(12) United States Patent
Coffin

(10) Patent No.: US 10,301,642 B2
(45) Date of Patent: May 28, 2019

(54) GENES AND USES FOR PLANT ENHANCEMENT

(71) Applicant: Monsanto Technology LLC, St. Louis, MO (US)

(72) Inventor: Marie Coffin, Cary, NC (US)

(73) Assignee: Monsanto Technology LLC, St. Louis, MO (US)

( * ) Notice: Subject to any disclaimer, the term of this patent is extended or adjusted under 35 U.S.C. 154(b) by 123 days.

(21) Appl. No.: 15/211,720

(22) Filed: Jul. 15, 2016

(65) Prior Publication Data

US 2016/0319297 A1 Nov. 3, 2016

Related U.S. Application Data

(60) Division of application No. 13/999,850, filed on Mar. 27, 2014, now abandoned, which is a continuation of application No. 13/140,920, filed as application No. PCT/US2009/068351 on Dec. 17, 2009.

(60) Provisional application No. 61/203,529, filed on Dec. 22, 2008.

(51) Int. Cl.
*C12N 15/82* (2006.01)
*C12Q 1/6895* (2018.01)

(52) U.S. Cl.
CPC ..... *C12N 15/8273* (2013.01); *C12N 15/8247* (2013.01); *C12N 15/8251* (2013.01); *C12N 15/8261* (2013.01); *C12N 15/8271* (2013.01); *C12Q 1/6895* (2013.01); *C12Q 2600/13* (2013.01); *C12Q 2600/158* (2013.01); *Y02A 40/146* (2018.01)

(58) Field of Classification Search
None
See application file for complete search history.

(56) References Cited

U.S. PATENT DOCUMENTS

| | | | |
|---|---|---|---|
| 7,196,245 B2 | 3/2007 | Jiang et al. | |
| 7,825,296 B2 | 11/2010 | Jiang et al. | |
| 7,956,242 B2 | 6/2011 | Zhang et al. | |
| 7,960,612 B2 | 6/2011 | Zhang et al. | |
| 8,030,546 B2 | 10/2011 | Reuber et al. | |
| 8,541,665 B2 | 9/2013 | Jiang et al. | |
| 2003/0204870 A1 | 10/2003 | Allen et al. | |
| 2005/0132445 A1 | 6/2005 | Fischer et al. | |
| 2007/0033671 A1* | 2/2007 | Jiang | C07K 14/415 800/278 |
| 2007/0101454 A1 | 5/2007 | Jiang et al. | |
| 2008/0313756 A1* | 12/2008 | Zhang | C07K 14/415 800/260 |
| 2009/0049566 A1 | 2/2009 | Zhang et al. | |
| 2009/0138981 A1 | 5/2009 | Repetti et al. | |
| 2011/0078806 A1 | 3/2011 | Jiang et al. | |
| 2011/0138499 A1 | 6/2011 | Zhang et al. | |
| 2011/0145949 A1 | 6/2011 | Hatzfeld et al. | |
| 2011/0258735 A1 | 10/2011 | Coffin | |
| 2012/0137382 A1 | 5/2012 | Repetti et al. | |
| 2014/0331357 A1 | 11/2014 | Coffin | |
| 2015/0135358 A1 | 5/2015 | Bohannon et al. | |
| 2015/0232874 A1 | 8/2015 | Hatzfeld et al. | |

FOREIGN PATENT DOCUMENTS

| | | |
|---|---|---|
| EP | 2270167 A3 | 1/2011 |
| EP | 2272962 A3 | 4/2011 |
| EP | 2270166 A3 | 8/2011 |
| EP | 1546336 B1 | 12/2011 |
| EP | 2441773 A1 | 4/2012 |
| WO | WO-2004031349 A2 | 4/2004 |
| WO | WO-2004031349 A3 | 4/2004 |
| WO | WO-2009009142 A2 | 1/2009 |
| WO | WO-2010020555 A1 | 2/2010 |
| WO | WO-2010075143 A1 | 7/2010 |

OTHER PUBLICATIONS

Friedberg. Automated protein function prediction—the genomic challenge. Briefings in Bioinformatics. 2006. 7(3): 225-242.*
"U.S. Appl. No. 13/140,920, Non Final Office Action dated Dec. 27, 2013", 14 pgs.
"U.S. Appl. No. 13/140,920, Response filed Nov. 13, 2013 to Restriction Requirement dated Sep. 10, 2013", 8 pgs.
"U.S. Appl. No. 13/140,920, Restriction Requirement dated Sep. 10, 2013", 12 pgs.
"U.S. Appl. No. 13/999,850, Non Final Office Action dated Mar. 22, 2016", 32 pgs.
"U.S. Appl. No. 13/999,850, Respnse filed Feb. 22, 2016 to Restriction Requirement dated Dec. 21, 2015", 9 pgs.
"U.S. Appl. No. 13/999,850, Restriction Requirement dated Dec. 21, 2015", 9 pgs.
"International Application Serial No. PCT/US2009/068351, International Search Report dated Apr. 28, 2010", 7 pgs.
"International Application Serial No. PCT/US2009/068351, Written Opinion dated Apr. 28, 2010", 8 pgs.
"International Application Serial No. PCT/US2009068351, International Preliminary Report on Patentability dated Jul. 7, 2011", 9 pgs.

(Continued)

*Primary Examiner* — Ashley K Buran

(74) *Attorney, Agent, or Firm* — Schwegman Lundberg & Woessner, P.A.

(57) ABSTRACT

The present invention discloses transgenic seeds for crops with enhanced agronomic traits are provided by trait-improving recombinant DNA in the nucleus of cells of the seed where plants grown from such transgenic seed exhibit one or more enhanced traits as compared to a control plant. Of particular interest are transgenic plants that have increased yield. The present invention also provides recombinant DNA molecules for expression of a protein, and recombinant DNA molecules for suppression of a protein.

3 Claims, 5 Drawing Sheets

Specification includes a Sequence Listing.

(56) References Cited

OTHER PUBLICATIONS

Englebrecht, et al., "Conservation, diversification and expansion of C2H2 zinc finger proteins in the *Arabidopsis thaliana* genome", BMC Genomics, 5(39), (2004), 1-17.
Friedberg, "Automated protein function prediction—the genomic challenge", Briefings in Bioinformatics, (2006), 225-242.
Guo, H. H, et al., "Protein tolerance to random amino acid change", Proc Natl Acad Sci U S A., 101(25), (2004), 9205-9210.

* cited by examiner

```
SEQ ID NO 2953    ------------------------------------------------------------
SEQ ID NO 5407    ------------------------------------------------------------
SEQ ID NO 4085    ------------------------------------------------------------
SEQ ID NO 2697    ------------------------------------------------------------
SEQ ID NO 237     ------------------------------------------------------------
SEQ ID NO 3937    MILDHASLEASNLSNHKGKSPNRKLFAQDNNDEISNDGKKKKKKIVHRDVERQRRQDMAT
SEQ ID NO 5922    ------------------------------------------------------MEKSPRQ----
SEQ ID NO 1193    MILDHASLEASNLCNHKGKSPNRKLFAQDNNDEISN-------------------------
SEQ ID NO 3378    ------------------------------------------------------------
SEQ ID NO 6033    ------------------------------------------------------------
Consensus ------------------------------------------------MDDCRDKRRRRCTKL
------------------------------------------------MDDCRDKRRRRCTKL
LYTSLRSLLPLEYIKGKRAISEHMNGAVNYIKHLQKKIKELGEKRNELKSLANSSSRNSS
----------------KVVLTPGKN-----------------------------------
--------------------------------------------xxxxxxxxxxxxxxxx TCGTDNNDMEKMMHRETERQRRQEMASLYASLRSLLPLHFIKGKRSTSDQVNEAVNYIKY
TCGTDNNDMEKMMHRETERQRRQEMASLYASLRSLLPLHFIKGKRSTSDQVNEAVNYIKY
--------MEKMMHRETERQRRQEMASLYASLRSLLPLHFIKGKRSTSDQVNEAVNYIKY
--------MEKLVHKEIEKRRRQEMASLYASLRSLLPLEFIQGKRSTSDQVKGAVNYIDY
-------------------------------GKRSTSDQVKGAVNYIDY
GNFNTSSSNKKILRRDMERQRRQEMANLNASLRSLLPLEYVKGKRSISDHMHEAVNYINH
-TENTSSSNKKILRRDMERQRRQEMANLNASLRSLLPLEYVKGKRSISDHMHEAVNYINH
---DGKKKKKKIVHRDVERQRRQDMATLYTSLRSLLPLEYIKGKRAISEHMNGAVNYIKH
--------KKKMIHKEIERQRRQEMATFYASLRSLLPLEFIKGKRSISDHMNEAVNYIKH
xxxxxxxxxxkxxxxxxergrrqemaxlxaslrsllplxxxkGKRsxSdxxxxAVNYIxx LQRKIKELSVRRDDLMVLSRGSLLGSSNGDFKEDVEMISGKNHVVVRQCLVGVEIMLSSR
LQRKIKELSVRRDDLMVLSRGSLLGSSNGDFKEDVEMISGKNHVVVRQCLVGVEIMLSSR
LQRKIKELSVRRDDLMVLSRGSLLGSSNGDFKEDVEMISGKNHVVVRQCLVGVEIMLSSR
LQRNIKDINSKRDDLVLLS-GRSFRSSN---EQEWNEIS--NHVVIRPCLVGIEIVLS--
LQRNIKDINSKRDDLVLLS-GRSFRSSN---EQEWNEIS--NHVVIRPCLVGIEIVLS--
LQMKIQDLGTKRDELRNQSNMSACDSES----GSSYKRSRHCVIVSP-CMDGVEILIS-G
LQMKIQDLGTKRDELRNQSNMSACDSES----GSSYKRSRHCVIVSP-CMDGVEILIS-G
LQKKIKELGEKRNELKSLANSSSRNS--------------SGNFVTVCP-CWGGVEIVLSSG
MQKHIKELGAKRDELKKLSNHSNNMENN-----HEGLHTSCNFTVHEKNGIMGIEITSVFR
lQxxIkxlxxxRdxLxxlsxxsxxxsxxxxxxxxxxxxSxxxxxvxxxcxxGxEIxxsxx CCGGQPRFSSVLQVLSEYGLCLLNSISSIVDDRLVYTIQAE-------------------
CCGGQPRFSSVLQVLSEYGLCLLNSISSIVDDRLVYTIQAEFIKMVGKNKNLCGCVVRGC
CCGGQPRFSSVLQVLSEYGLCLLNSISSIVDDRLVYTIQAE-------------------
---ILQTPFSSVLQVLREHGLYVLGYICSSVNDRLIHTLQAE------------------
---ILQTPFSSVLQVLREHGLYVLGYICSSVNDRLIHTLQAE------------------
GFKEGLLLSKVMEVLLEEGLGVHRCVSTKVNEGLLHTMNCKV------------------
GFKEGLLLSKVMEVLLEEGLGVHRCVSTKVNEGLLHTMNCKQ------------------
GEKEGMPLSRALETLLEEGLSVXSCISTKVXD-ITSIDLHG-------------------
EEKP-KISKLLQFLTEEGLEVVSFFSTEVNGRLLHSVQCEF-------------------
xxxxxxxxSxvlxvLxExGLxxxxxxsxxVxxxlxxtxxxxx------------------
```

FIG. 4a

```
-----VNDMALMIDLAELEKRLIRMK------------------------------*
MCIIKVNDMALMIDLAELEKRLIRMK------------------------------*
-----VNDMALMIDLAELEKRLIRMK------------------------------*
------VNDLAL-IDLADLKDTLTLMK------------------------------*
-----VQYLEL-TNFTAIEALLTLLRI-----------------------------*
------LRINIELSVHSFLPRYRVSCKVFTSFVEFHLSRSAIPQVLTYVGCGRNCGML*
-----VSDPTGFDLCGLRQKLWNAVTPSSR--------------------------*
------LQQQLSDQXLPHLDKLPSNTALRN--------------IPTI---------------*
------QQWTTIVAAEITATVKLAVADFRS--------------PDC---------------*
-----XXXXXXXXXXXXXXXXXXXXXXXXX------------XXX-------------*
```

FIG. 4b

GENES AND USES FOR PLANT ENHANCEMENT

CROSS REFERENCE TO RELATED APPLICATIONS

This application is a divisional of U.S. application Ser. No. 13/999,850, filed Mar. 27, 2014, which application is a continuation of U.S. application Ser. No. 13/140,920, filed Jun. 21, 2011, which is a national stage application under 35 U.S.C. § 371 of PCT/US2009/068351, filed Dec. 17, 2009, and published as WO 2010/075143 on Jul. 1, 2010, which claims the benefit of priority to U.S. provisional application Ser. No. 61/203,529, filed Dec. 22, 2008, which applications and publication are incorporated by reference as if reproduced herein and made a part hereof in their entirety, and the benefit of priority of each of which is claimed herein, along with sequence listings and computer program listings.

INCORPORATION OF SEQUENCE LISTING

This document incorporates by reference herein an electronic sequence listing text file, which is filed in electronic format via EFS-Web with the application. The text file is named "1598740.txt," is 17,264,640 bytes, and was created on Jul. 12, 2016.

FIELD OF THE INVENTION

Disclosed herein are transgenic plant cells, plants and seeds comprising recombinant DNA and methods of making and using such plant cells, plants and seeds.

SUMMARY OF THE INVENTION

This invention provides plant cell nuclei with recombinant DNA that imparts enhanced agronomic traits in transgenic plants having the nuclei in their cells, e.g. enhanced water use efficiency, enhanced cold tolerance, enhanced heat tolerance, enhanced shade tolerance, enhanced high salinity tolerance, increased yield, enhanced nitrogen use efficiency, enhanced seed protein or enhanced seed oil. In certain cases the trait is imparted by producing in the cells a protein that is encoded by recombinant DNA and/or in other cases the trait is imparted by suppressing the production of a protein that is natively produced in the cells.

Such recombinant DNA in a plant cell nucleus of this invention is provided in as a construct comprising a promoter that is functional in plant cells and that is operably linked to DNA that encodes a protein or to DNA that results in gene suppression. Such DNA in the construct is sometimes defined by protein domains of an encoded protein targeted for production or suppression, e.g. a "Pfam domain module" (as defined herein below) from the group of Pfam domain modules identified in Table 17. Alternatively, e.g. where a Pfam domain module is not available, such DNA in the construct is defined a consensus amino acid sequence of an encoded protein that is targeted for production or suppression, e.g. a protein having amino acid sequence with at least 90%, with at least 95%, with at least 98%, and with at least 99%, or 99.5% identity to a consensus amino acid sequence in the group of SEQ ID NO: 6027 through SEQ ID NO: 6034, or their corresponding nucleic acid sequences.

Other aspects of the invention are directed to specific derivative physical forms of the transgenic plant cell nuclei, e.g. where such a transgenic nucleus is present in a transgenic plant cell, a transgenic plant including plant part(s) such as progeny transgenic seed, and a haploid reproductive derivative of plant cell such as Iransgenic pollen and transgenic ovule. Such plant cell nuclei and derivatives are advantageously selected from a population of transgenic plants regenerated from plant cells having a nucleus that is transformed with recombinant DNA by screening the transgenic plants or progeny seeds in the population for an enhanced trait as compared to control plants or seed that do not have the recombinant DNA in their nuclei, where the enhanced trait is enhanced water use efficiency, enhanced cold tolerance, enhanced heat tolerance, enhanced shade tolerance, enhanced high salinity tolerance, increased yield, enhanced nitrogen use efficiency, enhanced seed protein or enhanced seed oil.

One aspect of the present invention includes a plant cell nucleus with stably integrated, recombinant DNA, wherein said recombinant DNA comprises a promoter that is functional in said plant cell and that is operably linked to a protein coding DNA encoding a protein having an amino acid sequence comprising a Pfam domain module selected from the group consisting of WRKY::WRKY, AP2, AUX_IAA, WRKY, WRKY, HLH, Myb_DNA-binding::Linker_histone, zf-B_box::zf-B_box, Ank::Ank::Ank::Chromo, NAM, zf-C2H2, Myb_DNA-binding, bZIP_1, PHD, Linker_histone::AT_hook::AT_hook::AT_hook::AT_hook, B3::Auxin_resp, HLH, zf-Dof, AT_hook::DUF296, AT_hook::AT_hook::DUF296, NAM, GATA, NAM, Myb_DNA-binding, zf-B_box::CCT, POX::Homeobox, B3::Auxin_resp::AUX_IAA, Myb_DNA-binding::Myb_DNA-binding, Myb_DNA-binding::Myb_DNA-binding, zf-C2H2, zf-C2H2, Myb_DNA-binding::Myb_DNA-binding, Myb_DNA-binding::Myb_DNA-binding, TCP, KNOX1::KNOX2, zf-ZPR1::zf-ZPR1, Myb_DNA-binding::Myb_DNA-binding, DUF630::DUF632, WRKY, Myb_DNA-binding, zf-C2H2, HLH, AP2, AT_hook::DUF296, Ank::Ank::Ank::Ank::Ank, WRKY, zf-C2H2, NAM, AP2, NAM, Myb_DNA-binding::Myb_DNA-binding::Myb_DNA-binding, NAM, HLH, Myb_DNA-binding::Myb_DNA-binding, Myb_DNA-binding, HLH, bZIP_2, bZIP_2, BAH::PHD, HLH, NAM, GATA, SSrc-cog::Rtt106::HMG_box, DUF573, zf-B_box::CCT, HLH, RWP-RK, AP2::B3, AUX_IAA, SRF-TF, AP2, AP2, HSF_DNA-bind, AP2, SRF-TF::K-box, Myb_DNA-binding, zf-LSD1::zf-LSD1::zf-LSD1, KNOX1::KNOX2::ELK, zf-C3HC4, MFMR::bZIP_1, DUF573, Myb_DNA-binding, HLH, NAM, Myb_DNA-binding::Myb_DNA-binding, SRF-TF::K-box, zf-C3HC4, zf-B_box, WRKY, zf-B_box::CCT, EIN3, HSF_DNA-bind, AUX_IAA, TCP, Myb_DNA-binding::Myb_DNA-binding, AP2, KNOX1::KNOX2::ELK::IHomeobox, HSF_DNA-bind, HSF_DNA-bind, AP2::B3, NAM, SBP, AP2, zf-C2H2. SRF-TF::K-box, zf-C2H2, GRAS, AP2, Myb_DNA-binding, AP2, AP2::AP2, HLH, CXC::CXC, AP2, NAM, zf-C3HC4, Myb_DNA-binding::Myb_DNA-binding, GRAS, Homeobox::HALZ, Myb_DNA-binding, NAM, WRKY, zf-C2H2, zf-C2H2, NAM, zf-C2H2, AP2::AP2, ef-C3HC4, RWP-RK::PB1, SRF-TF::K-box, and zf-B_box; said recombinant DNA comprises a promoter that is functional in said plant cell and that is operably linked to a protein coding DNA encoding a protein comprising an amino acid sequence with at least 90% identity to a consensus amino acid sequence selected from the group consisting of SEQ ID NO: 6027 through 6034; or said recombinant DNA suppresses comprises a promoter that is functional in said plant cell and operably linked to DNA that transcribe into RNA that suppresses the level of an endogenous protein wherein said endogenous protein has an amino acid sequence comprising a pfam domain module selected from the group consisting of RWP-RK, AUX_IAA, SRF-TF, zf-C3HC4, Myb_DNA-binding, CCT, PHD, EIN3, and AP2; and wherein said plant cell nucleus is selected by screening a population of transgenic plants that have said recombinant DNA and an enhanced trait as compared to control plants that do not have said recombinant DNA in their nuclei; and wherein said enhanced trait is selected from group of enhanced traits consisting of enhanced water use efficiency, enhanced cold tolerance, enhanced heat tolerance, enhanced resistance to salt exposure, enhanced shade tolerance, increased yield, enhanced nitrogen use efficiency, enhanced seed protein and enhanced seed oil.

In another aspect of the present invention, the plant cell nucleus where said protein coding DNA encodes a protein having an amino acid sequence selected from the group consisting of SEQ ID NO: 140 through SEQ ID NO: 6023. In addition, the plant cell nucleus can comprising DNA expressing a protein that provides tolerance from exposure to an herbicide, e.g., glyphosate, dicamba, or glufosinate, applied at levels that are lethal to a wild type of said plant cell.

Yet in another aspect of the invention includes a plurality of plant cells or plants with the plant cell nucleus described, and the transgenic plant cell or plant are homozygous for said recombinant DNA. In addition, these plant cells are transgenic seeds from crops such as a corn, soybean, cotton, canola, alfalfa, wheat or rice plant, or transgenic pollen grain comprising a haploid derivative of a plant cell nucleus.

One aspect of the present invention includes a method for manufacturing non-natural, transgenic seed that can be used to produce a crop of transgenic plants with an enhanced trait resulting from expression of recombinant DNA in a nucleus described, wherein said method for manufacturing said transgenic seed comprising (a) screening a population of plants for said enhanced trait and said recombinant DNA, wherein individual plants in said population can exhibit said trait at a level less than, essentially the same as or greater than the level that said trait is exhibited in control plants which do not contain the recombinant DNA, wherein said enhanced trait is selected from the group of enhanced traits consisting of enhanced water use efficiency, enhanced cold tolerance, enhanced heat tolerance, enhanced high salinity tolerance, enhanced shade tolerance, increased yield, enhanced nitrogen use efficiency, enhanced seed protein and enhanced seed oil, (b) selecting from said population one or more plants that exhibit said trait at a level greater than the level that said trait is exhibited in control plants, and (c) collecting seeds from selected plant selected from step b.

In another aspect, the method for manufacturing transgenic seed, e.g, corn, soybean, cotton, alfalfa, canola wheat or rice seed, further comprising (a) verifying that said recombinant DNA is stably integrated in said selected plants, and (b) analyzing tissue of said selected plant to determine the expression or suppression of a protein having the function of a protein having an amino acid sequence selected from the group consisting of SEQ ID NO: 140-278.

Yet another aspect of the present invention includes a method of producing hybrid corn seed comprising (a) acquiring hybrid corn seed from a herbicide tolerant corn plant which also has stably-integrated, recombinant DNA in a nucleus of claim 2: (b) producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; (c) selecting corn plants which are homozygous and hemizygous for said recombinant DNA by treating with an herbicide; (d) collecting seed from herbicide-treated-surviving corn plants and planting said seed to produce further progeny corn plants; (e) repeating steps (c) and (d) at least once to produce an inbred corn line; and (f) crossing said inbred corn line with a second corn line to produce hybrid seed.

In one aspect of the invention, the transgenic plant comprise recombinant DNA constructs for expressing proteins are characterized by amino acid sequence that have at least 90% identity over at least 90% of the length of a reference sequence selected from the group consisting of SEQ ID NOs: 140-278 when the amino acid sequence is aligned to the reference sequence.

In one aspect of the invention, the transgenic plant comprise recombinant DNA constructs for expressing proteins are characterized by amino acid sequence that have at least 92.5% identity over at least 92.5% of the length of a reference sequence selected from the group consisting of SEQ ID NOs: 140-278 when the amino acid sequence is aligned to the reference sequence.

In one aspect of the invention, the transgenic plant comprise recombinant DNA constructs for expressing proteins are characterized by amino acid sequence that have at least 95% identity over at least 95% of the length of a reference sequence selected from the group consisting of SEQ ID NOs: 140-278 when the amino acid sequence is aligned to the reference sequence.

In one aspect of the invention, the transgenic plant comprise recombinant DNA constructs for expressing proteins are characterized by amino acid sequence that have at least 97% identity over at least 97% of the length of a reference sequence selected from the group consisting of SEQ ID NOs: 140-278 when the amino acid sequence is aligned to the reference sequence.

In one aspect of the invention, the transgenic plant comprise recombinant DNA constructs for expressing proteins are characterized by amino acid sequence that have at least 98% identity over at least 98% of the length of a reference sequence selected from the group consisting of SEQ ID NOs: 140-278 when the amino acid sequence is aligned to the reference sequence.

In one aspect of the invention, the transgenic plant comprise recombinant DNA constructs for expressing proteins are characterized by amino acid sequence that have at least 99% identity over at least 99% of the length of a reference sequence selected from the group consisting of SEQ ID NOs: 140-278 when the amino acid sequence is aligned to the reference sequence.

In one aspect of the invention, the transgenic plant comprise recombinant DNA constructs for expressing proteins are characterized by amino acid sequence that have at least 99.5% identity over at least 99.5% of the length of a reference sequence selected from the group consisting of SEQ ID NOs: 140-278 when the amino acid sequence is aligned to the reference sequence.

In other aspects of the invention the nuclei of plant cells and derivative transgenic cells, plants, seeds, pollen and ovules further include recombinant DNA expressing a protein that provides tolerance from exposure to one or more herbicide applied at levels that are lethal to a wild type plant. Such herbicide tolerance is not only an advantageous trait in such plants but is also useful as a selectable marker in the transformation methods for producing the nuclei and nuclei derivatives of the invention. Such herbicide tolerance includes tolerance to a glyphosate, dicamba, or glufosinate herbicide.

Yet other aspects of the invention provide transgenic plant cell nuclei which are homozygous for the recombinant DNA. The transgenic plant cell nuclei of the invention and derivative cells, plants, seed and haploid reproductive derivatives of the invention are advantageously provided in corn, soybean, cotton, canola, alfalfa, wheat, rice plants, or combinations thereof.

This invention also provides methods for manufacturing non-natural, transgenic seed that can be used to produce a crop of transgenic plants with an enhanced trait resulting from expression of stably-integrated, recombinant DNA in the nucleus of the plant cells. More specifically the method includes, but are not limited to, (a) screening a population of plants for an enhanced trait and recombinant DNA, where individual plants in the population can exhibit the trait at a level less than, essentially the same as or greater than the level that the trait is exhibited in control plants which do not express the recombinant DNA; (b) selecting from the population one or more plants that exhibit the trait at a level greater than the level that said trait is exhibited in control plants and (c) collecting seed from a selected plant. Such method can further include the steps of (a) verifying that the recombinant DNA is stably integrated in said selected plants; and (b) analyzing tissue of a selected plant to determine the production of a protein having the function of a protein encoded by a recombinant DNA with a sequence of one of SEQ ID NO: 1-139; In one aspect of the invention the plants in the population can further include DNA expressing a protein that provides tolerance to exposure to an herbicide applied at levels that are lethal to wild type plant cells and where the selecting is effected by treating the population with the herbicide, e.g. a glyphosate, dicamba, or glufosinate compound. In another aspect of the invention, the plants are selected by identifying plants with the enhanced trait. The methods can be used for manufacturing corn, soybean, cotton, canola, alfalfa, wheat and/or rice seed selected as having one of the enhanced traits described above.

Another aspect of the invention provides a method of producing hybrid corn seed including the step of acquiring hybrid corn seed from a herbicide tolerant corn plant which also has a nucleus of this invention with stably-integrated, recombinant DNA. The method can further include the steps of producing corn plants from said hybrid corn seed, where a fraction of the plants produced from said hybrid corn seed is homozygous for said recombinant DNA, a fraction of the plants produced from said hybrid corn seed is hemizygous for said recombinant DNA, and/or a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

BRIEF DESCRIPTION OF THE DRAWINGS

FIGS. 4(a) and 4(b) illustrate a consensus amino acid sequence of SEQ ID NO: 237 and their homologs.

DETAILED DESCRIPTION OF THE INVENTION

Figure 1:
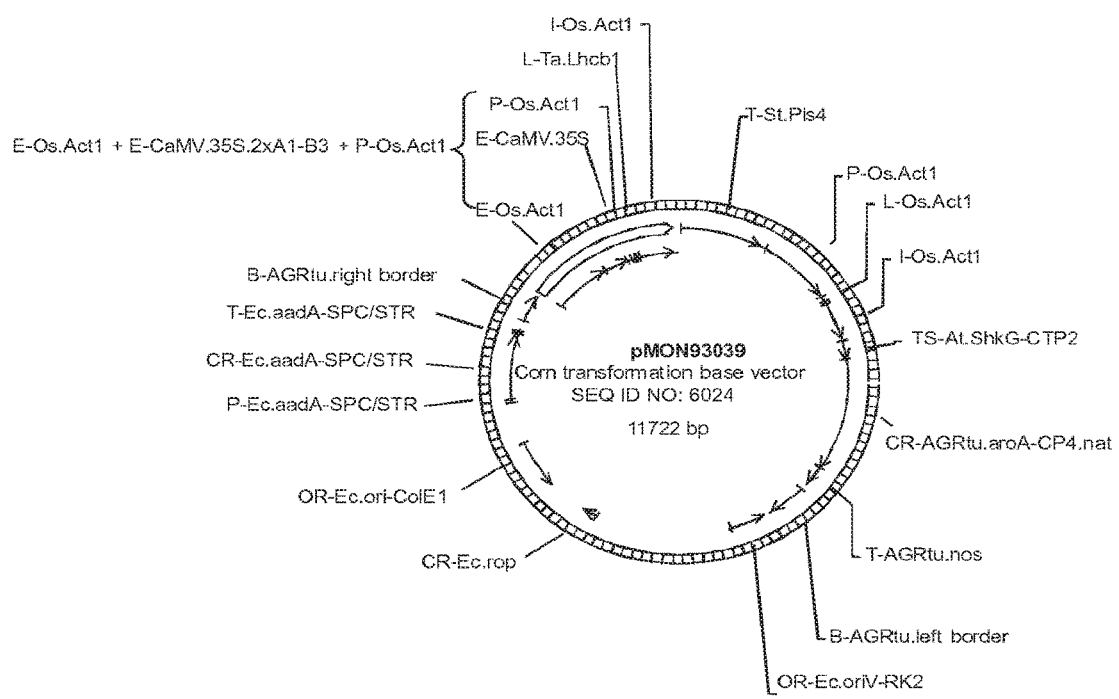
FIGS. 1, 2 and 3 are pictures illustrating plasmid maps.

In the attached sequence listing:
SEQ ID NO: 1-139 are nucleotide sequences of the coding strand of DNA for "genes" used in the recombinant DNA imparting an enhanced trait in plant cells, i.e. each represents a coding sequence for a protein;
SEQ ID NO: 140-278 are amino acid sequences of the protein of the "genes" encoding by nucleotide sequence 1-139;
SEQ ID NO: 279-6023 homologs are amino acid sequences of homologous proteins;
SEQ ID NO: 6024 is a nucleotide sequence of a plasmid base vector useful for corn transformation;
SEQ ID NO: 6025 is a DNA sequence of a plasmid base vector useful for soybean transformation;
SEQ ID NO: 6026 is a DNA sequence of a plasmid base vector useful for cotton transformation; and
SEQ ID NO: 6027-6034 are consensus sequences.

Table 1 lists the protein SEQ ID NOs and their corresponding consensus SEQ ID NOs.

TABLE 1

| NUC SEQ ID NO | PEP SEQ ID NO | GENE ID | CONSENSUS SEQ ID NO |
| --- | --- | --- | --- |
| 4 | 143 | CGPG2053 | 6027 |
| 21 | 160 | CGPG2704 | 6028 |
| 23 | 162 | CGPG2735 | 6029 |
| 50 | 189 | CGPG3347 | 6030 |
| 52 | 191 | CGPG3449 | 6031 |
| 95 | 234 | CGPG4537 | 6032 |
| 98 | 237 | CGPG4632 | 6033 |
| 139 | 278 | CGPG8726 | 6034 |

The nuclei of this invention are identified by screening transgenic plants for one or more traits including enhanced drought stress tolerance, enhanced heat stress tolerance, enhanced cold stress tolerance, enhanced high salinity stress tolerance, enhanced low nitrogen availability stress tolerance, enhanced shade stress tolerance, enhanced plant growth and development at the stages of seed imbibition through early vegetative phase, and enhanced plant growth and development at the stages of leaf development, flower production and seed maturity.

"Gene" means a chromosomal element for expressing a protein and specifically includes the DNA encoding a protein. In cases where expression of a target protein is desired, the pertinent part of a gene is the DNA encoding the target protein; in cases where suppression of a target is desired, the pertinent part of a gene is that part that is transcribed as mRNA. "Recombinant DNA" means a polynucleotide having a genetically engineered modification introduced through combination of endogenous and/or exogenous elements in a transcription unit. Recombinant DNA can include DNA segments obtained from different sources, or DNA segments obtained from the same source, but which have been manipulated to join DNA segments which do not naturally exist in the joined form.

"Trait" means a physiological, morphological, biochemical, or physical characteristic of a plant or particular plant material or cell, or any combinations thereof.

A "control plant" is a plant without trait-improving recombinant DNA in its nucleus. A control plant is used to measure and compare trait enhancement in a transgenic plant with such trait-improving recombinant DNA. A suitable control plant can be a non-transgenic plant of the parental line used to generate a transgenic plant herein. Alternatively, a control plant can be a transgenic plant having an empty vector or marker gene, but does not contain the recombinant DNA that produces the trait enhancement. A control plant can also be a negative segregant progeny of hemizygous transgenic plant. In certain demonstrations of trait enhancement, the use of a limited number of control plants can cause a wide variation in the control dataset. To minimize the effect of the variation within the control dataset, a "reference" is used. As use herein a "reference" is a trimmed mean of all data from both transgenic and control plants grown under the same conditions and at the same developmental stage. The trimmed mean is calculated by eliminating a specific percentage, e.g., 20%, of the smallest and largest observation from the data set and then calculating the average of the remaining observation.

"Trait enhancement" means a detectable and desirable difference in a characteristic in a transgenic plant relative to a control plant or a reference. In some cases, the trait enhancement can be measured quantitatively. For example, the trait enhancement can entail at least a 2% desirable difference in an observed trait, at least a 5% desirable difference, at least about a 10% desirable difference, at least about a 20% desirable difference, at least about a 30% desirable difference, at least about a 50% desirable difference, at least about a 70% desirable difference, at least about a 80% desirable difference, at least about a 90% desirable difference, at least about a 92.5% desirable difference, at least about a 95% desirable difference, at least about a 98% desirable difference, at least about a 99% desirable difference, at least about a 99.5% desirable difference or at least about a 100% difference, or an even greater desirable difference. In other cases, the trait enhancement is only measured qualitatively. It is known that there can be a natural variation in a trait. Therefore, the trait enhancement observed entails a change of the normal distribution of the trait in the transgenic plant compared with the trait distribution observed in a control plant or a reference, which is evaluated by statistical methods provided herein. Trait enhancement includes, but is not limited to, yield increase, including increased yield under non-stress conditions and increased yield under environmental stress conditions. Stress conditions can include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability, high plant density, or any combinations thereof.

Many agronomic traits can affect "yield", including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, juvenile traits, or any combinations thereof. Other traits that can affect yield include, efficiency of germination (including germination in stressed conditions), growth rate (including growth rate in stressed conditions), ear number, seed number per ear, seed size, composition of seed (starch, oil, protein) and characteristics of seed fill. Also of interest is the generation of transgenic plants that demonstrate desirable phenotypic properties that can confer an increase in overall plant yield. Such properties include enhanced plant morphology, plant physiology or improved components of the mature seed harvested from the transgenic plant.

"Yield-limiting environment" means the condition under which a plant would have the limitation on yield including environmental stress conditions.

"Stress condition" means a condition unfavorable for a plant, which adversely affect plant metabolism, growth and/or development. A plant under the stress condition typically shows reduced germination rate, retarded growth and development, reduced photosynthesis rate, and eventually leading to reduction in yield. Specifically, "water deficit stress" used herein refers to the sub-optimal conditions for water and humidity needed for normal growth of natural plants. Relative water content (RWC) can be used as a physiological measure of plant water deficit. It measures the effect of osmotic adjustment in plant water status, when a plant is under stressed conditions. Conditions which can result in water deficit stress include, but are not limited to, heat, drought, high salinity and PEG induced osmotic stress.

"Cold stress" means the exposure of a plant to a temperatures below (two or more degrees Celsius below) those normal for a particular species or particular strain of plant.

"Nitrogen nutrient" means any one or any mix of the nitrate salts commonly used as plant nitrogen fertilizer, including, but not limited to, potassium nitrate, calcium nitrate, sodium nitrate, ammonium nitrate. The term ammonium as used herein means any one or any mix of the ammonium salts commonly used as plant nitrogen fertilizer, e.g., ammonium nitrate, ammonium chloride, ammonium sulfate, etc.

"Low nitrogen availability stress" means a plant growth condition that does not contain sufficient nitrogen nutrient to maintain a healthy plant growth and/or for a plant to reach its typical yield under a sufficient nitrogen growth condition. For example, a limiting nitrogen condition can refers to a growth condition with 50% or less of the conventional nitrogen inputs. "Sufficient nitrogen growth condition" means a growth condition where the soil or growth medium contains or receives optimal amounts of nitrogen nutrient to sustain a healthy plant growth and/or for a plant to reach its typical yield for a particular plant species or a particular strain. One skilled in the art would recognize what constitute such soil, media and fertilizer inputs for most plant species.

"Shade stress" means a growth condition that has limited light availability that triggers the shade avoidance response in plant. Plants are subject to shade stress when localized at lower part of the canopy, or in close proximity of neighboring vegetation. Shade stress can become exacerbated when the planting density exceeds the average prevailing density for a particular plant species.

"Increased yield" of a transgenic plant of the present invention is evidenced and measured in a number of ways, including test weight, seed number per plant, seed weight, seed number per unit area (e.g., seeds, or weight of seeds, per acre), bushels per acre, tons per acre, tons per acre, kilo per hectare. For example, maize yield can be measured as production of shelled corn kernels per unit of production area, e.g., in bushels per acre or metric tons per hectare, often reported on a moisture adjusted basis, e.g., at 15.5% moisture. Increased yield can result from enhanced utilization of key biochemical compounds, such as nitrogen, phosphorous and carbohydrate, or from enhanced tolerance to environmental stresses, such as cold, heat, drought, salt, and attack by pests or pathogens. Trait-improving recombinant DNA can also be used to provide transgenic plants having enhanced growth and development, and ultimately increased yield, as the result of modified expression of plant growth regulators or modification of cell cycle or photosynthesis pathways.

A "plant promoter" is a promoter capable of initiating transcription in plant cells whether or not its origin is a plant cell. Exemplary plant promoters include, but are not limited to, those that are obtained from plants, plant viruses, and bacteria which include genes expressed in plant cells such *Agrobacterium* or *Rhizobium*. Examples of promoters under developmental control include promoters that preferentially initiate transcription in certain tissues, such as leaves, roots, or seeds. Such promoters are referred to as "tissue preferred". Promoters which initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that can effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions.

As used herein, "operably linked" refers to the association of two or more nucleic acid elements in a recombinant DNA construct, e.g. as when a promoter is operably linked with DNA that is transcribed to RNA whether for expressing or suppressing a protein. Recombinant DNA constructs can be designed to express a protein which can be an endogenous protein, an exogenous homologue of an endogenous protein or an exogenous protein with no native homologue. Alternatively, recombinant DNA constructs can be designed to suppress the level of an endogenous protein, e.g. by suppression of the native gene. Such gene suppression can be effectively employed through a native RNA interference (RNAi) mechanism in which recombinant DNA comprises both sense and anti-sense oriented DNA matched to the gene targeted for suppression where the recombinant DNA is transcribed into RNA that can form a double-strand to initiate an RNAi mechanism. Gene suppression can also be effected by recombinant DNA that comprises anti-sense oriented DNA matched to the gene targeted for suppression. Gene suppression can also be effected by recombinant DNA that comprises DNA that is transcribed to a microRNA matched to the gene targeted for suppression. In the examples illustrating the invention recombinant DNA for effecting gene suppression that imparts is identified by the term "antisense". It will be understood by a person of ordinary skill in the art that any of the ways of effecting gene suppression are contemplated and enabled by a showing of one approach to gene suppression.

A "consensus amino acid sequence" means an artificial, amino acid sequence indicating conserved amino acids in the sequence of homologous proteins as determined by statistical analysis of an optimal alignment, e.g. CLUSTALW, of amino acid sequence of homolog proteins. The consensus sequences listed in the sequence listing were created by identifying the most frequent amino acid at each position in a set of aligned protein sequences. When there was 100% identity in an alignment the amino acid is indicated by a capital letter. When the occurrence of an amino acid is at least about 70% in an alignment, the amino acid is indicated by a lower case letter. When there is no amino acid occurrence of at least about 70%, e.g. due to diversity or gaps, the amino acid is indicated by an "x".

When used to defined embodiments of the invention, a consensus amino acid sequence will be aligned with a query protein amino acid sequence in an optimal alignment, e.g. CLUSTALW. An embodiment of the invention will have identity to the conserved amino acids indicated in the consensus amino acid sequence.

As used herein a "homolog" means a protein in a group of proteins that perform the same biological function, e.g. proteins that belong to the same Pfam protein family and that provide a common enhanced trait in transgenic plants of this invention. Homologs are expressed by homologous genes. With reference to homologous genes, homologs include orthologs, e.g. genes expressed in different species that evolved from a common ancestral genes by speciation and encode proteins retain the same function, but do not include paralogs, e.g., genes that are related by duplication but have evolved to encode proteins with different functions. Homologous genes include naturally occurring alleles and artificially-created variants. Degeneracy of the genetic code provides the possibility to substitute at least one base of the protein encoding sequence of a gene with a different base without causing the amino acid sequence of the polypeptide produced from the gene to be changed. When optimally aligned, homolog proteins have typically at least about 60% identity, in some instances at least about 70%, for example about 80% and even at least about 90% identity over the full length of a protein, such as from SEQ ID No. 140-278, identified as being associated with imparting an enhanced trait when expressed in plant cells. In one aspect of the invention homolog proteins have an amino acid sequence that has at least 95%, 98%, 99%, or 99.5% identity to a consensus amino acid sequence of proteins and homologs disclosed herein.

Homologs are identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. Because a protein hit with the best E-value for a particular organism may not necessarily be an ortholog, i.e. have the same function, or be the only ortholog, a reciprocal query is used to filter hit sequences with significant E-values for ortholog identification. The reciprocal query entails search of the significant hits against a database of amino acid sequences from the base organism that are similar to the sequence of the query protein. A hit can be identified as an ortholog, when the reciprocal query's best hit is the query protein itself or a protein encoded by a duplicated gene after speciation. A further aspect of the homologs encoded by DNA useful in the transgenic plants of the invention are those proteins that differ from a disclosed protein as the result of deletion or insertion of one or more amino acids in a native sequence.

As used herein, "percent identity" means the extent to which two optimally aligned DNA or protein segments are invariant throughout a window of alignment of components, for example nucleotide sequence or amino acid sequence. An "identity fraction" for aligned segments of a test sequence and a reference sequence is the number of identical components that are shared by sequences of the two aligned segments divided by the total number of sequence components in the reference segment over a window of alignment which is the smaller of the full test sequence or the full reference sequence. "Percent identity" ("% identity") is the identity fraction times 100. Such optimal alignment is understood to be deemed as local alignment of DNA sequences. For protein alignment, a local alignment of protein sequences should allow introduction of gaps to achieve optimal alignment. Percent identity is calculated over the aligned length not including the gaps introduced by the alignment per se.

Homologous genes are genes which encode proteins with the same or similar biological function to the protein encoded by the second gene. Homologous genes can be generated by the event of speciation (see ortholog) or by the event of genetic duplication (see paralog). "Orthologs" refer to a set of homologous genes in different species that evolved from a common ancestral gene by specification. Normally, orthologs retain the same function in the course of evolution; and "paralogs" refer to a set of homologous genes in the same species that have diverged from each other as a consequence of genetic duplication. Thus, homologous genes can be from the same or a different organism. As used herein, "homolog" means a protein that performs the same biological function as a second protein including those identified by sequence identity search.

"*Arabidopsis*" means plants of *Arabidopsis thaliana*.

"Pfam" database is a large collection of multiple sequence alignments and hidden Markov models covering many common protein families, e.g. Pfam version 19.0 (December 2005) contains alignments and models for 8183 protein families and is based on the Swissprot 47.0 and SP-TrEMBL 30.0 protein sequence databases. See S. R. Eddy, "Profile Hidden Markov Models", *Bioinformatics* 14:755-763, 1998. The Pfam database is currently maintained and updated by the Pfam Consortium. The alignments represent some evolutionary conserved structure that has implications for the protein's function. Profile hidden Markov models (profile HMMs) built from the protein family alignments are useful for automatically recognizing that a new protein belongs to an existing protein family even if the homology by alignment appears to be low.

A "Pfam domain module" is a representation of Pfam domains in a protein, in order from N terminus to C terminus. In a Pfam domain module individual Pfam domains are separated by double colons "::". The order and copy number of the Pfam domains from N to C terminus are attributes of a Pfam domain module. Although the copy number of repetitive domains is important, varying copy number often enables a similar function. Thus, a Pfam domain module with multiple copies of a domain should define an equivalent Pfam domain module with variance in the number of multiple copies. A Pfam domain module is not specific for distance between adjacent domains, but contemplates natural distances and variations in distance that provide equivalent function. The Pfam database contains both narrowly- and broadly-defined domains, leading to identification of overlapping domains on some proteins. A Pfam domain module is characterized by non-overlapping domains. Where there is overlap, the domain having a function that is more closely associated with the function of the protein (based on the E value of the Pfam match) is selected.

Once one DNA is identified as encoding a protein which imparts an enhanced trait when expressed in transgenic plants, other DNA encoding proteins with the same Pfam domain module are identified by querying the amino acid sequence of protein encoded by candidate DNA against the Hidden Markov Models which characterizes the Pfam domains using HMMER software, a current version of which is provided in the appended computer listing. Candidate proteins meeting the same Pfam domain module are in the protein family and have corresponding DNA that is useful in constructing recombinant DNA for the use in the plant cells of this invention. Hidden Markov Model databases for use with HMMER software in identifying DNA expressing protein with a common Pfam domain module for recombinant DNA in the plant cells of this invention are also included in the appended computer listing.

Version 19.0 of the HMMER software and Pfam databases were used to identify known domains in the proteins corresponding to amino acid sequence of SEQ ID NO: 140 through SEQ ID NO:278. All DNA encoding proteins that have scores higher than the gathering cutoff disclosed in Table 19 by Pfam analysis disclosed herein can be used in recombinant DNA of the plant cells of this invention, e.g. for selecting transgenic plants having enhanced agronomic traits. The relevant Pfam modules for use in this invention, as more specifically disclosed below, are WRKY::WRKY, AP2, AUX_IAA, WRKY, WRKY, HLH, Myb_DNA-binding::Linker_histone, zf-B_box::zf-B_box, Ank::Ank::Ank::Chromo, NAM, zf-C2H2, Myb_DNA-binding, bZIP_1, PHD, Linker_histone::AT_hook::AT_hook::AT_hook::AT_hook, B3::Auxin_resp, HLH, zf-Dof, AT_hook::DUF296, AT_hook::AT_hook::DUF296, NAM, GATA, NAM, Myb_DNA-binding, zf-B_box::CCT, POX::Homeobox, B3::Auxin_resp::AUX_IAA, Myb_DNA-binding::Myb_DNA-binding, Myb_DNA-binding::Myb_DNA-binding, zf-C2H2, zf-C2H2, Myb_DNA-binding::Myb_DNA-binding, Myb_DNA-binding::Myb_DNA-binding, TCP, KNOX1::KNOX2, zf-ZPR1::zf-ZPR1, Myb_DNA-binding::Myb_DNA-binding, DUF630::DUF632, WRKY, Myb_DNA-binding, zf-C2H2, HLH, AP2, AT_hook::DUF296, Ank::Ank::Ank::Ank::Ank, WRKY, zf-C2H2, NAM, AP2, NAM, Myb_DNA-binding::Myb_DNA-binding::Myb_DNA-binding, NAM, HLH, Myb_DNA-binding::Myb_DNA-binding, Myb_DNA-binding, HLH, bZIP_2, bZIP_2, BAH::PHD, HLH, NAM, GATA, SSrecog::Rtt106::HMG_box, DUF573, zf-B_box::CCT, HLH, RWP-RK, AP2::B3, AUX_IAA, SRF-TF, AP2, AP2, HSF_DNA-bind, AP2, SRF-TF::K-box, Myb_DNA-binding, zf-LSD1::zf-LSD1::zf-LSD1, KNOX1::KNOX2::ELK, zf-C3HC4, MFMR::bZIP_1, DUF573, Myb_DNA-binding, HLH, NAM, Myb_DNA-binding::Myb_DNA-binding, SRF-TF::K-box, zf-C3HC4, zf-B_box, WRKY, zf-B_box::CCT, EIN3, HSF_DNA-bind, AUX_IAA, TCP, Myb_DNA-binding::Myb_DNA-binding, AP2, KNOX1::KNOX2::ELK::Homeobox, HSF_DNA-bind, HSF_DNA-bind, AP2::B3, NAM, SBP, AP2, zf-C2H2, SRF-TF::K-box, zf-C2H2, GRAS, AP2, Myb_DNA-binding, AP2, AP2::AP2, HLH, CXC::CXC, AP2, NAM, zf-C3HC4, Myb_DNA-binding::Myb_DNA-binding, GRAS, Homeobox::HALZ, Myb_DNA-binding, NAM, WRKY, zf-C2H2, zf-C2H2, NAM, zf-C2H2, AP2::AP2, zf-C3HC4, RWP-RK::PB1, SRF-TF::K-box, and zf-B_box.

Recombinant DNA Constructs

The invention uses recombinant DNA for imparting one or more enhanced traits to transgenic plant when incorporated into the nucleus of the plant cells. Such recombinant DNA is a construct comprising a promoter operatively linked to DNA for expression or suppression of a target protein in plant cells. Other construct components can include additional regulatory elements, such as 5' or 3' untranslated regions (such as polyadenylation sites), intron regions, and transit or signal peptides. Such recombinant DNA constructs can be assembled using methods known to those of ordinary skill in the art.

Recombinant constructs prepared in accordance with the present invention also generally include a 3' untranslated DNA region (UTR) that typically contains a polyadenylation sequence following the polynucleotide coding region. Examples of useful 3' UTRs include those from the nopaline synthase gene of *Agrobacterium tumefaciens* (nos), a gene encoding the small subunit of a ribulose-1,5-bisphosphate carboxylase-oxygenase (rbcS), and the T7 transcript of *Agrobacterium tumefaciens*.

Constructs and vectors can also include a transit peptide for targeting of a gene target to a plant organelle, particularly to a chloroplast, leucoplast or other plastid organelle. For descriptions of the use of chloroplast transit peptides, see U.S. Pat. Nos. 5,188,642 and 5,728,925, incorporated herein by reference.

Table 2 provides a list of genes that provided recombinant DNA that was expressed in a model plant and identified from screening as imparting an enhanced trait. When the stated orientation is "sense", the expression of the gene or a homolog in a crop plant provides the means to identify transgenic events that provide an enhanced trait in the crop plant. When the stated orientation is "antisense", the suppression of the native homolog in a crop plant provides the means to identify transgenic events that provide an enhanced trait in the crop plant. In some cases the expression/suppression in the model plant exhibited an enhanced trait that corresponds to an enhanced agronomic trait, e.g. cold stress tolerance, water deficit stress tolerance, low nitrogen stress tolerance and the like. In other cases the expression/suppression in the model plant exhibited an enhanced trait that is a surrogate to an enhanced agronomic trait, e.g. salinity stress tolerance being a surrogate to drought tolerance or improvement in plant growth and development being a surrogate to enhanced yield. Even when expression of a transgene or suppression of a native gene imparts an enhanced trait in a model plant, not every crop plant expressing the same transgene or suppressing the same native gene will necessarily demonstrate an indicated enhanced agronomic trait. For instance, it is well known that multiple transgenic events are required to identify a transgenic plant that can exhibit an enhanced agronomic trait. A skilled artisan can identify a transgenic plant cell nuclei, cell, plant or seed by making number of transgenic events, typically a very large number, and engaging in screening processes identified in this specification and illustrated in the examples. For example, a screening process includes selecting only those transgenic events with an intact, single copy of the recombinant DNA in a single locus of the host plant genome and further screening for transgenic events that impart a desired trait that is replicatable when the recombinant DNA is introgressed into a variety of germplams without imparting significant adverse traits.

An understanding of Table 2 is facilitated by the following description of the headings:

"NUC SEQ ID NO" refers to a SEQ ID NO. for particular DNA sequence in the Sequence Listing.

"PEP SEQ ID NO" refers to a SEQ ID NO. in the Sequence Listing for the amino acid sequence of a protein corresponding to a particular DNA "construct_id" refers to an arbitrary number used to identify a particular recombinant DNA construct comprising the particular DNA.

"Gene ID" refers to an arbitrary name used to identify the particular DNA.

"orientation" refers to the orientation of the particular DNA in a recombinant DNA construct relative to the promoter.

TABLE 2

| NUC SEQ ID NO | Gene id | PEP SEQ ID NO | Construct id | Orientation |
|---|---|---|---|---|
| 1 | CGPG113 | 140 | 12796 | SENSE |
| 2 | CGPG1754 | 141 | 18301 | SENSE |
| 3 | CGPG1809 | 142 | 70733 | ANTI-SENSE |
| 4 | CGPG2053 | 143 | 17013 | SENSE |
| 5 | CGPG2164 | 144 | 15707 | ANTI-SENSE |
| 6 | CGPG2551 | 145 | 17507 | SENSE |
| 7 | CGPG2578 | 146 | 17518 | SENSE |
| 8 | CGPG2583 | 147 | 17521 | SENSE |
| 9 | CGPG2586 | 148 | 17523 | SENSE |
| 10 | CGPG2593 | 149 | 17629 | SENSE |
| 11 | CGPG2594 | 150 | 70734 | SENSE |
| 12 | CGPG26 | 151 | 10106 | ANTI-SENSE |
| 13 | CGPG2604 | 152 | 72053 | SENSE |
| 14 | CGPG2615 | 153 | 76106 | SENSE |
| 15 | CGPG2639 | 154 | 17491 | SENSE |
| 16 | CGPG2644 | 155 | 19152 | SENSE |
| 17 | CGPG2657 | 156 | 17907 | SENSE |
| 18 | CGPG2664 | 157 | 17526 | SENSE |
| 19 | CGPG2678 | 158 | 70736 | SENSE |
| 20 | CGPG2699 | 159 | 76073 | SENSE |
| 21 | CGPG2704 | 160 | 76239 | SENSE |
| 22 | CGPG2711 | 161 | 18215 | SENSE |
| 23 | CGPG2735 | 162 | 72674 | SENSE |
| 24 | CGPG2752 | 163 | 17909 | SENSE |
| 25 | CGPG2757 | 164 | 17911 | SENSE |
| 26 | CGPG2767 | 165 | 17914 | SENSE |
| 27 | CGPG2778 | 166 | 74311 | SENSE |
| 28 | CGPG2797 | 167 | 78468 | SENSE |
| 29 | CGPG2805 | 168 | 19640 | SENSE |
| 30 | CGPG2811 | 169 | 71530 | SENSE |
| 31 | CGPG2907 | 170 | 17832 | SENSE |
| 32 | CGPG2935 | 171 | 18504 | SENSE |
| 33 | CGPG2943 | 172 | 18547 | SENSE |
| 34 | CGPG2948 | 173 | 18548 | SENSE |
| 35 | CGPG2961 | 174 | 18387 | SENSE |
| 36 | CGPG2975 | 175 | 18542 | SENSE |
| 37 | CGPG2985 | 176 | 74056 | SENSE |
| 38 | CGPG3107 | 177 | 73821 | SENSE |
| 39 | CGPG3169 | 178 | 18549 | SENSE |
| 40 | CGPG3171 | 179 | 18517 | SENSE |
| 41 | CGPG3175 | 180 | 19644 | SENSE |
| 42 | CGPG3287 | 181 | 18836 | SENSE |
| 43 | CGPG3289 | 182 | 18240 | SENSE |
| 44 | CGPG3296 | 183 | 71309 | SENSE |
| 45 | CGPG3298 | 184 | 19184 | SENSE |
| 46 | CGPG3309 | 185 | 19186 | SENSE |
| 47 | CGPG3312 | 186 | 70336 | SENSE |
| 48 | CGPG3327 | 187 | 18325 | SENSE |
| 49 | CGPG3341 | 188 | 18333 | SENSE |
| 50 | CGPG3347 | 189 | 18248 | SENSE |
| 51 | CGPG3369 | 190 | 18843 | SENSE |
| 52 | CGPG3449 | 191 | 77332 | SENSE |
| 53 | CGPG3451 | 192 | 19650 | SENSE |
| 54 | CGPG3463 | 193 | 18436 | SENSE |
| 55 | CGPG3468 | 194 | 19634 | SENSE |
| 56 | CGPG3476 | 195 | 18509 | SENSE |
| 57 | CGPG3505 | 196 | 18610 | SENSE |
| 58 | CGPG359 | 197 | 10456 | ANTI-SENSE |
| 59 | CGPG367 | 198 | 11115 | ANTI-SENSE |
| 60 | CGPG3750 | 199 | 70449 | SENSE |
| 61 | CGPG3761 | 200 | 70461 | SENSE |
| 62 | CGPG3793 | 201 | 70470 | SENSE |
| 63 | CGPG3795 | 202 | 70452 | SENSE |
| 64 | CGPG3804 | 203 | 70473 | SENSE |
| 65 | CGPG3810 | 204 | 70455 | SENSE |
| 66 | CGPG3813 | 205 | 70542 | SENSE |
| 67 | CGPG382 | 206 | 10362 | ANTI-SENSE |
| 68 | CGPG3825 | 207 | 70479 | SENSE |
| 69 | CGPG3828 | 208 | 70546 | SENSE |

TABLE 2-continued

| NUC SEQ ID NO | Gene id | PEP SEQ ID NO | Construct id | Orientation |
|---|---|---|---|---|
| 70 | CGPG3837 | 209 | 70481 | SENSE |
| 71 | CGPG3841 | 210 | 78318 | SENSE |
| 72 | CGPG3843 | 211 | 72907 | SENSE |
| 73 | CGPG3857 | 212 | 70485 | SENSE |
| 74 | CGPG3858 | 213 | 70486 | SENSE |
| 75 | CGPG3865 | 214 | 70483 | SENSE |
| 76 | CGPG3868 | 215 | 70625 | SENSE |
| 77 | CGPG3869 | 216 | 70489 | SENSE |
| 78 | CGPG3875 | 217 | 74202 | SENSE |
| 79 | CGPG3879 | 218 | 71971 | SENSE |
| 80 | CGPG3947 | 219 | 19880 | SENSE |
| 81 | CGPG3987 | 220 | 19972 | SENSE |
| 82 | CGPG4004 | 221 | 19920 | SENSE |
| 83 | CGPG4013 | 222 | 19995 | SENSE |
| 84 | CGPG4015 | 223 | 19896 | SENSE |
| 85 | CGPG4061 | 224 | 19957 | SENSE |
| 86 | CGPG4066 | 225 | 19826 | SENSE |
| 87 | CGPG4082 | 226 | 19748 | SENSE |
| 88 | CGPG4106 | 227 | 70930 | SENSE |
| 89 | CGPG4112 | 228 | 70983 | SENSE |
| 90 | CGPG4133 | 229 | 19796 | SENSE |
| 91 | CGPG4166 | 230 | 19869 | SENSE |
| 92 | CGPG4195 | 231 | 19924 | SENSE |
| 93 | CGPG4525 | 232 | 71822 | SENSE |
| 94 | CGPG4527 | 233 | 70758 | SENSE |
| 95 | CGPG4537 | 234 | 70760 | SENSE |
| 96 | CGPG4591 | 235 | 75032 | SENSE |
| 97 | CGPG4612 | 236 | 72943 | SENSE |
| 98 | CGPG4632 | 237 | 70773 | SENSE |
| 99 | CGPG490 | 238 | 70215 | SENSE |
| 100 | CGPG5130 | 239 | 73675 | SENSE |
| 101 | CGPG5278 | 240 | 72057 | SENSE |
| 102 | CGPG5280 | 241 | 72093 | SENSE |
| 103 | CGPG5292 | 242 | 72047 | SENSE |
| 104 | CGPG5306 | 243 | 72106 | SENSE |
| 105 | CGPG5316 | 244 | 72117 | SENSE |
| 106 | CGPG5324 | 245 | 72118 | SENSE |
| 107 | CGPG5330 | 246 | 72109 | SENSE |
| 108 | CGPG5334 | 247 | 72129 | SENSE |
| 109 | CGPG5422 | 248 | 74307 | SENSE |
| 110 | CGPG5599 | 249 | 72926 | SENSE |
| 111 | CGPG690 | 250 | 12179 | ANTI-SENSE |
| 112 | CGPG7354 | 251 | 74844 | SENSE |
| 113 | CGPG7367 | 252 | 74810 | SENSE |
| 114 | CGPG7369 | 253 | 74834 | SENSE |
| 115 | CGPG7373 | 254 | 74882 | SENSE |
| 116 | CGPG7374 | 255 | 74894 | SENSE |
| 117 | CGPG7376 | 256 | 74823 | SENSE |
| 118 | CGPG7378 | 257 | 77801 | SENSE |
| 119 | CGPG7641 | 258 | 75494 | SENSE |
| 120 | CGPG7655 | 259 | 75472 | SENSE |
| 121 | CGPG7678 | 260 | 75574 | SENSE |
| 122 | CGPG7697 | 261 | 75517 | SENSE |
| 123 | CGPG7709 | 262 | 75566 | SENSE |
| 124 | CGPG7714 | 263 | 75531 | SENSE |
| 125 | CGPG7743 | 264 | 75594 | SENSE |
| 126 | CGPG7748 | 265 | 75559 | SENSE |
| 127 | CGPG7757 | 266 | 75572 | SENSE |
| 128 | CGPG7759 | 267 | 75596 | SENSE |
| 129 | CGPG7822 | 268 | 75680 | SENSE |
| 130 | CGPG7840 | 269 | 75611 | SENSE |
| 131 | CGPG7876 | 270 | 75751 | SENSE |
| 132 | CGPG858 | 271 | 73934 | SENSE |
| 133 | CGPG2562 | 272 | 74555 | SENSE |
| 134 | CGPG31 | 273 | 10114 | ANTI-SENSE |
| 135 | CGPG4213 | 274 | 78654 | SENSE |
| 136 | CGPG477 | 275 | 10804 | ANTI-SENSE |
| 137 | CGPG6312 | 276 | 77507 | SENSE |
| 138 | CGPG7188 | 277 | 78989 | SENSE |
| 139 | CGPG8726 | 278 | 78560 | SENSE |

Recombinant DNA

DNA for use in the present invention to improve traits in plants have a nucleotide sequence of SEQ ID NO:1 through SEQ ID NO: 139, as well as the homologs of such DNA molecules. A subset of the DNA for gene suppression aspects of the invention includes fragments of the disclosed full polynucleotides consisting of oligonucleotides of 21 or more consecutive nucleotides. Oligonucleotides the larger molecules having a sequence selected from the group consisting of SEQ ID NO: 1 through SEQ ID NO: 139 are useful as probes and primers for detection of the polynucleotides used in the invention. Also useful in this invention are variants of the DNA. Such variants can be naturally occurring, including DNA from homologous genes from the same or a different species, or can be non-natural variants, for example DNA synthesized using chemical synthesis methods, or generated using recombinant DNA techniques. Degeneracy of the genetic code provides the possibility to substitute at least one base of the protein encoding sequence of a gene with a different base without causing the amino acid sequence of the polypeptide produced from the gene to be changed. Hence, a DNA useful in the present invention can have any base sequence that has been changed from the sequences provided herein by substitution in accordance with degeneracy of the genetic code.

Homologs of the genes providing DNA demonstrated as useful in improving traits in model plants disclosed herein will generally have significant identity with the DNA disclosed herein. DNA is substantially identical to a reference DNA if, when the sequences of the polynucleotides are optimally aligned there is at least about 60% nucleotide equivalence over a comparison window. The DNA can also be about 70% equivalence, about 80% equivalence; about 85% equivalence; about 90%; about 95%; or even about 98%, 98.5%, 99% or 99.5% equivalence over a comparison window. A comparison window is at least about 50-100 nucleotides, and/or is the entire length of the polynucleotide provided herein. Optimal alignment of sequences for aligning a comparison window can be conducted by algorithms or by computerized implementations of these algorithms (for example, the Wisconsin Genetics Software Package Release 7.0-10.0, Genetics Computer Group, 575 Science Dr., Madison, Wis.). The reference polynucleotide can be a full-length molecule or a portion of a longer molecule. In one embodiment, the window of comparison for determining polynucleotide identity of protein encoding sequences is the entire coding region.

Proteins useful for imparting enhanced traits are entire proteins or at least a sufficient portion of the entire protein to impart the relevant biological activity of the protein. Proteins used for generation of transgenic plants having enhanced traits include the proteins with an amino acid sequence provided herein as SEQ ID NO: 140 through SEQ ID NO: 278, as well as homologs of such proteins.

Homologs of the trait-improving proteins provided herein generally demonstrate significant sequence identity. Of particular interest are proteins having at least about 50% sequence identity, at least about 70% sequence identity or higher, e.g., at least about 80% sequence identity with an amino acid sequence of SEQ ID NO:140 through SEQ ID NO: 278. Proteins also include those with higher identity, e.g., at least about 100% to at least about 99.5%, at least about 100% to at least about 99%, at least about 100% to at least about 98%, at least about 100% to at least about 97.5%, at least about 100% to at least about 95%, at least about 100% to at least about 92.5%, and at least about 100% to at least about 90%. Identity of protein homologs is determined by aligning the amino acid sequence of a putative protein homolog with a defined amino acid sequence and by calculating the percentage of identical and conservatively substituted amino acids over the window of comparison. The window of comparison for determining identity can be the entire amino acid sequence disclosed herein, e.g., the full sequence of any of SEQ ID NO: 140 through SEQ ID NO: 278.

The relationship of homologs with amino acid sequences of SEQ ID NO: 279 to SEQ ID NO: 6023 to the proteins with amino acid sequences of SEQ ID NO: to 140 to SEQ ID NO: 278 are found in the listing of Table 16.

Other functional homolog proteins differ in one or more amino acids from those of a trait-improving protein disclosed herein as the result of one or more of the well-known conservative amino acid substitutions, e.g., valine is a conservative substitute for alanine and threonine is a conservative substitute for serine. Conservative substitutions for an amino acid within the native sequence can be selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the invention includes proteins that differ in one or more amino acids from those of a described protein sequence as the result of deletion or insertion of one or more amino acids in a native sequence.

Genes that are homologous to each other can be grouped into families and included in multiple sequence alignments. Then a consensus sequence for each group can be derived. This analysis enables the derivation of conserved and class- (family) specific residues or motifs that are functionally important. These conserved residues and motifs can be further validated with 3D protein structure if available. The consensus sequence can be used to define the full scope of the invention, e.g., to identify proteins with a homolog relationship. Thus, the present invention contemplates that protein homologs include proteins with an amino acid sequence that has at least 90% identity to such a consensus amino acid sequence sequences.

Promoters

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens,* caulimovirus promoters such as the *cauliflower mosaic* virus or *Figwort mosaic* virus promoters. For instance, see U.S. Pat. Nos. 5,858,742 and 5,322,938 which disclose versions of the constitutive promoter derived from *cauliflower mosaic* virus (CaMV35S), U.S. Pat. No. 5,378,619 which discloses a *Figwort Mosaic* Virus (FMV) 35S promoter, U.S. Pat. No. 6,437,217 which discloses a maize RS81 promoter, U.S. Pat. No. 5,641,876 which discloses a rice actin promoter, U.S. Pat. No. 6,426,446 which discloses a maize RS324 promoter, U.S. Pat. No. 6,429,362 which discloses a maize PR-1 promoter, U.S. Pat. No. 6,232,526 which discloses a maize A3 promoter, U.S. Pat. No. 6,177,611 which discloses constitutive maize promoters, U.S. Pat. No. 6,433,252 which discloses a maize L3 oleosin promoter, U.S. Pat. No. 6,429,357 which discloses a rice actin 2 promoter and intron, U.S. Pat. No. 5,837,848 which discloses a root specific promoter, U.S. Pat. No. 6,084,089 which discloses cold inducible promoters, U.S. Pat. No. 6,294,714 which discloses light inducible promoters, U.S. Pat. No. 6,140,078 which discloses salt inducible promoters, U.S. Pat. No. 6,252,138 which discloses pathogen inducible promoters, U.S. Pat. No. 6,175,060 which discloses phosphorus deficiency inducible promoters, U.S. Patent Application Publication 2002/0192813A1 which discloses 5', 3' and intron elements useful in the design of effective plant expression vectors, U.S. patent application Ser. No. 09/078,972 which discloses a coixin promoter, U.S. patent application Ser. No. 09/757,089 which discloses a maize chloroplast aldolase promoter, and U.S. patent application Ser. No. 10/739,565 which discloses water-deficit inducible promoters, all of which are incorporated herein by reference. These and numerous other promoters that function in plant cells are known to those skilled in the art and available for use in recombinant polynucleotides of the present invention to provide for expression of desired genes in transgenic plant cells.

Furthermore, the promoters can include multiple "enhancer sequences" to assist in elevating gene expression. Such enhancers are known in the art. By including an enhancer sequence with such constructs, the expression of the selected protein can be enhanced. These enhancers often are found 5' to the start of transcription in a promoter that functions in eukaryotic cells, but can often be inserted in the forward or reverse orientation 5' or 3' to the coding sequence. In some instances, these 5' enhancing elements are introns. Deemed to be particularly useful as enhancers are the 5' introns of the rice actin 1 and rice actin 2 genes. Examples of other enhancers that can be used in accordance with the invention include elements from the CaMV 35S promoter, octopine synthase genes, the maize alcohol dehydrogenase gene, the maize shrunken 1 gene and promoters from non-plant eukaryotes.

In some aspects of the invention, the promoter element in the DNA construct can be capable of causing sufficient expression to result in the production of an effective amount of a polypeptide in water deficit conditions. Such promoters can be identified and isolated from the regulatory region of plant genes that are over expressed in water deficit conditions. Specific water-deficit-inducible promoters for use in this invention are derived from the 5' regulatory region of genes identified as a heat shock protein 17.5 gene (HSP17.5), an HVA22 gene (HVA22), a Rab17 gene and a cinnamic acid 4-hydroxylase (CA4H) gene (CA44H) of *Zea maize.* Such water-deficit-inducible promoters are disclosed in U.S. application Ser. No. 10/739,565, incorporated herein by reference.

In some aspects of the invention, sufficient expression in plant seed tissues is desired to effect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al., (1997) *Transgenic Res.* 6(2):157-166), globulin 1 (Belanger et al., (1991) *Genetics* 129:863-872), glutelin 1 (Russell (1997) supra), and peroxiredoxin antioxidant (Perl) (Stacy et al., (1996) *Plant Mol Biol.* 31(6): 1205-1216).

In some aspects of the invention, expression in plant green tissues is desired. Promoters of interest for such uses include those from genes such as SSU (Fischhoff, et al., (1992) *Plant Mol Biol.* 20:81-93), aldolase and pyruvate orthophosphate dikinase (PPDK) (Taniguchi, et al., (2000) *Plant Cell Physiol.* 41(1):42-48).

Gene suppression includes any of the well-known methods for suppressing transcription of a gene or the accumulation of the mRNA corresponding to that gene thereby preventing translation of the transcript into protein. Post-transcriptional gene suppression is mediated by transcription of RNA that forms double-stranded RNA (dsRNA) having homology to a gene targeted for suppression. Suppression can also be achieved by insertion mutations created by transposable elements can also prevent gene function. For example, in many dicot plants, transformation with the T-DNA of *Agrobacterium* can be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants can be screened with polynucleotides encoding the polypeptide of interest to detect mutated plants having an insertion in the gene encoding the polypeptide of interest.

Gene Stacking

The present invention also contemplates that the trait-improving recombinant DNA provided herein can be used in combination with other recombinant DNA to create plants with multiple desired traits or a further enhanced trait. The combinations generated can include multiple copies of any one or more of the recombinant DNA constructs. These stacked combinations can be created by any method, including but not limited to cross breeding of transgenic plants, or multiple genetic transformation.

Transformation Methods

Numerous methods for producing plant cell nuclei with recombinant DNA are known in the art and can be used in the present invention. Two commonly used methods for plant transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn) and U.S. Pat. No. 6,153,812 (wheat) and *Agrobacterium*-mediated transformation is described in U.S. Pat. No. 5,159,135 (cotton); U.S. Pat. No. 5,824,877 (soybean); U.S. Pat. No. 5,463,174 (canola, U.S. Pat. No. 5,591,616 (corn); and U.S. Pat. No. 6,384,301 (soybean), all of which are incorporated herein by reference. For *Agrobacterium tumefaciens* based plant transformation system, additional elements present on transformation constructs will include T-DNA left and right border sequences to facilitate incorporation of the recombinant polynucleotide into the plant genome.

Numerous methods for transforming chromosomes in a plant cell nucleus with recombinant DNA are known in the art and are used in methods of preparing a transgenic plant cell nucleus cell, and plant. Two effective methods for such transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean): U.S. Pat. No. 6,160,208 (corn); U.S. Pat. No. 6,399,861 (corn); U.S. Pat. No. 6,153,812 (wheat) and U.S. Pat. No. 6,365,807 (rice) and *Agrobacterium*-mediated transformation is described in U.S. Pat. No. 5,159,135 (cotton); U.S. Pat. No. 5,824,877 (soybean); U.S. Pat. No. 5,463,174 (canola, also known as rapeseed); U.S. Pat. No. 5,591,616 (corn); U.S. Pat. No. 6,384,301 (soybean), U.S. Pat. No. 7,026,528 (wheat) and U.S. Pat. No. 6,329,571 (rice), all of which are incorporated herein by reference for enabling the production of transgenic plants. Transformation of plant material is practiced in tissue culture on a nutrient media, i.e. a mixture of nutrients that will allow cells to grow in vitro. Recipient cell targets include, but are not limited to, meristem cells, hypocotyls, calli, immature embryos and gametic cells such as microspores, pollen, sperm and egg cells. Callus may be initiated from tissue sources including, but not limited to, immature embryos, hypocotyls, seedling apical meristems, microspores and the like. Cells containing a transgenic nucleus are grown into transgenic plants.

In general it is useful to introduce heterologous DNA randomly, e.g., at a non-specific location, in the genome of a target plant line. In special cases it can be useful to target heterologous DNA insertion in order to achieve site-specific integration, e.g., to replace an existing gene in the genome, to use an existing promoter in the plant genome, or to insert a recombinant polynucleotide at a predetermined site known to be active for gene expression. Several site specific recombination systems exist which are known to function in plants including cre-lox as disclosed in U.S. Pat. No. 4,959,317 and FLP-FRT as disclosed in U.S. Pat. No. 5,527,695, both incorporated herein by reference.

Transformation methods of this invention can be practiced in tissue culture on media and in a controlled environment. "Media" refers to the numerous nutrient mixtures that are used to grow cells in vitro, that is, outside of the intact living organism. Recipient cell targets include, but are not limited to, meristem cells, calli, hypocotyles, immature embryos and gametic cells such as microspores, pollen, sperm and egg cells. It is contemplated that any cell from which a fertile plant can be regenerated is useful as a recipient cell. Callus can be initiated from tissue sources including, but not limited to, immature embryos, seedling apical meristems, microspores and the like. Cells capable of proliferating as callus are also recipient cells for genetic transformation. Practical transformation methods and materials for making transgenic plants of this invention, e.g., various media and recipient target cells, transformation of immature embryos and subsequent regeneration of fertile transgenic plants are disclosed in U.S. Pat. Nos. 6,194,636 and 6,232,526 and U.S. patent application Ser. No. 09/757,089, which are incorporated herein by reference.

The seeds of transgenic plants can be harvested from fertile transgenic plants and be used to grow progeny generations of transformed plants of this invention including hybrid plants line for selection of plants having an enhanced trait. In addition to direct transformation of a plant with a recombinant DNA, transgenic plants can be prepared by crossing a first plant having a recombinant DNA with a second plant lacking the DNA. For example, recombinant DNA can be introduced into a first plant line that is amenable to transformation to produce a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait: such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

In practice, DNA is introduced into only a small percentage of target cell nuclei. Marker genes are used to provide an efficient system for identification of those cells with nuclei that are stably transformed by receiving and integrating a recombinant DNA molecule into their genomes. Some marker genes provide selective markers that confer resistance to a selective agent, such as an antibiotic or herbicide. Potentially transformed cells with a nucleus of the invention are exposed to the selective agent. In the population of surviving cells will be those cells where, generally, the resistance-conferring gene has been integrated and expressed at sufficient levels to permit cell survival. Cells can be tested further to confirm stable integration of the exogenous DNA in the nucleus. Useful selective marker genes include those conferring resistance to antibiotics such as kanamycin (nptII), hygromycin B (aph IV), spectinomycin (aadA) and gentamycin (aac3 and aacC4) or resistance to herbicides such as glufosinate (bar or pat), dicamba (DMO) and glyphosate (EPSPS). Examples of such selectable markers are illustrated in U.S. Pat. Nos. 5,550,318; 5,633,435; 5,780,708 and 6,118,047, all of which are incorporated herein by reference. Screenable markers which provide an ability to visually identify transformants can also be employed, e.g., a gene expressing a colored or fluorescent protein such as a luciferase or green fluorescent protein (GFP) or a gene expressing a beta-glucuronidase or uidA gene (GUS) for which various chromogenic substrates are known. It is also contemplated that combinations of screenable and selectable markers will be useful for identification of transformed cells. See PCT publication WO 99/61129 (herein incorporated by reference) which discloses use of a gene fusion between a selectable marker gene and a screenable marker gene, e.g., an NPTII gene and a GFP gene.

Plant cells that survive exposure to the selective agent, or cells that have been scored positive in a screening assay, can be cultured in regeneration media and allowed to mature into plants. Developing plantlets can be transferred to soil less plant growth mix, and hardened off, e.g., in an environmentally controlled chamber at about 85% relative humidity, 600 ppm $CO_2$, and 25-250 microeinsteins $m^{-2}$ $s^{-1}$ of light, prior to transfer to a greenhouse or growth chamber for maturation. Plants are matured either in a growth chamber or greenhouse. Plants are regenerated from about 6 weeks to 10 months after a transformant is identified, depending on the initial tissue. During regeneration, cells are grown to plants on solid media at about 19 to 28° C. After regenerating plants have reached the stage of shoot and root development, they can be transferred to a greenhouse for further growth and testing. Plants can be pollinated using conventional plant breeding methods known to those of skill in the art and seed produced.

Progeny can be recovered from transformed plants and tested for expression of the exogenous recombinant polynucleotide. Useful assays include, for example, "molecular biological" assays, such as Southern and Northern blotting and PCR; "biochemical" assays, such as detecting the presence of RNA, e.g., double stranded RNA, or a protein product, e.g., by immunological means (ELISAs and Western blots) or by enzymatic function; plant part assays, such as leaf or root assays; and also, by analyzing the phenotype of the whole regenerated plant.

Discovery of Trait-Improving Recombinant DNA

To identify nuclei with recombinant DNA that confer enhanced traits to plants, *Arabidopsis thaliana* was transformed with a candidate recombinant DNA construct and screened for an enhanced trait.

*Arabidopsis thaliana* is used a model for genetics and metabolism in plants. A two-step screening process was employed which included two passes of trait characterization to ensure that the trait modification was dependent on expression of the recombinant DNA, but not due to the chromosomal location of the integration of the transgene. Twelve independent transgenic lines for each recombinant DNA construct were established and assayed for the transgene expression levels. Five transgenic lines with high transgene expression levels were used in the first pass screen to evaluate the transgene's function in T2 transgenic plants. Subsequently, three transgenic events, which had been shown to have one or more enhanced traits, were further evaluated in the second pass screen to confirm the transgene's ability to impart an enhanced trait. The following Table 3 summarizes the enhanced traits that have been confirmed as provided by a recombinant DNA construct.

In particular, Table 3 reports:

"PEP SEQ ID" which is the amino acid sequence of the protein corresponding to the DNA in the recombinant DNA construct corresponding to a protein sequence of a SEQ ID NO. in the Sequence Listing.

"construct_id" is an arbitrary name for the recombinant DNA describe more particularly in Table 1.

"annotation" refers to a description of the top hit protein obtained from an amino acid sequence query of each PEP SEQ ID NO to GenBank database of the National Center for Biotechnology Information (ncbi). More particularly, "gi" is the GenBank ID number for the top BLAST hit.

"description" refers to the description of the top BLAST hit.

"e-value" provides the expectation value for the BLAST hit.

"% id" refers to the percentage of identically matched amino acid residues along the length of the portion of the sequences which is aligned by BLAST between the sequence of interest provided herein and the hit sequence in GenBank.

"traits" identify by two letter codes the confirmed enhancement in a transgenic plant provided by the recombinant DNA. The codes for enhanced traits are:

"CK" which indicates cold tolerance enhancement identified under a cold shock tolerance screen;

"CS" which indicates cold tolerance enhancement identified by a cold germination tolerance screen;

"DS" which indicates drought tolerance enhancement identified by a soil drought stress tolerance screen;

"PEG" which indicates osmotic stress tolerance enhancement identified by a PEG induced osmotic stress tolerance screen;

"HS" which indicates heat stress tolerance enhancement identified by a heat stress tolerance screen;

"SS" which indicates high salinity stress tolerance enhancement identified by a salt stress tolerance screen;

"LN" which indicates nitrogen use efficiency enhancement identified by a limited nitrogen tolerance screen;

"LL" which indicates attenuated shade avoidance response identified by a shade tolerance screen under a low light condition;

"PP" which indicates enhanced growth and development at early stages identified by an early plant growth and development screen;

"SP" which indicates enhanced growth and development at late stages identified by a late plant growth and development screen provided herein.

TABLE 3

| NUC Seq ID No. | Gene ID | PEP Seq ID No. | Annotation | | | Traits | |
|---|---|---|---|---|---|---|---|
| | | | E-value | % id | Description | | |
| 1 | CGPG113 | 140 | 0 | 90 | gb|AAA86281.1|CKC | HS | |
| 2 | CGPG1754 | 141 | 1.00E−156 | 78 | ref|NP_564784.1|DNA-binding storekeeper protein-related [*Arabidopsis thaliana*] | PP | |
| 3 | CGPG1809 | 142 | 1.00E−105 | 76 | ref|NP_200116.1|RWP-RK domain-containing protein [*Arabidopsis thaliana*] | SP | |
| 4 | CGPG2053 | 143 | 1.00E−124 | 82 | gb|AAD22130.2|expressed protein [*Arabidopsis thaliana*] | SS | |
| 5 | CGPG2164 | 144 | 0 | 93 | gb|AAG53999.1|AF336918_1ARF2 [*Arabidopsis thaliana*] | SS | |
| 6 | CGPG2551 | 145 | 3.00E−92 | 81 | ref|NP_172518.1|ZFP5 (ZINC FINGER PROTEIN 5); nucleic acid binding/transcription factor/zinc ion binding [*Arabidopsis thaliana*] | LL | |
| 7 | CGPG2578 | 146 | 1.00E−139 | 95 | ref|NP_187963.1|ATMYB5 (myb domain protein 5); DNA binding/transcription factor [*Arabidopsis thaliana*] | SS | |
| 8 | CGPG2583 | 147 | 1.00E−112 | 100 | pir||H84613probable MADS-box protein [imported] - *Arabidopsis thaliana* | PP | PEG |
| 9 | CGPG2586 | 148 | 1.00E−107 | 79 | ref|NP_177524.2|BEE3 (BR ENHANCED EXPRESSION 3); DNA binding/transcription factor [*Arabidopsis thaliana*] | PEG | |
| 10 | CGPG2593 | 149 | 1.00E−147 | 84 | ref|NP_188962.2|basic helix-loop-helix (bHLH) family protein [*Arabidopsis thaliana*] | PP | |
| 11 | CGPG2594 | 150 | 0 | 83 | sp|Q9LEZ3|BIM1_ARATHTranscription factor BIM1 (BES1-interacting Myc-like protein 1) (Transcription factor EN 126) (Basic helix-loop-helix protein 46) | SS | |
| 12 | CGPG26 | 151 | 1.00E−134 | 94 | ref|NP_177074.1|AP1 (APETALA1); DNA binding/transcription factor [*Arabidopsis thaliana*] | LN | |
| 13 | CGPG2604 | 152 | 1.00E−151 | 100 | ref|NP_187737.1|myb family transcription factor [*Arabidopsis thaliana*] | LN | |
| 14 | CGPG2615 | 153 | 1.00E−178 | 92 | ref|NP_177338.1|VND7 (VASCULAR RELATED NAC-DOMAIN PROTEIN 7); transcription factor [*Arabidopsis thaliana*] | HS | |
| 15 | CGPG2639 | 154 | 5.00E−91 | 60 | ref|NP_566232.1|DNA-binding protein-related [*Arabidopsis thaliana*] | DS | |
| 16 | CGPG2644 | 155 | 1.00E−174 | 88 | ref|NP_189199.1|basic helix-loop-helix (bHLH) family protein [*Arabidopsis thaliana*] | HS | |
| 17 | CGPG2657 | 156 | 1.00E−102 | 77 | ref|NP_188666.1|ERF7 (ETHYLINE RESPONSE FACTOR7); DNA binding/protein binding/transcription factor/transcriptional repressor [*Arabidopsis thaliana*] | PP | SP |
| 18 | CGPG2664 | 157 | 2.00E−69 | 100 | ref|NP_188827.1|zinc finger (B-box type) family protein [*Arabidopsis thaliana*] | PEG | PP |
| 19 | CGPG2678 | 158 | 1.00E−110 | 94 | ref|NP_564263.1|zinc finger (C3HC4-type RING finger) family protein [*Arabidopsis thaliana*] | CK | |
| 20 | CGPG2699 | 159 | 0 | 91 | ref|NP_200853.1|ARF4 (AUXIN RESPONSE FACTOR 4); transcription factor [*Arabidopsis thaliana*] | CK | |
| 21 | CGPG2704 | 160 | 0 | 100 | ref|NP_001030821.1|TRFL1 (TRF-LIKE 1); DNA binding [*Arabidopsis thaliana*] | DS | LL |
| 22 | CGPG2711 | 161 | 0 | 94 | ref|NP_191351.1|squamosa promoter-binding protein, putative [*Arabidopsis thaliana*] | DS | |
| 23 | CGPG2735 | 162 | 1.00E−102 | 100 | ref|NP_191211.1|no apical meristem (NAM) family protein [*Arabidopsis thaliana*] | HS | |
| 24 | CGPG2752 | 163 | 1.00E−176 | 100 | ref|NP_172279.1|zinc finger (GATA type) family protein [*Arabidopsis thaliana*] | SS | |
| 25 | CGPG2757 | 164 | 0 | 96 | ref|NP_171609.1|ANAC001 (*Arabidopsis* NAC domain containing protein 1); transcription factor [*Arabidopsis thaliana*] | PP | |
| 26 | CGPG2767 | 165 | 0 | 65 | ref|NP_175412.1|zinc finger (C2H2 type) family protein [*Arabidopsis thaliana*] | PP | SS |
| 27 | CGPG2778 | 166 | 0 | 100 | ref|NP_197640.1|zinc finger (ZPR1-type) family protein [*Arabidopsis thaliana*] | SS | |
| 28 | CGPG2797 | 167 | 0 | 92 | dbj|BAF62149.1|C2—H2 zinc finger protein [*Arabidopsis thaliana*] | PP | |
| 29 | CGPG2805 | 168 | 1.00E−167 | 100 | ref|NP_564230.1|MYB116 (myb domain protein 116); DNA binding/transcription factor [*Arabidopsis thaliana*] | DS | HS |
| 30 | CGPG2811 | 169 | 1.00E−158 | 79 | gb|AAG50818.1|AC079281_20hypothetical protein [*Arabidopsis thaliana*] | DS | HS |

TABLE 3-continued

| No. | Gene ID | PEP Seq ID No. | E-value | % id | Description | Traits | | |
|---|---|---|---|---|---|---|---|---|
| 31 | CGPG2907 | 170 | 0 | 86 | gb\|AAF99784.1\|AC012463_1T2E6.3 [*Arabidopsis thaliana*] | HS | | |
| 32 | CGPG2935 | 171 | 1.00E−57 | 100 | ref\|NP_200132.2\|TRY (TRIPTYCHON); DNA binding/transcription factor [*Arabidopsis thaliana*] | DS | | |
| 33 | CGPG2943 | 172 | 0 | 95 | gb\|AAF25987.1\|AC013354_6F15H18.16 [*Arabidopsis thaliana*] | CK | HS | |
| 34 | CGPG2948 | 173 | 1.00E−167 | 94 | ref\|NP_198065.2\|MADS-box family protein [*Arabidopsis thaliana*] | CS | HS | PP |
| 35 | CGPG2961 | 174 | 1.00E−146 | 80 | ref\|NP_189218.1\|AP2 domain-containing transcription factor, putative [*Arabidopsis thaliana*] | PP | SS | |
| 36 | CGPG2975 | 175 | 2.00E−97 | 91 | ref\|NP_850951.2\|KNAT6 (Knotted-like *Arabidopsis thaliana* 6); DNA binding/transcription factor s | CK | | |
| 37 | CGPG2985 | 176 | 1.00E−127 | 79 | ref\|NP_201559.1\|ATTRB2/TRB2 (TELOMERE REPEAT BINDING FACTOR 2); DNA binding/transcription factor [*Arabidopsis thaliana*] | HS | | |
| 38 | CGPG3107 | 177 | 0 | 97 | ref\|NP_566442.1\|myb family transcription factor [*Arabidopsis thaliana*] | HS | | |
| 39 | CGPG3169 | 178 | 1.00E−118 | 100 | ref\|NP_196979.1\|WER (WEREWOLF 1); DNA binding/transcription factor [*Arabidopsis thaliana*] | HS | | |
| 40 | CGPG3171 | 179 | 1.00E−128 | 95 | ref\|NP_197898.1\|ZFP3 (ZINC FINGER PROTEIN 3); nucleic acid binding/transcription factor/zinc ion binding [*Arabidopsis thaliana*] | HS | | |
| 41 | CGPG3175 | 180 | 1.00E−116 | 81 | ref\|NP_182191.1\|ATHB-7 (*ARABIDOPSIS THALIANA* HOMEOBOX 7); transcription factor [*Arabidopsis thaliana*] | HS | | |
| 42 | CGPG3287 | 181 | 1.00E−180 | 86 | ref\|NP_566101.1\|CAO (CHAOS); chromatin binding [*Arabidopsis thaliana*] | PP | | |
| 43 | CGPG3289 | 182 | 1.00E−65 | 86 | ref\|NP_566290.1\|zinc finger (GATA type) family protein [*Arabidopsis thaliana* | CS | HS | |
| 44 | CGPG3296 | 183 | 0 | 77 | ref\|NP_564359.1\|WRKY14 (WRKY DNA-binding protein 14); transcription factor [*Arabidopsis thaliana*] | SS | | |
| 45 | CGPG3298 | 184 | 1.00E−172 | 92 | ref\|NP_564486.1\|VIP1 (VIRE2-INTERACTING PROTEIN 1); transcription factor [*Arabidopsis thaliana*] | DS | LL | |
| 46 | CGPG3309 | 185 | 1.00E−118 | 94 | ref\|NP_178188.1\|ZFP1 (*ARABIDOPSIS THALIANA* ZINC-FINGER PROTEIN 1); nucleic acid binding/transcription factor/zinc ion binding [*Arabidopsis thaliana*] | HS | | |
| 47 | CGPG3312 | 186 | 1.00E−174 | 86 | ref\|NP_181594.1\|bZIP transcription factor family protein [*Arabidopsis thaliana*] | PP | | |
| 48 | CGPG3327 | 187 | 2.00E−87 | 88 | ref\|NP_172872.1\|zinc finger (C3HC4-type RING finger) family protein [*Arabidopsis thaliana*] | HS | | |
| 49 | CGPG3341 | 188 | 0 | 85 | ref\|NP_195410.1\|AP2 (APETALA 2); transcription factor [*Arabidopsis thaliana*] | LN | | |
| 50 | CGPG3347 | 189 | 5.00E−82 | 74 | ref\|NP_566567.1\|transcription factor [*Arabidopsis thaliana*] | PP | | |
| 51 | CGPG3369 | 190 | 0 | 91 | ref\|NP_175475.2\|SCL5; transcription factor [*Arabidopsis thaliana*] | CK | HS | |
| 52 | CGPG3449 | 191 | 1.00E−122 | 62 | ref\|NP_193820.1\|ethylene-responsive nuclear protein/ethylene-regulated nuclear protein (ERT2) [*Arabidopsis thaliana*] | SS | | |
| 53 | CGPG3451 | 192 | 1.00E−113 | 94 | ref\|NP_194271.1\|basix helix-loop-helix (bHLH) family protein [*Arabidopsis thaliana*] | HS | | |
| 54 | CGPG3463 | 193 | 0 | 87 | ref\|NP_200855.1\|zinc finger (C2H2 type) family protein [*Arabidopsis thaliana*] | HS | | |
| 55 | CGPG3468 | 194 | 1.00E−176 | 95 | ref\|NP_001031160.1\|zinc ion binding [*Arabidopsis thaliana*] | LN | | |
| 56 | CGPG3476 | 195 | 4.00E−92 | 72 | ref\|NP_177887.1\|AP2 domain-containing transcription factor, putative [*Arabidopsis thaliana*] | LN | | |
| 57 | CGPG3505 | 196 | 0 | 100 | gb\|AAF05867.1\|AC011698_18transfactor-like [*Arabidopsis thaliana*] | CS | HS | |
| 58 | CGPG359 | 197 | 4.00E−95 | 100 | ref\|NP_176569.1\|zinc finger (C3HC4-type RING finger) family protein [*Arabidopsis thaliana*] | LL | | |
| 59 | CGPG367 | 198 | 1.00E−132 | 86 | ref\|NP_177583.1\|MYB95 (myb domain protein 95); DNA binding/transcription factor [*Arabidopsis thaliana*] | PEG | | |
| 60 | CGPG3750 | 199 | 0 | 83 | ref\|NP_172690.1\|VND4 (VASCULAR RELATED NAC-DOMAIN PROTEIN 4); transcription factor [*Arabidopsis thaliana*] | SS | | |
| 61 | CGPG3761 | 200 | 0 | 98 | ref\|NP_190564.1\|scarecrow transcription factor family protein [*Arabidopsis thaliana*] | HS | SP | |
| 62 | CGPG3793 | 201 | 1.00E−164 | 93 | ref\|NP_199078.1\|zinc finger (C2H2 type) family protein [*Arabidopsis thaliana*] | HS | | |
| 63 | CGPG3795 | 202 | 0 | 92 | ref\|NP_173950.1\|basic helix-loop-helix (bHLH) family protein [*Arabidopsis thaliana*] | HS | PEG | |
| 64 | CGPG3804 | 203 | 1.00E−147 | 90 | ref\|NP_174279.1\|WRKY71 (WRKY DNA-binding protein 71); transcription factor [*Arabidopsis thaliana*] | HS | | |
| 65 | CGPG3810 | 204 | 1.00E−166 | 83 | ref\|NP_174494.2\|bZIP transcription factor family protein [*Arabidopsis thaliana*] | CS | HS | |
| 66 | CGPG3813 | 205 | 0 | 100 | ref\|NP_174554.1\|ANAC012/NST3/SND1 (*ARABIDOPSIS* NAC DOMAIN CONTAINING PROTEIN 12, NAC SECONDARY WALL THICKENING PROMOTING 3); transcription factor/transcriptional activator [*Arabidopsis thaliana*] | HS | | |
| 67 | CGPG382 | 206 | 0 | 90 | gb\|AAG52391.1\|AC011915_5putative B-box zinc finger protein; 52092-50677 [*Arabidopsis thaliana*] | LN | | |
| 68 | CGPG3825 | 207 | 1.00E−144 | 100 | ref\|NP_176829.1\|WRKY64 (WRKY DNA-binding protein 64); transcription factor [*Arabidopsis thaliana*] | CS | PEG | |
| 69 | CGPG3828 | 208 | 1.00E−151 | 74 | ref\|NP_177346.1\|TCP family transcription factor, putative [*Arabidopsis thaliana*] | CS | HS | |

TABLE 3-continued

| NUC Seq ID No. | Gene ID | PEP Seq ID No. | E-value | % id | Description | Traits | | |
|---|---|---|---|---|---|---|---|---|
| 70 | CGPG3837 | 209 | 1.00E−177 | 92 | ref|NP_179176.1|zinc finger (C2H2 type) family protein [*Arabidopsis thaliana*] | HS | | |
| 71 | CGPG3841 | 210 | 0 | 85 | ref|NP_180679.2|basic helix-loop-helix (bHLH) family protein [*Arabidopsis thaliana*] | HS | | |
| 72 | CGPG3843 | 211 | 0 | 89 | ref|NP_181555.1|myb family transcription factor [*Arabidopsis thaliana*] | HS | PEG | |
| 73 | CGPG3857 | 212 | 1.00E−133 | 89 | ref|NP_001077812.1|ethylene-responsive element-binding protein, putative [*Arabidopsis thaliana*]] | CS | HS | |
| 74 | CGPG3858 | 213 | 1.00E−112 | 75 | ref|NP_177090.1|WRKY57 (WRKY DNA-binding protein 57); transcription factor [*Arabidopsis thaliana*] | CS | | |
| 75 | CGPG3865 | 214 | 2.00E−96 | 83 | ref|NP_195806.1|zinc finger (C2H2 type) family protein [*Arabidopsis thaliana* | HS | | |
| 76 | CGPG3868 | 215 | 9.00E−78 | 86 | ref|NP_199895.3|ANAC097 (*Arabidopsis* NAC domain containing protein 97); transcription factor [*Arabidopsis thaliana*] | HS | | |
| 77 | CGPG3869 | 216 | 1.00E−139 | 95 | ref|NP_188400.1|ANAC057 (*Arabidopsis* NAC domain containing protein 57); transcription factor [*Arabidopsis thaliana*] | CK | | |
| 78 | CGPG3875 | 217 | 0 | 82 | gb|AAF26166.1|AC008261_23putative DNA-binding protein [*Arabidopsis thaliana*] | PP | | |
| 79 | CGPG3879 | 218 | 0 | 80 | ref|NP_027544.1|myb family transcription factor [*Arabidopsis thaliana*] | LN | PP | |
| 80 | CGPG3947 | 219 | 2.00E−92 | 74 | gb|AAX13296.1|MADS box protein AP1a [*Lotus corniculatus* var. *japonicus*] | PP | | |
| 81 | CGPG3987 | 220 | 2.00E−75 | 99 | gb|ABH02834.1|MYB transcription factor MYB178 [*Glycine max*] | HS | | |
| 82 | CGPG4004 | 221 | 1.00E−104 | 56 | emb|CAO43809.1|unnamed protein product [*Vitis vinifera*] | HS | | |
| 83 | CGPG4013 | 222 | 1.00E−126 | 74 | gb|AAQ57226.1|DREB2 [*Glycine max*] | HS | | |
| 84 | CGPG4015 | 223 | 1.00E−136 | 87 | dbj|BAA81733.2|GmMYB29A2 [*Glycine max*] | HS | LL | |
| 85 | CGPG4061 | 224 | 1.00E−113 | 59 | emb|CAN68564.1|hypothetical protein [*Vitis vinifera*] | PP | | |
| 86 | CGPG4066 | 225 | 1.00E−134 | 75 | gb|AAK84889.1|AF402608_1TGA-type basic leucine zipper protein TGA2.1 [*Phaseolus vulgaris*] | LL | | |
| 87 | CGPG4082 | 226 | 3.00E−88 | 56 | emb|CAO17657.1|unnamed protein product [*Vitis vinifera*] | HS | | |
| 88 | CGPG4106 | 227 | 1.00E−103 | 67 | ref|NP_171677.1|ATAF1 (*Arabidopsis* NAC domain containing protein 2); transcription factor [*Arabidopsis thaliana*] | HS | | |
| 89 | CGPG4112 | 228 | 2.00E−87 | 64 | emb|CAO67297.1|unnamed protein product [*Vitis vinifera*] | CS | | |
| 90 | CGPG4133 | 229 | 1.00E−132 | 85 | emb|CAA87077.1|heat shock transcription factor 34 [*Glycine max*] | CK | PP | |
| 91 | CGPG4166 | 230 | 1.00E−122 | 66 | emb|CAO43957.1|unnamed protein product [*Vitis vinifera*] | DS | | |
| 92 | CGPG4195 | 231 | 1.00E−143 | 85 | gb|ABK92551.1|unknown [*Populus trichocarpa*] | HS | | |
| 93 | CGPG4525 | 232 | 0 | 91 | ref|NP_180366.1|BLH8 (BEL1-LIKE HOMEODOMAIN 8); DNA binding/transcription factor [*Arabidopsis thaliana*] | HS | | |
| 94 | CGPG4527 | 233 | 1.00E−138 | 79 | emb|CAL64011.1|BRANCHED2 [*Arabidopsis thaliana*] | LL | | |
| 95 | CGPG4537 | 234 | 1.00E−175 | 78 | ref|NP_176237.1|apical meristem formation protein-related [*Arabidopsis thaliana* | LL | | |
| 96 | CGPG4591 | 235 | 1.00E−98 | 80 | ref|NP_188752.1|zinc finger (B-box type) family protein [*Arabidopsis thaliana*] | SS | PEG | |
| 97 | CGPG4612 | 236 | 1.00E−157 | 93 | ref|NP_174529.2|ANAC011 (*Arabidopsis* NAC domain containing protein 11); transcription factor [*Arabidopsis thaliana*] | LL | | |
| 98 | CGPG4632 | 237 | 5.00E−58 | 89 | ref|NP_194270.1|basix helix-loop-helix (bHLH) family protein [*Arabidopsis thaliana*] | CS | LL | |
| 99 | CGPG490 | 238 | 1.00E−127 | 68 | gb|AAZ66389.1|RAV-like DNA-binding protein [*Glycine max*] | LL | | |
| 100 | CGPG5130 | 239 | 1.00E−173 | 82 | ref|NP_176536.2|DNA-binding family protein [*Arabidopsis thaliana*] | CK | DS | |
| 101 | CGPG5278 | 240 | 2.00E−98 | 55 | emb|CAO15010.1|unnamed protein product [*Vitis vinifera*] | DS | | |
| 102 | CGPG5280 | 241 | 1.00E−110 | 83 | ref|NP_001031695.1|DNA binding [*Arabidopsis thaliana*] | LL | | |
| 103 | CGPG5292 | 242 | 1.00E−104 | 69 | gb|ABH02859.1|MYB transcription factor MYB138 [*Glycine max*] | LL | | |
| 104 | CGPG5306 | 243 | 3.00E−68 | 55 | emb|CAA67968.1|MADS4 protein [*Betula pendula*] | HS | PP | LN |
| 105 | CGPG5316 | 244 | 0 | 60 | emb|CAO15649.1|unnamed protein product [*Vitis vinifera*] | LN | | |
| 106 | CGPG5324 | 245 | 3.00E−47 | 60 | sp|Q00423|HMGYA_SOYBNHMG-Y-related protein A (Protein SB16A) | LN | SP | |
| 107 | CGPG5330 | 246 | 2.00E−44 | 50 | gb|ABD64947.1|ethylene responsive element binding factor, putative [*Brassica oleracea*] | HS | | |
| 108 | CGPG5334 | 247 | 1.00E−174 | 88 | gb|ABH02830.1|MYB transcription factor MYB62 [*Glycine max*] | HS | | |
| 109 | CGPG5422 | 248 | 0 | 89 | ref|NP_172900.2|protein binding [*Arabidopsis thaliana*] | DS | | |
| 110 | CGPG5599 | 249 | 0 | 95 | ref|NP_179306.2|RWP-RK domain-containing protein [*Arabidopsis thaliana*] | PP | | |
| 111 | CGPG690 | 250 | 1.00E−113 | 80 | ref|NP_189865.1|PHD finger family protein [*Arabidopsis thaliana*] | CK | | |
| 112 | CGPG7354 | 251 | 2.00E−93 | 68 | gb|ABY84652.1|transcription factor [*Glycine max*] | CS | | |
| 113 | CGPG7367 | 252 | 1.00E−131 | 67 | emb|CAC84706.1|aux/IAA protein [*Populus tremula* x *Populus tremuloides*] | PEG | | |
| 114 | CGPG7369 | 253 | 1.00E−154 | 89 | gb|ABI16022.1|Dof21 [*Glycine max*] | PEG | | |
| 115 | CGPG7373 | 254 | 1.00E−68 | 47 | emb|CAN72162.1|hypothetical protein [*Vitis vinifera*] | LN | | |
| 116 | CGPG7374 | 255 | 1.00E−107 | 53 | gb|ABK20308.1|Myb transcription factor [*Malus x domestica*] | LL | | |
| 117 | CGPG7376 | 256 | 1.00E−130 | 90 | gb|ABS18444.1|WRKY48 [*Glycine max*] | LN | | |
| 118 | CGPG7378 | 257 | 2.00E−86 | 57 | emb|CAO23794.1|unnamed protein product [*Vitis vinifera*] | DS | | |
| 119 | CGPG7641 | 258 | 1.00E−111 | 65 | emb|CAN62363.1|hypothetical protein [*Vitis vinifera*] | LL | | |
| 120 | CGPG7655 | 259 | 4.00E−50 | 48 | emb|CAO61053.1|unnamed protein product [*Vitis vinifera*] | LL | | |
| 121 | CGPG7678 | 260 | 1.00E−125 | 86 | gb|ABH02860.1|MYB transcription factor MYB139 [*Glycine max*] | LL | | |
| 122 | CGPG7697 | 261 | 0 | 96 | gb|AAX85980.1|NAC3 protein [*Glycine max*] | LN | | |
| 123 | CGPG7709 | 262 | 2.00E−65 | 68 | emb|CAO46779.1|unnamed protein product [*Vitis vinifera*] | SP | | |

TABLE 3-continued

| NUC Seq ID No. | Gene ID | PEP Seq ID No. | Annotation | | | Traits | |
|---|---|---|---|---|---|---|---|
| | | | E-value | % id | Description | | |
| 124 | CGPG7714 | 263 | 1.00E−94 | 92 | sp|P13088|AUX22__SOYBNAuxin-induced protein AUX22 | CS | LL |
| 125 | CGPG7743 | 264 | 6.00E−37 | 45 | ref|NP__201280.1|ABR1 (ABA REPRESSOR1); DNA binding/ transcription factor [*Arabidopsis thaliana*] | SS | LN |
| 126 | CGPG7748 | 265 | 0 | 70 | emb|CAO68379.1|unnamed protein product [*Vitis vinifera*] | CK | |
| 127 | CGPG7757 | 266 | 0 | 81 | sp|O04235|SSRP1__VICFAFACT complex subunit SSRP1 (Facilitates chromatin transcription complex subunit SSRP1) (Recombination signal sequence recognition protein 1) | CS | PEG |
| 128 | CGPG7759 | 267 | 9.00E−64 | 73 | emb|CAO44022.1|unnamed protein product [*Vitis vinifera*] | LL | |
| 129 | CGPG7822 | 268 | 9.00E−99 | 70 | emb|CAN77695.1|hypothetical protein [*Vitis vinifera*] | DS | |
| 130 | CGPG7840 | 269 | 6.00E−75 | 40 | ref|NP__188826.1|zinc finger (B-box type) family protein [*Arabidopsis thaliana*] | DS | |
| 131 | CGPG7876 | 270 | 1.00E−45 | 46 | gb|AAD09248.1|EREBP-3 homolog [*Stylosanthes hamata*] | CK | |
| 132 | CGPG858 | 271 | 0 | 91 | ref|NP__566718.2|TSO1 (CHINESE FOR 'UGLY'); transcription factor [*Arabidopsis thaliana*] dbj|BAB01253.1|DNA binding protein-like [*Arabidopsis thaliana*] | HS | |
| 133 | CGPG2562 | 272 | 0 | 88 | ref|NP__176964.1|AT-HSFA8 (*Arabidopsis thaliana* heat shock transcription factor A8); DNA binding/transcription factor | PEG | |
| 134 | CGPG31 | 273 | 0 | 88 | ref|NP__188713.1|EIN3 (ETHYLENE-INSENSITIVE3); transcription factor [*Arabidopsis thaliana*] | SS | |
| 135 | CGPG4213 | 274 | 1.00E−113 | 85 | ref|NP__181549.1|basic helix-loop-helix (bHLH) family protein [*Arabidopsis thaliana*] | LN | |
| 136 | CGPG477 | 275 | 5.00E−56 | 71 | ref|NP__196837.1|RAP2.6L (related to AP2 6L); DNA binding/ transcription factor [*Arabidopsis thaliana*] | LN | |
| 137 | CGPG6312 | 276 | 0 | 76 | ref|NP__190697.1|proline-rich family protein [*Arabidopsis thaliana*] | LL | |
| 138 | CGPG7188 | 277 | 1.00E−121 | 79 | ref|NP__564491.1|transcription regulator [*Arabidopsis thaliana*] | HS | |
| 139 | CGPG8726 | 278 | 1.00E−124 | 94 | gb|AAY78741.1|DNA-binding protein-related [*Arabidopsis thaliana*] | HS | |

Trait Enhancement Screens

DS-Enhancement of Drought Tolerance Identified by a Soil Drought Stress Tolerance Screen:

Drought or water deficit conditions impose mainly osmotic stress on plants. Plants are particularly vulnerable to drought during the flowering stage. The drought condition in the screening process disclosed in Example 1B started from the flowering time and was sustained to the end of harvesting. The present invention provides recombinant DNA that can improve the plant survival rate under such sustained drought condition. Exemplary recombinant DNA for conferring such drought tolerance are identified as such in Table 3. Such recombinant DNA can be used in generating transgenic plants that are tolerant to the drought condition imposed during flowering time and in other stages of the plant life cycle. As demonstrated from the model plant screen, in some embodiments of transgenic plants with trait-improving recombinant DNA grown under such sustained drought condition can also have increased total seed weight per plant in addition to the increased survival rate within a transgenic population, providing a higher yield potential as compared to control plants.

PEG-Enhancement of Drought Tolerance Identified by PEG Induced Osmotic Stress Tolerance Screen:

Various drought levels can be artificially induced by using various concentrations of polyethylene glycol (PEG) to produce different osmotic potentials (Pilon-Smits e.g., (1995) Plant Physiol. 107:125-130). Several physiological characteristics have been reported as being reliable indications for selection of plants possessing drought tolerance. These characteristics include the rate of seed germination and seedling growth. The traits can be assayed relatively easily by measuring the growth rate of seedling in PEG solution. Thus, a PEG-induced osmotic stress tolerance screen is a useful surrogate for drought tolerance screen. As demonstrated from the model plant screen, embodiments of transgenic plants with trait-improving recombinant DNA identified in the PEG-induced osmotic stress tolerance screen can survive better drought conditions providing a higher yield potential as compared to control plants.

SS-Enhancement of Drought Tolerance Identified by High Salinity Stress Tolerance Screen:

Three different factors are responsible for salt damages: (1) osmotic effects, (2) disturbances in the mineralization process, and (3) toxic effects caused by the salt ions, e.g., inactivation of enzymes. While the first factor of salt stress results in the wilting of the plants that is similar to drought effect, the ionic aspect of salt stress is clearly distinct from drought. The present invention provides genes that help plants maintain biomass, root growth, and/or plant development in high salinity conditions, which are identified as such in Table 3. Since osmotic effect is one of the major components of salt stress, which is common to the drought stress, trait-improving recombinant DNA identified in a high salinity stress tolerance screen can also provide transgenic crops with enhanced drought tolerance. As demonstrated from the model plant screen, embodiments of transgenic plants with trait-improving recombinant DNA identified in a high salinity stress tolerance screen can survive better drought conditions and/or high salinity conditions providing a higher yield potential as compared to control plants.

HS-Enhancement of Drought Tolerance Identified by Heat Stress Tolerance Screen:

Heat and drought stress often occur simultaneously, limiting plant growth. Heat stress can cause the reduction in photosynthesis rate, inhibition of leaf growth and osmotic potential in plants. Thus, genes identified by the present invention as heat stress tolerance conferring genes can also impart enhanced drought tolerance to plants. As demonstrated from the model plant screen, embodiments of transgenic plants with trait-improving recombinant DNA identified in a heat stress tolerance screen can survive better heat stress conditions and/or drought conditions providing a higher yield potential as compared to control plants.

CK and CS-Enhancement of Tolerance to Cold Stress:

Low temperature can immediately result in mechanical constraints, changes in activities of macromolecules, and reduced osmotic potential. In the present invention, two screening conditions, e.g., cold shock tolerance screen (CK) and cold germination tolerance screen (CS), were set up to look for transgenic plants that display visual growth advantage at lower temperature. In cold germination tolerance screen, the transgenic Arabidopsis plants were exposed to a constant temperature of 8° C. from planting until day 28 post plating. The trait-improving recombinant DNA identified by such screen are particular useful for the production of transgenic plant that can germinate more robustly in a cold temperature as compared to the wild type plants. In cold shock tolerance screen, the transgenic plants were first grown under the normal growth temperature of 22° C. until day 8 post plating, and subsequently were placed under 8° C. until day 28 post plating. As demonstrated from the model plant screen, embodiments of transgenic plants with trait-improving recombinant DNA identified in a cold shock stress tolerance screen and/or a cold germination stress tolerance screen can survive better cold conditions providing a higher yield potential as compared to control plants.

Enhancement of Tolerance to Multiple Stresses:

Different kinds of stresses often lead to identical or similar reaction in the plants. Genes that are activated or inactivated as a reaction to stress can either act directly in a way the genetic product reduces a specific stress, or they can act indirectly by activating other specific stress genes. By manipulating the activity of such regulatory genes, e.g., multiple stress tolerance genes, the plant can be enabled to react to different kinds of stresses. For examples, PEP SEQ ID NO:172 can be used to enhance both cold chock tolerance and heat stress tolerance in plants. Of particular interest, plants transformed with PEP SEQ ID NO: 235 can resist salt and osmotic stress. Plants transformed with PEP SEQ ID NO: 243 can also improve growth in early stage and under heat stress. In addition to these multiple stress tolerance genes, the stress tolerance conferring genes provided by the present invention may be used in combinations to generate transgenic plants that can resist multiple stress conditions.

PP-Enhancement of Early Plant Growth and Development:

It has been known in the art that to minimize the impact of disease on crop profitability, it is important to start the season with healthy and vigorous plants. This means avoiding seed and seedling diseases, leading to increased nutrient uptake and increased yield potential. Traditionally early planting and applying fertilizer are the methods used for promoting early seedling vigor. In early development stage, plant embryos establish only the basic root-shoot axis, a cotyledon storage organ(s), and stem cell populations, called the root and shoot apical meristems that continuously generate new organs throughout post-embryonic development. "Early growth and development" used herein encompasses the stages of seed imbibition through the early vegetative phase. The present invention provides genes that are useful to produce transgenic plants that have advantages in one or more processes including, but not limited to, germination, seedling vigor, root growth and root morphology under non-stressed conditions. The transgenic plants starting from a more robust seedling are less susceptible to the fungal and bacterial pathogens that attach germinating seeds and seedling. Furthermore, seedlings with advantage in root growth are more resistant to drought stress due to extensive and deeper root architecture. Therefore, it can be recognized by those skilled in the art that genes conferring the growth advantage in early stages to plants can also be used to generate transgenic plants that are more resistant to various stress conditions due to enhanced early plant development. The present invention provides such exemplary recombinant DNA that confer both the stress tolerance and growth advantages to plants, identified as such in Table 3, e.g., PEP SEQ ID NO: 173 which can improve the plant early growth and development, and impart salt tolerance to plants. As demonstrated from the model plant screen, embodiments of transgenic plants with trait-improving recombinant DNA identified in the early plant development screen can grow better under non-stress conditions and/or stress conditions providing a higher yield potential as compared to control plants.

SP-Enhancement of Late Plant Growth and Development:

"Late growth and development" used herein encompasses the stages of leaf development, flower production, and seed maturity. In certain embodiments, transgenic plants produced using genes that confer growth advantages to plants provided by the present invention, identified as such in Table 3, exhibit at least one phenotypic characteristics including, but not limited to, increased rosette radius, increased rosette dry weight, seed dry weight, silique dry weight, and silique length. On one hand, the rosette radius and rosette dry weight are used as the indexes of photosynthesis capacity, and thereby plant source strength and yield potential of a plant. On the other hand, the seed dry weight, silique dry weight and silique length are used as the indexes for plant sink strength, which are considered as the direct determinants of yield. As demonstrated from the model plant screen, embodiments of transgenic plants with trait-improving recombinant DNA identified in the late development screen can grow better and/or have enhanced development during leaf development and seed maturation providing a higher yield potential as compared to control plants.

LL-Enhancement of Tolerance to Shade Stress Identified in a Low Light Screen:

The effects of light on plant development are especially prominent at the seedling stage. Under normal light conditions with unobstructed direct light, a plant seeding develops according to a characteristic photomorphogenic pattern, in which plants have open and expanded cotyledons and short hypocotyls. Then the plant's energy is devoted to cotyledon and leaf development while longitudinal extension growth is minimized. Under low light condition where light quality and intensity are reduced by shading, obstruction or high population density, a seedling displays a shade-avoidance pattern, in which the seedling displays a reduced cotyledon expansion, and hypocotyls extension is greatly increased. As the result, a plant under low light condition increases significantly its stem length at the expanse of leaf, seed or fruit and storage organ development, thereby adversely affecting of yield. The present invention provides recombinant DNA that enable plants to have an attenuated shade avoidance response so that the source of plant can be contributed to reproductive growth efficiently, resulting higher yield as compared to the wild type plants. As demonstrated from the model plant screen, embodiments of transgenic plants with trait-improving recombinant DNA identified in a shade stress tolerance screen can have attenuated shade response under shade conditions providing a higher yield potential as compared to control plants. The transgenic plants generated by the present invention can be suitable for a higher density planting, thereby resulting increased yield per unit area.

LN-Enhancement of Tolerance to Low Nitrogen Availability Stress

Nitrogen is a key factor in plant growth and crop yield. The metabolism, growth and development of plants are profoundly affected by their nitrogen supply. Restricted nitrogen supply alters shoot to root ratio, root development, activity of enzymes of primary metabolism and the rate of senescence (death) of older leaves. All field crops have a fundamental dependence on inorganic nitrogenous fertilizer. Since fertilizer is rapidly depleted from most soil types, it must be supplied to growing crops two or three times during the growing season. Enhanced nitrogen use efficiency by plants should enable crops cultivated under low nitrogen availability stress condition resulted from low fertilizer input or poor soil quality.

This invention demonstrates that the transgenic plants generated using the recombinant nucleotides, which confer enhanced nitrogen use efficiency, identified as such in Table 3, exhibit one or more desirable traits including, but not limited to, increased seedling weight, greener leaves, increased number of rosette leaves, increased or decreased root length. One skilled in the art can recognize that the transgenic plants provided by the present invention with enhanced nitrogen use efficiency can also have altered amino acid or protein compositions, increased yield and/or better seed quality. The transgenic plants of the present invention can be productively cultivated under low nitrogen growth conditions, e.g., nitrogen-poor soils and low nitrogen fertilizer inputs, which would cause the growth of wild type plants to cease or to be so diminished as to make the wild type plants practically useless. The transgenic plants also can be advantageously used to achieve earlier maturing, faster growing, and/or higher yielding crops and/or produce more nutritious foods and animal feedstocks when cultivated using nitrogen non-limiting growth conditions.

Stacked Traits:

The present invention also encompasses transgenic plants with stacked engineered traits, e.g., a crop having an enhanced phenotype resulting from expression of a trait-improving recombinant DNA, in combination with herbicide and/or pest resistance traits. For example, genes of the current invention can be stacked with other traits of agronomic interest, such as a trait providing herbicide resistance, for example a RoundUp Ready® trait, or insect resistance, such as using a gene from *Bacillus thuringensis* to provide resistance against lepidopteran, coliopteran, homopteran, hemiopteran, and other insects. Herbicides for which resistance is useful in a plant include glyphosate herbicides, phosphinothricin herbicides, oxynil herbicides, imidazolinone herbicides, dinitroaniline herbicides, pyridine herbicides, sulfonylurea herbicides, bialaphos herbicides, sulfonamide herbicides and gluphosinate herbicides. To illustrate that the production of transgenic plants with herbicide resistance is a capability of those of ordinary skill in the art, reference is made to U.S. patent application publications 2003/0106096A1 and 2002/0112260A1 and U.S. Pat. Nos. 5,034,322; 5,776,760, 6,107,549 and 6,376,754, all of which are incorporated herein by reference. To illustrate that the production of transgenic plants with pest resistance is a capability of those of ordinary skill in the art, reference is made to U.S. Pat. Nos. 5,250,515 and 5,880,275 which disclose plants expressing an endotoxin of *Bacillus thuringiensis* bacteria, to U.S. Pat. No. 6,506,599 which discloses control of invertebrates which feed on transgenic plants which express dsRNA for suppressing a target gene in the invertebrate, to U.S. Pat. No. 5,986,175 which discloses the control of viral pests by transgenic plants which express viral replicase, and to U.S. Patent Application Publication 2003/0150017 A1 which discloses control of pests by a transgenic plant which express a dsRNA targeted to suppressing a gene in the pest, all of which are incorporated herein by reference.

Once one recombinant DNA has been identified as conferring an enhanced trait of interest in transgenic *Arabidopsis* plants, several methods are available for using the sequence of that recombinant DNA and knowledge about the protein it encodes to identify homologs of that sequence from the same plant or different plant species or other organisms, e.g., bacteria and yeast. Thus, in one aspect, the invention provides methods for identifying a homologous gene with a DNA sequence homologous to any of SEQ ID NO: 1 through SEQ ID NO: 139, or a homologous protein with an amino acid sequence homologous to any of SEQ ID NO: 140 through SEQ ID NO: 278. In another aspect, the present invention provides the protein sequences of identified homologs for a sequence listed as SEQ ID NO: 279 through SEQ ID NO: 6023. In yet another aspect, the present invention also includes linking or associating one or more desired traits, or gene function with a homolog sequence provided herein.

The trait-improving recombinant DNA and methods of using such trait-improving recombinant DNA for generating transgenic plants with enhanced traits provided by the present invention are not limited to any particular plant species. Indeed, the plants according to the present invention can be of any plant species, e.g., can be monocotyledonous or dicotyledonous. In one embodiment, they will be agricultural useful plants, e.g., plants cultivated by man for purposes of food production or technical, particularly industrial applications. Of particular interest in the present invention are corn and soybean plants. The recombinant DNA constructs optimized for soybean transformation and recombinant DNA constructs optimized for corn transformation are provided by the present invention. Other plants of interest in the present invention for production of transgenic plants having enhanced traits include, without limitation, cotton, canola, wheat, sunflower, sorghum, alfalfa, barley, millet, rice, tobacco, fruit and vegetable crops, and turfgrass.

In certain embodiments, the present invention contemplates to use an orthologous gene in generating the transgenic plants with similarly enhanced traits as the transgenic *Arabidopsis* counterpart. Enhanced physiological properties in transgenic plants of the present invention can be confirmed in responses to stress conditions, for example in assays using imposed stress conditions to detect enhanced responses to drought stress, nitrogen deficiency, cold growing conditions, or alternatively, under naturally present stress conditions, for example under field conditions. Biomass measures can be made on greenhouse or field grown plants and can include such measurements as plant height, stem diameter, root and shoot dry weights, and, for corn plants, ear length and diameter.

Trait data on morphological changes can be collected by visual observation during the process of plant regeneration as well as in regenerated plants transferred to soil. Such trait data includes characteristics such as normal plants, bushy plants, taller plants, thicker stalks, narrow leaves, striped leaves, knotted phenotype, chlorosis, albino, anthocyanin production, or altered tassels, ears or roots. Other enhanced traits can be identified by measurements taken under field conditions, such as days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy, green snap, and pest resistance. In addition, trait characteristics of harvested grain can be confirmed, including number of kernels per row on the ear, number of rows of kernels on the ear, kernel abortion, kernel weight, kernel size, kernel density and physical grain quality.

To confirm hybrid yield in transgenic corn plants expressing genes of the present invention, it can be desirable to test hybrids over multiple years at multiple locations in a geographical location where maize is conventionally grown, e.g., in Iowa, Illinois or other locations in the midwestern United States, under "normal" field conditions as well as under stress conditions, e.g., under drought or population density stress.

Transgenic plants can be used to provide plant parts according to the invention for regeneration or tissue culture of cells or tissues containing the constructs described herein. Plant parts for these purposes can include leaves, stems, roots, flowers, tissues, epicotyl, meristems, hypocotyls, cotyledons, pollen, ovaries, cells and protoplasts, or any other portion of the plant which can be used to regenerate additional transgenic plants, cells, protoplasts or tissue culture. Seeds of transgenic plants are provided by this invention can be used to propagate more plants containing the trait-improving recombinant DNA constructs of this invention. These descendants are intended to be included in the scope of this invention if they contain a trait-improving recombinant DNA construct of this invention, whether or not these plants are selfed or crossed with different varieties of plants.

The various aspects of the invention are illustrated by means of the following examples which are in no way intended to limit the full breath and scope of claims.

EXAMPLES

Example 1. Identification of Recombinant DNA that Confers Enhanced Trait(s) to Plants A. Plant Expression Constructs for *Arabidopsi* Transformation Each gene of interest was amplified from a genomic or cDNA library using primers specific to sequences upstream and downstream of the coding region. Transformation vectors were prepared to constitutively transcribe DNA in either sense orientation (for enhanced protein expression) or antisense orientation (for endogenous gene suppression) under the control of an enhanced *Cauliflower Mosaic* Virus 35S promoter (U.S. Pat. No. 5,359,142) directly or indirectly (Moore, e.g., PNAS 95:376-381, 1998; Guyer, e.g., Genetics 149: 633-639, 1998; International patent application NO. PCT/EP98/07577). The transformation vectors also contain a bar gene as a selectable marker for resistance to glufosinate herbicide. The transformation of *Arabidopsis* plants was carried out using the vacuum infiltration method known in the art (Bethtold, e.g., Methods Mol. Biol. 82:259-66, 1998). Seeds harvested from the plants, named as T1 seeds, were subsequently grown in a glufosinate-containing selective medium to select for plants which were actually transformed and which produced T2 transgenic seed.

B. Soil Drought Tolerance Screen

This example describes a soil drought tolerance screen to identify *Arabidopsis* plants transformed with recombinant DNA that wilt less rapidly and/or produce higher seed yield when grown in soil under drought conditions T2 seeds were sown in flats filled with Metro/Mix® 200 (The Scotts® Company, USA). Humidity domes were added to each flat and flats were assigned locations and placed in climate-controlled growth chambers. Plants were grown under a temperature regime of 22° C. at day and 20° C. at night, with a photoperiod of 16 hours and average light intensity of 170 μmol/m$^2$/s. After the first true leaves appeared, humidity domes were removed. The plants were sprayed with glufosinate herbicide and put back in the growth chamber for 3 additional days. Flats were watered for 1 hour the week following the herbicide treatment. Watering was continued every seven days until the flower bud primordia became apparent, at which time plants were watered for the last time.

To identify drought tolerant plants, plants were evaluated for wilting response and seed yield. Beginning ten days after the last watering, plants were examined daily until 4 plants/line had wilted. In the next six days, plants were monitored for wilting response. Five drought scores were assigned according to the visual inspection of the phenotypes: 1 for healthy, 2 for dark green, 3 for wilting, 4 severe wilting, and 5 for dead. A score of 3 or higher was considered as wilted.

At the end of this assay, seed yield measured as seed weight per plant under the drought condition was characterized for the transgenic plants and their controls and analyzed as a quantitative response according to example 1M.

Two approaches were used for statistical analysis on the wilting response. First, the risk score was analyzed for wilting phenotype and treated as a qualitative response according to the example 1L. Alternatively, the survival analysis was carried out in which the proportions of wilted and non-wilted transgenic and control plants were compared over each of the six days under scoring and an overall log rank test was performed to compare the two survival curves using S-PLUS statistical software (S-PLUS 6. Guide to statistics, Insightful. Seattle, Wash., USA). A list of recombinant DNA constructs which improve drought tolerance in transgenic plants is illustrated in Table 4

TABLE 4

| NUC SEQ ID | PEP SEQ ID | Construct ID | Nomination ID | Orientation | Drought score Delta mean | P-value | Seed yield Delta mean | P-value |
|---|---|---|---|---|---|---|---|---|
| 15 | 154 | 17491 | CGPG2639 | SENSE | 0.437 | 0.006 | −1.429 | 0.021 |
| 32 | 171 | 18504 | CGPG2935 | SENSE | 0.150 | 0.233 | −0.598 | 0.013 |
| 29 | 168 | 19640 | CGPG2805 | SENSE | −0.282 | 0.027 | 0.287 | 0.019 |
| 91 | 230 | 19869 | CGPG4166 | SENSE | −0.076 | 0.292 | −0.489 | 0.023 |
| 30 | 169 | 71530 | CGPG2811 | SENSE | 0.000 | 0.242 | −0.574 | 0.008 |
| 109 | 248 | 74307 | CGPG5422 | SENSE | 0.276 | 0.027 | −1.258 | 0.015 |
| 130 | 269 | 75611 | CGPG7840 | SENSE | 0.330 | 0.030 | −1.029 | 0.070 |
| 118 | 257 | 77801 | CGPG7378 | SENSE | 0.032 | 0.361 | −0.912 | 0.021 |

Transgenic plants comprising recombinant DNA expressing protein as set forth in SEQ ID NO: 160, 161, 184, 239, 240 or 268 showed enhanced drought tolerance by the second criteria as illustrated in Example 1L.

C. Heat Stress Tolerance Screen

Under high temperatures, Arabidopsis seedlings become chlorotic and root growth is inhibited. This example sets forth the heat stress tolerance screen to identify Arabidopsis plants transformed with the gene of interest that are more resistant to heat stress based on primarily their seedling weight and root growth under high temperature.

T2 seeds were plated on ½×MS salts, 1/% phytagel, with 10 μg/ml BASTA (7 per plate with 2 control seeds; 9 seeds total per plate). Plates were placed at 4° C. for 3 days to stratify seeds. Plates were then incubated at room temperature for 3 hours and then held vertically for 11 additional days at temperature of 34° C. at day and 20° C. at night. Photoperiod was 16 h. Average light intensity was −140 μmol/m$^2$/s. After 14 days of growth, plants were scored for glufosinate resistance, root length, final growth stage, visual color, and seedling fresh weight. A photograph of the whole plate was taken on day 14.

The seedling weight and root length were analyzed as quantitative responses according to example 1M. The final grow stage at day 14 was scored as success if 50% of the plants had reached 3 rosette leaves and size of leaves are greater than 1 mm (Boyes, et al. (2001) The Plant Cell 13, 1499-1510). The growth stage data was analyzed as a qualitative response according to example 1L. A list of recombinant DNA constructs that improve heat tolerance in transgenic plants illustrated in Table 5.

TABLE 5

| NUC Seq ID | PEP SEQ ID | Construct ID | Root length day 14 Delta mean | P-value | Growth stage at day 14 Risk score mean | P-value | Seedling weight Delta mean | P-value |
|---|---|---|---|---|---|---|---|---|
| 1 | 140 | 12796 | 0.029 | 0.808 | −0.137 | 0.383 | 0.783 | 0.007 |
| 31 | 170 | 17832 | 0.311 | 0.157 | 0.385 | 0.235 | 1.029 | 0.013 |
| 43 | 182 | 18240 | 0.098 | 0.585 | 0.095 | 0.795 | 0.856 | 0.021 |
| 48 | 187 | 18325 | −0.001 | 0.993 | 0.691 | 0.085 | 0.724 | 0.017 |
| 54 | 193 | 18436 | 0.208 | 0.016 | 0.548 | 0.364 | 1.091 | 0.009 |
| 33 | 172 | 18547 | 0.249 | 0.230 | −0.004 | | 0.918 | 0.024 |
| 34 | 173 | 18548 | −0.017 | 0.305 | 0.525 | 0.014 | 0.670 | 0.038 |
| 39 | 178 | 18549 | 0.127 | 0.441 | 0.601 | 0.202 | 0.912 | 0.016 |
| 57 | 196 | 18610 | 0.093 | 0.762 | 0.034 | 0.586 | 0.977 | 0.015 |
| 51 | 190 | 18843 | 0.147 | 0.087 | 0.603 | 0.042 | 0.641 | 0.006 |
| 16 | 155 | 19152 | 0.218 | 0.183 | 0.000 | | 0.935 | 0.004 |
| 46 | 185 | 19186 | 0.081 | 0.586 | −0.055 | | 0.645 | 0.020 |
| 29 | 168 | 19640 | 0.070 | 0.518 | 0.043 | 0.762 | 0.815 | 0.014 |
| 41 | 180 | 19644 | 0.226 | 0.139 | 1.126 | 0.086 | 1.244 | 0.003 |
| 53 | 192 | 19650 | −0.182 | 0.011 | −0.062 | 0.714 | 0.606 | 0.008 |
| 87 | 226 | 19748 | 0.612 | 0.016 | 0.795 | 0.254 | 1.149 | 0.003 |
| 84 | 223 | 19896 | 0.172 | 0.057 | 0.136 | 0.269 | 0.969 | 0.002 |
| 82 | 221 | 19920 | 0.189 | 0.414 | 0.993 | 0.152 | 1.023 | 0.017 |
| 92 | 231 | 19924 | 0.032 | 0.455 | 0.110 | 0.323 | 0.877 | 0.002 |
| 81 | 220 | 19972 | 0.136 | 0.079 | 1.169 | 0.001 | 0.970 | 0.012 |
| 63 | 202 | 70452 | −0.043 | 0.557 | 0.326 | 0.372 | 0.735 | 0.002 |
| 65 | 204 | 70455 | −0.012 | 0.920 | −0.023 | 0.772 | 0.506 | 0.003 |
| 61 | 200 | 70461 | 0.295 | 0.014 | 1.656 | 0.121 | 1.139 | 0.000 |
| 62 | 201 | 70470 | −0.122 | 0.507 | 0.125 | 0.663 | 0.783 | 0.003 |
| 64 | 203 | 70473 | −0.085 | 0.499 | −0.022 | 0.613 | 0.676 | 0.015 |
| 70 | 209 | 70481 | 0.179 | 0.299 | −0.018 | | 1.124 | 0.026 |
| 75 | 214 | 70483 | 0.014 | 0.842 | 0.914 | 0.312 | 0.843 | 0.018 |
| 73 | 212 | 70485 | 0.226 | 0.314 | 1.242 | 0.220 | 1.339 | 0.024 |
| 66 | 205 | 70542 | 0.139 | 0.018 | 0.639 | 0.527 | 0.887 | 0.030 |
| 69 | 208 | 70546 | −0.065 | 0.712 | 0.579 | 0.591 | 0.780 | 0.023 |
| 76 | 215 | 70625 | −0.104 | 0.274 | 0.466 | 0.244 | 0.682 | 0.004 |
| 88 | 227 | 70930 | 0.147 | 0.322 | 1.129 | 0.130 | 1.044 | 0.025 |
| 30 | 169 | 71530 | 0.100 | 0.445 | −0.107 | 0.058 | 0.690 | 0.021 |
| 93 | 232 | 71822 | 0.111 | 0.458 | 1.305 | 0.204 | 1.139 | 0.002 |
| 107 | 246 | 72109 | 0.101 | 0.637 | −0.007 | 0.901 | 1.006 | 0.012 |
| 108 | 247 | 72129 | 0.204 | 0.202 | 0.234 | 0.410 | 1.189 | 0.022 |
| 23 | 162 | 72674 | 0.145 | 0.103 | 0.196 | 0.693 | 0.956 | 0.006 |
| 72 | 211 | 72907 | 0.345 | 0.069 | 0.901 | 0.228 | 1.374 | 0.005 |
| 38 | 177 | 73821 | −0.078 | 0.622 | −0.151 | | 0.467 | 0.000 |
| 132 | 271 | 73934 | 0.109 | 0.337 | 0.239 | 0.491 | 1.150 | 0.012 |
| 37 | 176 | 74056 | 0.136 | 0.335 | −0.012 | | 0.816 | 0.012 |
| 14 | 153 | 76106 | 0.221 | 0.291 | 0.934 | 0.218 | 0.994 | 0.019 |
| 71 | 210 | 78318 | 0.079 | 0.438 | −0.012 | 0.949 | 0.905 | 0.002 |
| 139 | 278 | 78560 | 0.204 | 0.033 | 0.590 | 0.260 | 0.903 | 0.041 |
| 138 | 277 | 78989 | 0.102 | 0.417 | 0.308 | 0.303 | 0.625 | 0.014 |

Transgenic plants comprising recombinant DNA expressing protein as set forth in SEQ ID NO: 179, 222 or 243 showed enhanced heat stress tolerance by the second criteria as illustrated in Example 1L and 1M.

D. Salt Stress Tolerance Screen

This example sets forth the high salinity stress screen to identify Arabidopsis plants transformed with the gene of interest that are tolerant to high levels of salt based on their rate of development, root growth and chlorophyll accumulation under high salt conditions.

T2 seeds were plated on glufosinate selection plates containing 90 mM NaCl and grown under standard light and temperature conditions. All seedlings used in the embodiments were grown at a temperature of 22° C. at day and 20° C. at night, a 16-hour photoperiod, an average light intensity of approximately 120 umol/m$^2$. On day 11, plants were measured for primary root length. After 3 more days of growth (day 14), plants were scored for transgenic status, primary root length, growth stage, visual color, and the seedlings were pooled for fresh weight measurement. A photograph of the whole plate was also taken on day 14.

The seedling weight and root length were analyzed as quantitative responses according to example 1M. The final growth stage at day 14 was scored as success if 50% of the plants reached 3 rosette leaves and size of leaves are greater than 1 mm (Boyes, D. C., et al., (2001), The Plant Cell 13, 1499/1510). The growth stage data was analyzed as a qualitative response according to example 1L. A list of recombinant DNA constructs that improve high salinity tolerance in transgenic plants illustrated in Table 6.

TABLE 6

| NUC Seq ID No. | PEP SEQ ID | Root length at day 11 Delta mean | P-value | Root length at day 14 Delta mean | P-value | Growth stage at day 14 Delta mean | P-value | Seedling weight at day 14 Delta mean | P-value |
|---|---|---|---|---|---|---|---|---|---|
| 52 | 191 | 0.351 | 0.028 | 0.370 | 0.014 | 0.883 | 0.272 | 0.878 | 0.020 |

Transgenic plants comprising recombinant DNA expressing protein as set forth in SEQ ID NO: 143, 144, 146, 150, 163, 165, 166, 174, 183, 199, 235, 264 or 273 showed enhanced salt stress tolerance by the second criteria as illustrated in Example 1L and 1M.

E. Polyethylene Glycol (PEG) Induced Osmotic Stress Tolerance Screen

There are numerous factors, which can influence seed germination and subsequent seedling growth, one being the availability of water. Genes, which can directly affect the success rate of germination and early seedling growth, are potentially useful agronomic traits for improving the germination and growth of crop plants under drought stress. In this assay, PEG was used to induce osmotic stress on germinating transgenic lines of *Arabidopsis thaliana* seeds in order to screen for osmotically resistant seed lines.

T2 seeds were plated on BASTA selection plates containing 3% PEG and grown under standard light and temperature conditions. Seeds were plated on each plate containing 3% PEG, ½×MS salts, 1% phytagel, and 10 μg/ml glufosinate. Plates were placed at 4° C. for 3 days to stratify seeds. On day 11, plants were measured for primary root length. After 3 more days of growth, i.e., at day 14, plants were scored for transgenic status, primary root length, growth stage, visual color, and the seedlings were pooled for fresh weight measurement. A photograph of the whole plate was taken on day 14.

Seedling weight and root length were analyzed as quantitative responses according to example 1M. The final growth stage at day 14 was scored as success or failure based on whether the plants reached 3 rosette leaves and size of leaves are greater than 1 mm. The growth stage data was analyzed as a qualitative response according to example 1L. A list of recombinant DNA constructs that improve osmotic stress tolerance in transgenic plants illustrated in Table 7.

Transgenic plants comprising recombinant DNA expressing protein as set forth in SEQ ID NO: 147, 157, 198, 202, 207, 211, 252, 253, 266 or 272 showed enhanced PEG osmotic stress tolerance by the second criteria as illustrated in Example 1L and 1M.

F. Cold Shock Tolerance Screen

This example set forth a screen to identify *Arabidopsis* plants transformed with the genes of interest that are more tolerant to cold stress subjected during day 8 to day 28 after seed planting. During these crucial early stages, seedling growth and leaf area increase were measured to assess tolerance when *Arabidopsis* seedlings were exposed to low temperatures. Using this screen, genetic alterations can be found that enable plants to germinate and grow better than wild type plants under sudden exposure to low temperatures.

Eleven seedlings from T2 seeds of each transgenic line plus one control line were plated together on a plate containing ½× Gamborg Salts with 0.8 Phytagel™, 1% Phytagel, and 0.3% Sucrose. Plates were then oriented horizontally and stratified for three days at 4° C. At day three, plates were removed from stratification and exposed to standard conditions (16 hr photoperiod, 22° C. at day and 20° C. at night) until day 8. At day eight, plates were removed from standard conditions and exposed to cold shock conditions (24 hr photoperiod, 8° C. at both day and night) until the final day of the assay, i.e., day 28. Rosette areas were measured at day 8 and day 28, which were analyzed as quantitative responses according to example 1M. A list of recombinant nucleotides that improve cold shock stress tolerance in plants is illustrated in Table 8.

TABLE 7

| Nuc SEQ ID | PEP SEQ ID | Construct ID | Root length at day 11 Delta mean | Root length at day 11 P-value | Root length at day 14 Delta mean | Root length at day 14 P-value | Growth stage at day 14 Delta mean | Growth stage at day 14 P-value | Seedling weight at day 14 Delta mean | Seedling weight at day 14 P-value |
|---|---|---|---|---|---|---|---|---|---|---|
| 9 | 148 | 17523 | 0.342 | 0.005 | 0.283 | 0.045 | 2.877 | 0.124 | 0.405 | 0.119 |
| 96 | 235 | 75032 | 0.449 | 0.031 | 0.545 | 0.042 | 1.022 | 0.581 | 0.327 | 0.118 |

TABLE 8

| NUC Seq ID No. | PEP SEQ ID | Construct ID | Rosette area at day 8 Delta mean | Rosette area at day 8 P-value | Rosette area at day 28 Risk score mean | Rosette area at day 28 P-value | Rosette area difference Delta mean | Rosette area difference P-value |
|---|---|---|---|---|---|---|---|---|
| 111 | 250 | 12179 | −0.611 | 0.0161 | 0.0353 | 0.666 | 0.862 | 0.007 |
| 36 | 175 | 18542 | 0.583 | 0.184 | 0.094 | 0.019 | 0.078 | 0.006 |
| 33 | 172 | 18547 | −0.162 | 0.531 | 0.521 | 0.059 | 0.622 | 0.020 |
| 51 | 190 | 18843 | 0.114 | 0.495 | 0.728 | 0.009 | 0.667 | 0.007 |
| 90 | 229 | 19796 | 0.157 | 0.0886 | 0.438 | 0.005 | 0.382 | 0.0164 |
| 77 | 216 | 70489 | 0.488 | 0.081 | 0.312 | 0.010 | 0.220 | 0.311 |
| 19 | 158 | 70736 | −0.213 | 0.549 | 0.389 | 0.013 | 0.226 | 0.344 |
| 100 | 239 | 73675 | 0.088 | 0.832 | 0.586 | 0.041 | 0.720 | 0.032 |
| 131 | 270 | 75751 | 0.199 | 0.251 | 0.987 | 0.033 | 1.093 | 0.033 |
| 20 | 159 | 76073 | 0.510 | 0.329 | 0.515 | 0.020 | 0.566 | 0.067 |

Transgenic plants comprising recombinant DNA expressing protein as set forth in PEP SEQ ID NO. 265 or 270 showed enhanced cold stress tolerance by the second criterial as illustrated in Example 1L and 1M.

G. Cold Germination Tolerance Screen

This example sets forth a screen to identify *Arabidopsis* plants transformed with the genes of interests are resistant to cold stress based on their rate of development, root growth and chlorophyll accumulation under low temperature conditions.

T2 seeds were plated and all seedlings used in the embodiments were grown at 8° C. Seeds were first surface disinfected using chlorine gas and then seeded on assay plates containing an aqueous solution of ½× Gamborg's B/5 Basal Salt Mixture (Sigma/Aldrich Corp., St. Louis, Mo., USA G/5788), 1% Phytagel™ (Sigma-Aldrich, P-8169), and 10 ug/ml glufosinate with the final pH adjusted to 5.8 using KOH. Test plates were held vertically for 28 days at a constant temperature of 8° C., a photoperiod of 16 hr, and average light intensity of approximately 100 umol/m$^2$/s. At 28 days post plating, root length was measured, growth stage was observed, the visual color was assessed, and a whole plate photograph was taken.

The root length at day 28 was analyzed as a quantitative response according to example 1M. The growth stage at day 7 was analyzed as a qualitative response according to example 1L. A list of recombinant DNA constructs that improve cold stress tolerance in transgenic plants illustrated in Table 9.

the leaf angle, and a reduction in chlorophyll content. While these changes can confer a competitive advantage to individuals, in a monoculture the shade avoidance response is thought to reduce the overall biomass of the population. Thus, genetic alterations that prevent the shade avoidance response can be associated with higher yields. Genes that favor growth under low light conditions can also promote yield, as inadequate light levels frequently limit yield. This protocol describes a screen to look for *Arabidopsis* plants that show an attenuated shade avoidance response and/or grow better than control plants under low light intensity. Of particular interest, we were looking for plants that didn't extend their petiole length, had an increase in seedling weight relative to the reference and had leaves that were more close to parallel with the plate surface.

T2 seeds were plated on glufosinate selection plates with ½ MS medium. Seeds were sown on ½×MS salts, 1% Phytagel, 10 ug/ml BASTA. Plants were grown on vertical plates at a temperature of 22° C. at day, 20° C. at night and under low light (approximately 30 uE/m$^2$/s, far/red ratio (655/665/725/735) ~0.35 using PLAQ lights with GAM color filter #680). Twenty-three days after seedlings were sown, measurements were recorded including seedling status, number of rosette leaves, status of flower bud, petiole

TABLE 9

| NUC Seq ID No. | PEP SEQ ID | Construct ID | Nomination ID | Orientation | Root length at day 28 Delta mean | Root length at day 28 P-value | Growth stage at day 28 Delta mean | Growth stage at day 28 P-value |
|---|---|---|---|---|---|---|---|---|
| 43 | 182 | 18240 | CGPG3289 | SENSE | 0.289 | 0.020 | 0.325 | 0.029 |
| 57 | 196 | 18610 | CGPG3505 | SENSE | 0.642 | 0.059 | 0.983 | 0.006 |
| 65 | 204 | 70455 | CGPG3810 | SENSE | | | 4.000 | |
| 73 | 212 | 70485 | CGPG3857 | SENSE | 0.213 | 0.102 | 0.959 | 0.010 |
| 74 | 213 | 70486 | CGPG3858 | SENSE | 0.383 | 0.223 | 1.682 | 0.049 |
| 98 | 237 | 70773 | CGPG4632 | SENSE | 0.134 | 0.186 | 1.455 | 0.005 |
| 89 | 228 | 70983 | CGPG4112 | SENSE | 0.362 | 0.015 | 2.033 | 0.059 |
| 124 | 263 | 75531 | CGPG7714 | SENSE | 0.035 | 0.778 | 1.717 | 0.001 |
| 127 | 266 | 75572 | CGPG7757 | SENSE | 0.278 | 0.025 | 2.252 | 0.002 |

Transgenic plants comprising recombinant DNA expressing protein as set forth in SEQ ID NO: 173, 204, 207, 208, 209, 213, 228 or 251 showed enhanced cold stress tolerance by the 10 second criterial as illustrated in Example 1L and 1M.

H. Shade Tolerance Screen

Plants undergo a characteristic morphological response in shade that includes the elongation of the petiole, a change in leaf angle, petiole length, and pooled fresh weights. A digital image of the whole plate was taken on the measurement day. Seedling weight and petiole length were analyzed as quantitative responses according to example 1M. The number of rosette leaves, flowering bud formation and leaf angel were analyzed as qualitative responses according to example 1L.

A list of recombinant DNA constructs that improve shade tolerance in plants illustrated in Table 10.

TABLE 10

| NUC Seq ID | PEP SEQ ID | Construct ID | Nomination ID | Orientation | Seedling weight at day 23 Delta mean | Seedling weight at day 23 P-value | Petiole length at day 23 Delta mean | Petiole length at day 23 P-value |
|---|---|---|---|---|---|---|---|---|
| 6 | 145 | 17507 | CGPG2551 | SENSE | 0.467 | 0.025 | 0.312 | 0.067 |
| 84 | 223 | 19896 | CGPG4015 | SENSE | 0.360 | 0.035 | 0.262 | 0.060 |
| 99 | 238 | 70215 | CGPG490 | SENSE | −0.080 | 0.133 | −0.088 | 0.050 |

For "seeding weight", if p<0.05 and delta or risk score mean>0, the transgenic plants showed statistically significant trait enhancement as compared to the reference. If p<0.2 and delta or risk score mean>0, the transgenic plants showed a trend of trait enhancement as compared to the reference with p<0.2.

For "petiole length", if p<0.05 and delta <0, the transgenic plants showed statistically significant trait enhancement as compared to the reference. If p<0.2 and delta <0, the transgenic plants showed a trend of trait enhancement as compared to the reference.

Transgenic plants comprising recombinant DNA expressing protein as set forth in SEQ ID NO: 160, 184, 197, 225, 233, 234, 236, 237, 241, 242, 255, 258, 259, 260, 263, 267 or 276 showed enhanced tolerance to shade or low light condition by the second criterial as illustrated in Example 1L and 1M.

I. Early Plant Growth and Development Screen

This example sets forth a plate based phenotypic analysis platform for the rapid detection of phenotypes that are evident during the first two weeks of growth. In this screen, we were looking for genes that confer advantages in the processes of germination, seedling vigor, root growth and root morphology under non-stressed growth conditions to plants. The transgenic plants with advantages in seedling growth and development were determined by the seedling weight and root length at day 14 after seed planting.

T2 seeds were plated on glufosinate selection plates and grown under standard conditions (~100 uE/m² is, 16 h photoperiod, 22° C. at day, 20° C. at night). Seeds were stratified for 3 days at 4° C. Seedlings were grown vertically (at a temperature of 22° C. at day 20° C. at night). Observations were taken on day 10 and day 14. Both seedling weight and root length at day 14 were analyzed as quantitative responses according to example 1M.

A list recombinant DNA constructs that improve early plant growth and development illustrated in Table 11.

TABLE 11

| NUC Seq ID | PEP SEQ ID | Construct ID | Root length at day 10 Delta mean | Root length at day 10 P-value | Root length at day 14 Delta mean | Root length at day 14 P-value | Seedling weight at day 14 Delta mean | Seedling weight at day 14 P-value |
|---|---|---|---|---|---|---|---|---|
| 8 | 147 | 17521 | 0.508 | 0.003 | 0.385 | 0.003 | 0.164 | 0.222 |
| 17 | 156 | 17907 | | | | | 0.588 | 0.021 |
| 25 | 164 | 17911 | 0.272 | 0.049 | 0.107 | 0.295 | 0.254 | 0.091 |
| 50 | 189 | 18248 | 0.477 | 0.014 | 0.301 | 0.004 | 0.592 | 0.048 |
| 2 | 141 | 18301 | 0.200 | 0.173 | 0.157 | 0.048 | 0.299 | 0.001 |
| 42 | 181 | 18836 | 0.081 | 0.426 | 0.144 | 0.037 | 0.066 | 0.734 |
| 80 | 219 | 19880 | 0.405 | 0.010 | 0.239 | 0.003 | 0.459 | 0.024 |
| 85 | 224 | 19957 | 0.234 | 0.052 | 0.240 | 0.035 | 0.332 | 0.027 |
| 110 | 249 | 72926 | 0.244 | 0.024 | 0.119 | 0.304 | 0.235 | 0.033 |
| 78 | 217 | 74202 | 0.094 | 0.044 | 0.080 | 0.056 | 0.025 | 0.587 |
| 28 | 167 | 78468 | 0.194 | 0.050 | 0.087 | 0.039 | 0.309 | 0.039 |
| 90 | 229 | 19796 | 0.274 | 0.004 | 0.221 | 0.022 | 0.561 | 0.0002 |

Transgenic plants comprising recombinant DNA expressing a protein as set forth in SEQ ID NO: 149, 155, 165, 173, 174, 186, 218 or 243 showed enhanced tolerance to shade or low light condition by the second criterial as illustrated in Example 1L and 1M.

J. Late Plant Growth and Development Screen

This example sets forth a soil based phenotypic platform to identify genes that confer advantages in the processes of leaf development, flowering production and seed maturity to plants.

*Arabidopsis* plants were grown on a commercial potting mixture (Metro Mix 360, Scotts Co., Marysville, Ohio) consisting of 30-40% medium grade horticultural vermiculite, 35-55% sphagnum peat moss, 10-20% processed bark ash, 1-15% pine bark and a starter nutrient charge. Soil was supplemented with Osmocote time-release fertilizer at a rate of 30 mg/ft³. T2 seeds were imbibed in 1% agarose solution for 3 days at 4° C. and then sown at a density of ~5 per ½" pot. Thirty-two pots were ordered in a 4 by 8 grid in standard greenhouse flat. Plants were grown in environmentally controlled rooms under a 16 h day length with an average light intensity of ~200 μmoles/m²/s. Day and night temperature set points were 22° C. and 20° C., respectively. Humidity was maintained at 65%. Plants were watered by sub-irrigation every two days on average until mid-flowering, at which point the plants were watered daily until flowering was complete.

Application of the herbicide glufosinate was performed to select T2 individuals containing the target transgene. A single application of glufosinate was applied when the first true leaves were visible. Each pot was thinned to leave a single glufosinate-resistant seedling ~3 days after the selection was applied.

The rosette radius was measured at day 25. The silique length was measured at day 40. The plant parts were harvested at day 49 for dry weight measurements if flowering production was stopped. Otherwise, the dry weights of rosette and silique were carried out at day 53. The seeds were harvested at day 58. All measurements were analyzed as quantitative responses according to example 1M.

A list of recombinant DNA constructs that improve late plant growth and development illustrated in Table 12.

TABLE 12

| NUC SEQ ID | PEP SEQ ID | Rosette dry weight at day 53 Delta mean | Rosette dry weight at day 53 P-value | Rosette radius at day 25 Delta mean | Rosette radius at day 25 P-value | Seed net dry weight at day 62 Delta mean | Seed net dry weight at day 62 P-value | Silique dry weight at day 53 Delta mean | Silique dry weight at day 53 P-value | Silique length at day 40 Delta mean | Silique length at day 40 P-value |
|---|---|---|---|---|---|---|---|---|---|---|---|
| 17 | 156 | −0.333 | 0.026 | 0.000 | 1.000 | 1.401 | 0.017 | 0.419 | 0.040 | 0.020 | 0.635 |
| 61 | 200 | −0.354 | 0.147 | −0.120 | 0.139 | 1.079 | 0.006 | | | 0.009 | 0.819 |
| 3 | 142 | −0.234 | 0.138 | −0.024 | 0.756 | 1.618 | 0.000 | −0.192 | 0.476 | 0.025 | 0.100 |
| 123 | 262 | −0.057 | 0.586 | 0.042 | 0.480 | 0.985 | 0.014 | −0.085 | 0.537 | −0.068 | 0.363 |

If p<0.05 and delta or risk score mean>0, the transgenic plants showed statistically significant trait enhancement as compared to the reference. If p<0.2 and delta or risk score mean>0, the transgenic plants showed a trend of trait enhancement as compared to the reference. Transgenic plants comprising recombinant DNA expressing protein as set forth in SEQ ID NO: 245 showed enhanced tolerance to shade or low light condition by the second criterial as illustrated in Example 1L and 1M.

K. Limited Nitrogen Tolerance Screen

Under low nitrogen conditions, Arabidopsis seedlings become chlorotic and have less biomass. This example sets forth the limited nitrogen tolerance screen to identify Arabidopsis plants transformed with the gene of interest that are altered in their ability to accumulate biomass and/or retain chlorophyll under low nitrogen condition.

T2 seeds were plated on glufosinate selection plates containing 0.5× N-Free Hoagland's T 0.1 mM NH$_4$NO$_3$ T 0.1% sucrose T 1% phytagel media and grown under standard light and temperature conditions. At 12 days of growth, plants were scored for seedling status (i.e., viable or non-viable) and root length. After 21 days of growth, plants were scored for BASTA resistance, visual color, seedling weight, number of green leaves, number of rosette leaves, root length and formation of flowering buds. A photograph of each plant was also taken at this time point.

The seedling weight and root length were analyzed as quantitative responses according to example 1M. The number green leaves, the number of rosette leaves and the flowerbud formation were analyzed as qualitative responses according to example 1L. The leaf color raw data were collected on each plant as the percentages of five color elements (Green, DarkGreen, LightGreen, RedPurple, YellowChlorotic) using a computer imaging system. A statistical logistic regression model was developed to predict an overall value based on five colors for each plant.

A list of recombinant DNA constructs that improve low nitrogen availability tolerance in plants illustrated in Table 13.

Transgenic plants comprising recombinant DNA expressing a protein as set forth in SEQ ID NO: 151, 152, 188, 195, 206, 254, 256, 261, 264, or 274 showed enhanced tolerance to shade or low light condition by the second criterial as illustrated in Example 1L and 1M.

L. Statistic Analysis for Qualitative Responses

A list of responses that were analyzed as qualitative responses illustrated in Table 14.

TABLE 14

| response | Screen | categories (success vs. failure) |
| --- | --- | --- |
| Wilting response | Soil drought tolerance screen | non-wilted vs. wilted |
| Risk Score growth stage at day 14 | heat stress tolerance screen | 50% of plants reach stage1.03 vs. not |
| growth stage at day 14 | salt stress tolerance screen | 50% of plants reach stage1.03 vs. not |
| growth stage at day 14 | PEG induced osmotic stress tolerance screen | 50% of plants reach stage1.03 vs. not |
| growth stage at day 7 | cold germination tolerance screen | 50% of plants reach stage 0.5 vs. not |
| number of rosette leaves at day 23 | Shade tolerance screen | 5 leaves appeared vs. not |
| Flower bud formation at day 23 | Shade tolerance screen | flower buds appear vs. not |
| leaf angle at day 23 | Shade tolerance screen | >60 degree vs. <60 degree |
| number of green leaves at day 21 | limited nitrogen tolerance screen | 6 or 7 leaves appeared vs. not |
| number of rosette leaves at day 21 | limited nitrogen tolerance screen | 6 or 7 leaves appeared vs. not |
| Flower bud formation at day 21 | limited nitrogen tolerance screen | flower buds appear vs. not |

Plants were grouped into transgenic and reference groups and were scored as success or failure according to Table 14. First, the risk (R) was calculated, which is the proportion of plants that were scored as of failure plants within the group.

TABLE 13

| NUC SEQ ID | PEP SEQ ID | Construct ID | Nomination ID | Orientation | Leaf color at day 21 | | Rosette weight at day 21 | |
| --- | --- | --- | --- | --- | --- | --- | --- | --- |
| | | | | | Risk score mean | P-value | Delta mean | P-value |
| 136 | 275 | 10804 | CGPG477 | ANTI-SENSE | 3.281 | 0.015 | −0.118 | 0.063 |
| 55 | 194 | 19634 | CGPG3468 | SENSE | 1.332 | 0.025 | −0.008 | 0.933 |
| 79 | 218 | 71971 | CGPG3879 | SENSE | 1.566 | 0.539 | 0.182 | 0.011 |
| 105 | 244 | 72117 | CGPG5316 | SENSE | −1.264 | 0.178 | 0.060 | 0.048 |
| 106 | 245 | 72118 | CGPG5324 | SENSE | 2.897 | 0.130 | 0.093 | 0.018 |
| 104 | 243 | 72106 | CGPG5306 | SENSE | −1.867 | 0.048 | 0.117 | 0.018 |
| 125 | 264 | 75594 | CGPG7743 | SENSE | −4.165 | 0.0009 | −0.216 | 0.344 |

For rosette weight, if p<0.05 and delta or risk score mean>0, the transgenic plants showed statistically significant trait enhancement as compared to the reference. If p<0.2 and delta or risk score mean>0, the transgenic plants showed a trend of trait enhancement as compared to the reference with p<0.2. For root length, if p<0.05, the transgenic plants showed statistically significant trait enhancement as compared to the reference. If p<0.2, the transgenic plants showed a trend of trait enhancement as compared to the reference.

Then the relative risk (RR) was calculated as the ratio of R (transgenic) to R (reference). Risk score (RS) was calculated as $-\log_2^{RR}$. Two criteria were used to determine a transgenic with enhanced trait(s). Transgenic plants comprising recombinant DNA disclosed herein showed trait enhancement according to either or both of the two criteria.

For the first criteria, the risk scores from multiple events of the transgene of interest were evaluated for statistical significance by t-test using SAS statistical software (SAS 9, SAS/STAT User's Guide, SAS Institute Inc., Cary, N.C., USA). RS with a value greater than 0 indicates that the transgenic plants perform better than the reference. RS with a value less than 0 indicates that the transgenic plants perform worse than the reference. The RS with a value equal to 0 indicates that the performance of the transgenic plants and the reference don't show any difference. If p<0.05 and risk score mean>0, the transgenic plants showed statistically significant trait enhancement as compared to the reference. If p<0.2 and risk score mean>0, the transgenic plants showed a trend of trait enhancement as compared to the reference.

For the second criteria, the RS from each event was evaluated for statistical significance by t-test using SAS statistical software (SAS 9, SAS/STAT User's Guide, SAS Institute Inc, Cary, N.C., USA). The RS with a value greater than 0 indicates that the transgenic plants from this event performs better than the reference. The RS with a value less than 0 indicates that the transgenic plants from this event perform worse than the reference. The RS with a value equal to 0 indicates that the performance of the transgenic plants from this event and the reference don't show any difference. If p<0.05 and risk score mean>0, the transgenic plants from this event showed statistically significant trait enhancement as compared to the reference. If p<0.2 and risk score mean>0, the transgenic plants showed a trend of trait enhancement as compared to the reference. If two or more events of the transgene of interest showed improvement in the same response, the transgene was deemed to show trait enhancement.

M. Statistic Analysis for Quantitative Responses

A list of responses that were analyzed as quantitative responses illustrated in Table 15.

TABLE 15

| response | screen |
| --- | --- |
| seed yield | Soil drought stress tolerance screen |
| seedling weight at day 14 | heat stress tolerance screen |
| root length at day 14 | heat stress tolerance screen |
| seedling weight at day 14 | salt stress tolerance screen |
| root length at day 14 | salt stress tolerance screen |
| root length at day 11 | salt stress tolerance screen |
| seedling weight at day 14 | PEG induced osmotic stress tolerance screen |
| root length at day 11 | PEG induced osmotic stress tolerance screen |
| root length at day 14 | PEG induced osmotic stress tolerance screen |
| rosette area at day 8 | cold shock tolerance screen |
| rosette area at day 28 | cold shock tolerance screen |
| difference in rosette area from day 8 to day 28 | cold shock tolerance screen |
| root length at day 28 | cold germination tolerance screen |
| seedling weight at day 23 | Shade tolerance screen |
| petiole length at day 23 | Shade tolerance screen |
| root length at day 14 | Early plant growth and development screen |
| Seedling weight at day14 | Early plant growth and development screen |
| Rosette dry weight at day 53 | Late plant growth and development screen |
| rosette radius at day 25 | Late plant growth and development screen |
| seed dry weight at day 58 | Late plant growth and development screen |
| silique dry weight at day 53 | Late plant growth and development screen |
| silique length at day 40 | Late plant growth and development screen |

TABLE 15-continued

| response | screen |
| --- | --- |
| Seedling weight at day 21 | Limited nitrogen tolerance screen |
| Root length at day 21 | Limited nitrogen tolerance screen |

The measurements (M) of each plant were transformed by $log_2$ calculation. The Delta was calculated as $log_2M$(transgenic)$-log_2M$(reference). Two criteria were used to determine trait enhancement. A transgene of interest could show trait enhancement according to either or both of the two criteria. The measurements (M) of each plant were transformed by $log_2$ calculation. The Delta was calculated as $log_2M$(transgenic)$-log_2M$(reference). If the measured response was Petiole Length for the Low Light assay, Delta was subsequently multiplied by −1, to account for the fact that a shorter petiole length is considered an indication of trait enhancement.

For the first criteria, the Deltas from multiple events of the transgene of interest were evaluated for statistical significance by t-test using SAS statistical software (SAS 9, SAS/STAT User's Guide, SAS Institute Inc, Cary, N.C., USA). Delta with a value greater than 0 indicates that the transgenic plants perform better than the reference. Delta with a value less than 0 indicates that the transgenic plants perform worse than the reference. The Delta with a value equal to 0 indicates that the performance of the transgenic plants and the reference don't show any difference. If p<0.05 and risk score mean>0, the transgenic plants showed statistically significant trail enhancement as compared to the reference. If p<0.2 and risk score mean>0, the transgenic plants showed a trend of trait enhancement as compared to the reference.

For the second criteria, the delta from each event was evaluated for statistical significance by t-test using SAS statistical software (SAS 9, SAS/STAT User's Guide, SAS Institute Inc., Cary, N.C., USA). The Delta with a value greater than 0 indicates that the transgenic plants from this event performs better than the reference. The Delta with a value less than 0 indicates that the transgenic plants from this event perform worse than the reference. The Delta with a value equal to 0 indicates that the performance of the transgenic plants from this event and the reference don't show any difference. If p<0.05 and delta mean>0, the transgenic plants from this event showed statistically significant trait improvement as compared to the reference. If p<0.2 and delta mean>0, the transgenic plants showed a trend of trait enhancement as compared to the reference. If two or more events of the transgene of interest showed enhancement in the same response, the transgene was deemed to show trait improvement.

Example 2. Identification of Homologs

A BLAST searchable "All Protein Database" is constructed of known protein sequences using a proprietary sequence database and the National Center for Biotechnology Information (NCBI) non-redundant amino acid database (nr.aa). For each organism from which a DNA sequence provided herein was obtained, an "Organism Protein Database" is constructed of known protein sequences of the organism; the Organism Protein Database is a subset of the All Protein Database based on the NCBI taxonomy ID for the organism.

The All Protein Database is queried using amino acid sequence of protein for gene DNA used in trait-improving recombinant DNA, e.g., sequences of SEQ ID NO: 140 through SEQ ID NO: 278 using "blastp" with E-value cutoff of $1e^{-8}$. Up to 1000 top hits were kept, and separated by organism names. For each organism other than that of the query sequence, a list is kept for hits from the query organism itself with a more significant E-value than the best hit of the organism. The list contains likely duplicated genes, and is referred to as the Core List. Another list was kept for all the hits from each organism, sorted by E-value, and referred to as the Hit List.

The Organism Protein Database is queried using amino acid sequences of SEQ ID NO: 140 through SEQ ID NO: 278 using "blastp" with E-value cutoff of $1e^{-4}$. Up to 1000 top hits are kept. A BLAST searchable database is constructed based on these hits, and is referred to as "SubDB". SubDB was queried with each sequence in the Hit List using "blastp" with E-value cutoff of $1e^{-8}$. The hit with the best E-value is compared with the Core List from the corresponding organism. The hit is deemed a likely ortholog if it belongs to the Core List, otherwise it is deemed not a likely ortholog and there is no further search of sequences in the Hit List for the same organism. Likely orthologs from a large number of distinct organisms were identified and are reported by amino acid sequences of SEQ ID NO: 279 to SEQ ID NO: 6023. These orthologs are reported in Tables 16 as homologs to the proteins corresponding to genes used in trait-improving recombinant DNA.

TABLE 16

| SEQ ID NO: | homolog SEQ ID NOs |
|---|---|
| 140 | 706 583 749 1086 889 4107 4890 5430 5612 5594 5975 5992 3470 3467 4873 5969 2008 1250 2884 2958 5903 2565 2070 1078 773 2235 4335 3214 4415 4455 3698 2745 2621 5012 3281 5559 5099 4670 5882 4112 292 2139 2117 574 3241 5646 765 |
| 141 | 5572 480 2492 5574 3604 3508 1313 4894 2962 1986 980 1872 2159 5857 2531 4416 2195 5995 3011 1037 1829 1932 332 |
| 142 | 1425 4267 1156 1158 3175 3370 5813 5349 323 1183 3689 3801 5576 909 3422 |
| 143 | 1940 1119 2138 1862 5052 5472 868 572 1040 4058 676 5951 1286 4676 5427 5999 6004 |
| 144 | 4034 1262 5043 4488 3122 382 2293 4246 5255 3244 265 2807 2929 5984 4993 1551 4627 1294 1566 1459 458 4519 2776 1652 2082 2649 5796 2283 2023 4293 4315 1293 4100 3901 3311 4688 4068 820 1612 1221 4055 3085 1996 4893 3751 5025 2729 845 2135 3195 3814 4466 5641 5108 5763 2640 586 4810 5694 4552 496 1055 1714 4402 1493 3104 |
| 145 | 4559 4904 5098 4982 1325 2232 4706 2837 |
| 146 | 4044 4599 4596 4123 4126 4927 3191 3185 3187 1517 523 421 469 474 3181 3946 3466 1289 684 2433 4760 554 5051 1173 1177 4119 4157 4154 4153 1653 1623 4318 3119 1096 1895 1538 686 1291 3891 370 4991 5005 4396 2493 386 3794 1257 5775 2919 1934 5213 4973 1838 3945 5344 5304 2122 4587 646 5819 2977 2759 3349 2817 2736 5208 526 1147 525 551 550 548 547 1144 2160 2158 2163 1561 1801 1804 608 626 4158 2547 1771 1137 1923 751 299 5783 690 1295 5690 3430 833 992 1100 4289 1726 5130 3169 3149 582 3850 |
| 147 | 2968 1281 3943 3942 2774 2848 2846 3813 1113 1696 1881 1858 5614 1426 1427 1900 1902 1879 1876 1057 3093 2526 2530 2522 1823 1821 4989 2826 2824 2026 2027 4260 5513 5078 2002 4849 3096 3094 1850 1848 2532 1851 1056 1700 1633 2879 1017 3441 3443 3884 2057 2054 2024 2000 1997 1781 2494 1110 2855 1115 5275 2020 402 4915 2190 1957 931 2654 4159 4332 5767 1062 1061 1085 1083 2489 1087 1673 1698 3188 1815 1713 3439 4122 3541 5209 2025 1386 1363 1391 3739 3815 4065 5795 1865 4640 4278 2787 2984 2735 5981 1990 1972 1974 1646 2858 1600 1596 2225 2204 2211 1595 2208 2227 2199 2223 2224 2202 1114 1116 738 367 5838 4568 647 450 5010 2251 5512 2691 1129 2798 641 659 4698 1165 1089 1716 4731 2721 2306 2324 1754 1907 1760 4220 4238 2121 1373 3967 5220 4005 4022 3832 3835 3852 2175 1521 4240 405 1395 4268 1569 516 1752 2019 2073 2074 1689 654 2092 4857 2046 3575 5183 2042 3831 2593 705 3763 |

TABLE 16-continued

| SEQ ID NO: | homolog SEQ ID NOs |
|---|---|
| | 3296 5917 5625 2641 5890 2658 1108 4250 3736 2327 3342 374 5119 1079 3170 1813 3859 2820 2080 1039 2497 2500 5121 3783 3803 4103 3382 3385 1976 3336 2313 1311 353 2646 3954 2071 1971 4404 609 1675 1694 3840 4456 1530 4622 1202 3539 2203 |
| 148 | 4182 2778 4726 3323 4652 2981 322 390 3479 1263 2331 1241 1956 5803 3120 4500 4418 732 4740 2645 |
| 149 | 3953 1949 1651 4276 5811 2557 5727 4517 2978 4020 3215 4950 3135 |
| 150 | 2990 2566 3100 4734 3825 756 4214 5757 3851 2321 4679 5525 3354 3855 3941 5018 3517 4172 3250 5399 873 |
| 151 | 2968 2970 4423 3943 3942 1859 5233 1155 3627 3653 4236 4254 3680 4989 3816 2771 3935 5513 5138 3009 5832 5266 3963 3964 3707 3711 2002 4790 5326 5331 5192 3940 3921 3687 305 2329 5540 5724 5235 3556 5395 1633 3784 4113 1017 3884 2024 2057 2000 1997 2923 2855 3489 3490 5198 2186 4613 5382 5392 5387 5887 2051 2020 2021 452 455 2628 476 5122 4332 803 4118 5139 3739 1945 1941 3128 2596 2614 4690 932 910 929 3105 3101 3080 5069 3010 3026 3013 3012 3815 546 5153 2342 2936 2924 5254 5251 3672 4241 4453 3675 4640 5652 1952 1774 2735 1882 3728 3702 3704 591 5231 1990 1972 1974 1646 5408 2612 2642 2699 4985 4841 5637 4876 1114 1116 219 5072 5101 4785 4225 4752 4753 5415 5352 3660 6003 5114 541 5054 5132 3914 3919 3916 1548 3402 902 2721 2718 3334 5965 1543 3087 4523 5088 4134 806 1338 1340 3967 3966 4244 2053 3992 5602 4005 4003 3944 5355 5358 5363 4249 3807 979 981 4497 2877 1581 2340 2050 908 1926 1584 2872 4266 5369 5453 5449 5421 5423 2098 3930 4102 2942 563 2667 2623 1368 4475 4399 911 2345 1964 5889 4704 4192 4008 2686 4811 2806 2939 3636 681 3639 2946 2948 4713 4831 4830 2644 1857 4103 2529 1908 3385 2799 1740 1861 6023 2943 2941 3033 3049 1311 3074 3077 3030 3028 3962 3108 3123 336 353 2646 4716 3908 2179 3808 2134 1971 1993 4781 5732 5102 922 1570 4031 4084 4036 4082 4039 |
| 152 | 5416 883 5152 2568 5743 1968 2983 3159 4213 5015 2469 3190 2028 515 2432 2739 2741 2018 4146 5137 4751 4953 2987 3255 1704 2044 1245 1192 1773 1292 3528 |
| 153 | 2405 5876 2401 1562 2187 3269 1611 5721 1822 1816 3058 3232 3795 5928 880 3889 2299 5638 721 3362 3121 3699 4832 5124 1690 5173 4966 1819 1810 786 633 509 4205 4092 5880 4436 |
| 154 | 819 4425 5257 4363 642 5501 1511 5785 5942 2716 1841 5443 3600 4353 2428 3445 3444 5473 2410 2184 5526 2013 2918 5569 371 2032 3873 5203 5161 578 |
| 155 | 1721 1093 2228 4171 2514 2318 1917 804 3460 459 2578 341 4880 4511 1090 6021 1868 1824 5028 4480 1013 4255 4612 |
| 156 | 3014 1344 2750 2332 1438 5692 3595 2508 1587 1572 5265 5262 5713 1374 2443 602 2045 2510 5219 4408 4037 2274 2289 3348 3431 1350 680 3247 1226 1663 3469 479 3084 5286 4921 4557 5008 2576 1402 533 361 357 1767 279 5630 5936 5961 1994 3838 3124 359 449 2351 2724 2316 5250 3114 4494 5238 5827 3261 368 2993 3777 2803 5597 4526 876 |
| 157 | 5202 4554 5544 1467 3645 5899 735 4111 3024 1002 4992 3589 3905 3715 5971 4300 3290 1222 3628 |
| 158 | 2474 5667 561 5836 1953 3107 2481 2238 1342 5800 1664 2499 792 5755 2191 1502 1370 |
| 159 | 1494 464 5709 2152 2279 3994 4034 5789 2738 5600 3122 4398 382 4030 1938 2293 4246 3601 853 5636 2582 4316 4313 4310 5446 2426 4367 5694 |
| 160 | 2374 1010 5914 1710 712 2261 5977 4454 2033 4256 4756 770 3703 1200 5588 5082 5524 2996 1574 4380 1939 4668 4602 4348 1556 5940 2065 3932 4351 3156 5024 5738 2146 1191 713 5128 4759 5040 4089 4416 905 3678 1942 3138 3607 2209 962 898 1212 388 2119 2952 5810 2384 2367 3878 |
| 161 | 1680 4990 4400 5120 1549 1008 3563 912 4945 2252 3585 4631 5821 5229 4996 4540 1833 4207 2049 2650 1607 5658 3847 1510 788 1573 1343 4639 590 3078 628 3194 3192 3371 4403 407 3098 3086 5498 577 4501 387 385 383 365 346 343 339 337 4168 4330 4626 |
| 162 | 3724 5809 4846 3166 |
| 163 | 3366 5222 5300 3266 447 3614 632 285 4094 3785 2294 4482 4678 604 3616 5846 4285 767 2624 5056 5632 1776 3868 5285 378 3092 4924 |
| 164 | 1654 2695 3293 4355 2088 1611 1365 1943 4070 1816 1822 2055 5693 317 4606 5124 1690 1810 1819 786 3223 509 4205 4092 5100 2606 349 5880 998 2341 5514 3648 5623 4979 1980 1274 2344 2302 4135 5451 2130 5545 5237 4301 4529 797 3242 4262 |

TABLE 16-continued

| SEQ ID NO: | homolog SEQ ID NOs |
|---|---|
| 165 | 4371 5585 2976 4302 1393 2287 857 1167 3936 4011 5870 1697 1720 4625 5097 1954 2600 852 1211 5206 4892 821 1239 2501 3780 2655 2626 1478 5657 2571 4955 2643 1505 3482 |
| 166 | 5373 1616 5059 4534 2772 5175 2483 5884 3243 4618 2938 2613 2856 3110 3168 2189 1006 5414 2780 1028 4142 4971 2567 4314 4515 1583 1430 1431 514 2193 660 2256 4634 3619 4574 1929 4527 1749 5146 769 2505 3072 1890 3357 5123 2857 1302 1436 5357 848 4889 1560 2218 2889 456 596 5994 2165 3845 3846 4389 1787 4032 1593 414 335 4661 5178 3789 |
| 167 | 5845 1878 567 1423 4601 2722 2391 4729 3634 2698 771 3501 2078 4021 3126 4095 5650 5607 1755 2271 1464 1328 1359 761 2476 4373 2603 3363 1909 5816 2177 4464 3484 1190 3856 1683 3221 2609 1648 886 338 664 381 999 986 3265 5665 |
| 168 | 4044 1836 2399 1517 418 421 469 472 474 4685 4660 4662 3466 684 1289 4655 2982 320 395 3043 3054 4396 3794 1257 1280 2919 4973 4378 1912 5519 2107 737 5662 1845 543 675 1204 4896 2104 2116 2122 2120 1801 1804 4158 4328 5403 4617 1276 5438 1466 5783 5690 3430 404 4289 403 5130 582 3850 2131 3224 5941 |
| 169 | 1277 2372 1925 5947 4545 2136 921 1594 429 620 2947 1251 3038 1709 5556 1435 471 5067 1094 4877 5182 2730 4705 4096 4843 174 1632 |
| 170 | 4908 1888 5020 5021 5036 5405 5913 5522 3125 2634 4681 2182 1620 4516 2355 435 4869 2387 4434 3657 1396 4271 3139 4919 2933 2300 1259 1487 2141 4385 2304 1134 1649 5035 |
| 171 | 5601 2178 1509 1817 2260 512 527 3478 6017 1358 3551 347 1074 1347 2011 4975 3975 |
| 172 | 4150 3450 2563 5837 937 5062 3696 3827 5946 1958 892 3810 5017 651 3925 3321 4621 3369 4326 5401 4009 2058 4356 5306 3822 2455 5551 3416 1421 3414 1418 1415 5770 5766 3411 3393 3392 3320 3312 2715 5756 3387 3288 2746 2744 1417 3316 3289 3388 3361 3358 3390 3350 3295 3355 3353 2749 2748 2713 3446 3447 3452 3510 3480 1434 1433 3598 3593 3542 3509 3483 3473 3453 3423 3544 3502 3591 3513 3548 3587 3424 3582 3504 4166 3449 4176 1585 1568 5535 4771 5496 3679 4208 5716 1258 319 4686 3364 4762 3203 5243 3070 4115 1513 1488 1483 3655 1157 5026 3758 759 |
| 173 | 4447 4541 1214 534 2512 5290 5242 2315 1800 433 3950 5619 3958 4350 2217 5505 4433 2168 3610 1580 1482 334 3673 4724 2743 |
| 174 | 5568 1277 2372 1925 5947 4930 429 620 2947 1251 1709 5556 3038 2311 1435 471 4189 5067 4877 4076 2396 |
| 175 | 5343 4666 1525 1526 2766 4329 1869 2897 1225 1224 2867 2728 2813 2836 2883 2833 2832 2881 2830 2827 2814 2859 2693 2090 2811 1634 1300 1927 1930 2692 2732 1831 4062 4438 4413 4409 4410 1324 1319 1962 3263 4317 4467 3580 5215 3020 2108 5799 915 997 995 1685 291 3088 3036 2997 2994 2991 3019 1446 2210 1579 1474 1428 5729 5773 5706 636 4926 3246 3227 3270 1357 585 540 4845 4818 5604 4887 5629 298 4229 4006 881 5748 5745 6011 4180 4352 5931 5217 4247 3623 3476 6007 5136 5798 5096 4426 3674 2885 2840 2140 2111 4558 6002 2094 3208 290 6008 6005 5986 2448 5293 1273 3474 3496 3498 3497 1501 4345 503 502 3481 1499 1066 2397 2047 2660 2659 311 1853 5167 5168 1565 2673 1029 268 3767 4934 1670 970 5296 5295 4739 5381 5307 5379 5410 4361 1306 4463 1576 1559 4656 4462 822 3769 3701 1629 3924 3918 5339 5733 3637 4598 1318 1916 4594 380 3524 930 2385 2386 2388 3245 3248 3426 3432 2132 519 1883 4564 3913 4595 2253 3708 2591 3915 4728 1249 1254 4732 4735 2037 2012 4725 5742 5354 901 3903 4987 5071 3590 1628 4486 3057 4072 5368 4667 384 5842 891 4590 1711 3111 325 5853 1528 983 5726 1496 1904 1899 3907 837 838 649 5507 4045 2995 1766 2444 4530 3834 4303 5277 |
| 176 | 1586 4775 3515 1476 4682 2688 2109 2291 3164 3890 568 1837 1264 4577 286 3286 1031 1208 3690 4963 4965 5508 5939 1535 560 3090 2040 5159 1285 2056 1486 1092 946 345 1232 1217 |
| 177 | 4555 5998 1792 2093 4556 961 5561 4547 4390 2657 4520 2999 3968 1712 3391 682 2523 5211 882 5105 2206 5877 3526 3791 879 614 3849 5888 4743 6015 3182 |
| 178 | 4044 4599 4596 4123 3805 1284 1836 3185 3191 3187 2399 1517 418 469 474 3181 2666 3466 3946 715 4961 3097 4177 3154 1176 3297 489 1173 4119 4157 1623 4153 1653 4156 1627 3781 1895 1096 4318 3119 4575 3043 1538 3440 3054 370 4991 5005 3681 795 3651 2349 454 2765 3794 4288 1131 5344 646 2977 2759 2736 2817 3349 4638 4948 1804 4158 2547 4617 720 717 5690 4289 701 4290 1726 5317 5316 3169 3149 582 |
| 179 | 4334 1320 2950 3218 1541 627 4235 3260 5826 3239 1105 495 3989 3308 4362 5991 3865 5083 2369 1658 1278 2412 3271 1808 1406 3695 5070 1537 3743 4280 5073 |
| 180 | 1966 2015 2267 5147 4138 5312 1782 5270 1515 5715 3576 5029 4657 1863 890 549 3732 3931 2845 3377 3032 5590 619 2147 1027 579 2325 4460 4860 2328 4077 3155 5391 2086 5047 3298 1979 4311 5164 5162 5190 5165 5193 5187 4702 878 4050 5278 1707 |
| 181 | 5679 5907 2200 3826 5471 3605 4284 4379 4320 985 4148 4357 3866 3196 5675 2231 5090 3400 2371 934 2172 |
| 182 | 743 1279 2456 5589 3183 4450 2648 5298 3471 5860 4492 3830 2669 2870 3543 5350 1270 5444 1261 674 4179 1577 |
| 183 | 1795 1794 5504 3837 1046 2389 5668 3979 4922 3798 4518 4647 501 4768 4782 2222 1275 3500 4607 5542 5549 3180 5843 1744 5660 2917 3514 1780 4769 1656 5454 2197 4098 5595 5527 508 4397 5972 4412 5484 3978 2229 1601 2269 2248 5440 760 375 1770 5417 914 2518 559 |
| 184 | 5993 3521 2513 3291 3017 4699 3222 4505 5944 5541 4972 1470 754 2262 4736 314 1458 5615 1197 344 1122 1591 3406 3824 4188 4491 569 4614 1255 5489 3252 2268 |
| 185 | 5378 3046 1687 4334 2950 4235 627 3417 4143 2326 5826 3239 3260 4197 1424 836 1170 3753 1105 5083 1808 1406 3695 5070 1537 |
| 186 | 4370 2960 3521 3741 1518 4699 5560 1073 1504 4223 314 1458 392 1445 1650 4294 3682 2171 936 4524 |
| 187 | 624 5667 561 5836 1175 831 2212 2499 5755 5402 1502 4169 1169 |
| 188 | 706 753 3969 1086 889 1733 5370 3806 4324 4890 5430 5973 5978 3467 3470 4873 1181 1182 5968 2008 5703 704 5205 2565 4521 2174 4988 1351 3546 1961 597 5474 2804 4913 4916 2462 2463 5374 5475 1297 3165 5371 4658 4419 1719 1532 5515 1025 420 4393 3770 4604 2117 2139 2166 507 574 2926 3241 1172 2022 5646 3373 |
| 189 | 2290 1706 3332 4422 1329 2914 3643 863 4802 1234 4014 5216 3717 2398 3016 4259 5823 5345 4974 1870 5095 |
| 190 | 1180 282 5348 1818 2036 307 352 393 4805 1152 1194 5801 348 1196 5718 1070 1067 1041 4834 4836 1353 1404 4833 5741 4531 4506 1331 1243 1148 1045 1049 5413 424 5879 351 5089 4231 5840 1272 4354 658 1362 4066 4088 4064 4042 4018 4136 4870 4202 4804 4902 4900 4931 4942 4994 4962 4935 4905 5620 4928 5016 5013 4741 4744 4871 4897 4750 4809 4808 4776 4623 4211 4322 4321 4319 4298 431 960 2406 4591 1547 1023 1452 3836 846 2851 3881 1507 3961 5533 1268 1298 4206 4777 4868 4865 4779 4803 4838 4842 4747 4749 4874 4903 4901 4774 5867 5851 1014 2234 1610 2507 1178 1198 844 |
| 191 | 963 3161 2708 4263 5794 372 945 3965 593 4895 3748 1437 2216 5060 1199 |
| 192 | 1193 3937 5922 3970 398 893 3378 5847 492 4954 4087 4636 |
| 193 | 4551 2254 3050 2988 1423 1400 2391 564 3634 4152 1328 1359 761 3564 3557 6018 2854 1739 1308 5199 |
| 194 | 416 417 4815 442 1052 3389 621 4110 5133 5320 4431 444 1983 5688 3116 5009 2866 5653 4325 2916 517 1588 4025 4691 1485 5932 3550 5771 4999 3737 |
| 195 | 2001 1995 1992 4043 3381 6016 3375 1814 3376 3335 3337 2096 2892 1635 2077 580 2170 3306 3574 1797 2980 1405 3137 3130 3299 1856 5186 4863 4761 3742 2672 1267 1360 3823 5829 3172 521 5812 5023 2690 835 5308 2215 5156 3511 4866 4835 379 2538 613 5683 5708 3755 4248 3885 5447 5145 3345 3305 2631 3343 2128 5661 3457 2760 1555 |
| 196 | 4555 3235 1533 3060 3912 2622 2480 3056 4556 4847 961 5561 5432 775 566 4390 5547 3117 2986 4799 1352 667 4956 304 5919 2661 2517 4116 426 2188 2689 4366 4457 1449 5987 2007 2664 1238 614 3849 5888 4743 1873 4498 5905 4162 2679 631 5327 766 |
| 197 | 4619 1614 1668 4958 1643 3771 2742 3947 1398 3731 4694 2611 4695 1875 4199 1495 1791 3583 1082 1937 1567 897 1477 |
| 198 | 4044 4123 4128 4959 3191 3185 5855 421 469 3181 3946 2651 1539 3887 370 4396 2525 386 1257 5532 2919 5213 1934 4973 4381 5344 5764 5958 1145 5252 5493 2104 4587 4638 1801 1804 2246 4158 432 2547 5428 5424 5455 5486 1827 2992 4562 5491 4617 364 5690 3430 3327 5130 3169 3149 582 4807 |
| 199 | 1654 2401 5876 3237 3568 427 1121 4355 4070 5721 1816 1822 1762 5638 826 1408 5693 5104 3121 3699 4424 1564 2411 4566 783 5124 1690 5173 1810 1819 786 2546 3267 3861 576 5004 4205 4092 349 5880 4436 5689 3875 400 2585 3141 |

TABLE 16-continued

| SEQ ID NO: | homolog SEQ ID NOs |
|---|---|
| 200 | 1180 282 1012 3612 5874 1790 307 352 393 4805 1152 1194 5801 348 1196 1070 1067 1041 4834 1353 4833 3972 2181 4687 1016 1015 5085 1148 1049 1045 5413 424 5170 4287 887 2284 5006 1717 5356 2148 4231 1272 4360 2873 4042 4064 4018 4136 4088 4202 4066 4804 4870 4741 4744 4871 4750 4897 4808 4809 4776 4211 4322 4321 4319 4298 573 1730 431 625 4674 4692 4206 4777 4868 4865 4779 4803 4842 4838 4749 4747 4874 4903 4774 4901 5851 5867 1014 1610 2133 1178 1918 2702 |
| 201 | 1098 1060 5786 5523 4091 5297 209 2647 2620 5039 3842 1914 3140 4507 3160 |
| 202 | 2844 3179 5027 4726 2778 4093 5396 4178 2435 2581 2447 2752 5878 2424 1409 4024 5710 2331 1241 4151 1956 1420 3472 4976 3864 2439 616 5579 4500 401 3442 4237 3549 3230 4054 5746 732 5951 4740 4858 1154 3061 4977 1731 |
| 203 | 4789 1795 1794 5924 2482 5225 3572 4495 5648 1419 1844 4139 3418 1380 750 5129 5328 1151 2714 5091 2602 2558 3220 4201 3837 1125 1622 1631 2286 2103 3979 1933 1931 1896 5336 1928 5635 3902 5461 4518 1248 4647 501 4672 3790 1128 2754 2153 5660 2917 1247 752 3730 4821 1682 3109 5985 4010 830 1536 1778 2434 4769 2115 2949 2805 2550 373 1462 2541 2764 4485 3978 5626 2229 1601 2269 2248 389 412 1189 3503 5384 1271 411 3178 789 3922 |
| 204 | 2064 2537 5112 4071 1746 5669 993 1950 5337 4382 2365 2333 1678 3799 4624 5543 5722 5719 2429 2381 5329 1722 1718 1307 5779 862 1332 5144 800 2633 1529 306 4855 2336 2696 1312 1399 707 5116 5768 1138 685 662 5322 3313 5019 694 5720 3983 522 312 3274 2066 2275 2573 463 |
| 205 | 2401 5876 3237 4867 3700 3568 5557 1562 2187 4421 3795 4125 3351 3641 3699 3745 4569 5124 1690 1810 1819 786 2528 1758 3142 4439 509 349 4436 |
| 206 | 861 3389 1052 2373 4608 5063 621 4502 5478 2464 4251 4711 2438 3987 5126 4839 4795 468 5133 5320 3116 5009 1983 4325 2916 5653 1588 4693 517 3277 2129 5909 2944 5771 4999 1485 5055 1799 2060 834 4675 1705 3386 2907 |
| 207 | 1844 1109 1631 5668 5400 5360 2769 5635 3463 5195 5626 5440 2488 2521 1644 5087 5323 |
| 208 | 5204 1132 5728 1500 1924 1638 399 645 1265 5731 3876 3397 3204 1982 1826 |
| 209 | 1098 1060 5786 5523 1914 4091 5297 201 1326 2620 5039 3842 4507 |
| 210 | 1489 843 958 2339 5714 3468 5380 4813 5881 3599 2676 1508 4375 2777 5258 1702 758 1349 1847 5948 3257 2314 4386 2599 558 4757 1323 545 |
| 211 | 4555 4307 5534 1387 4556 5561 5432 5774 4390 1874 1195 623 2317 2999 859 1737 1582 4279 928 2477 817 2149 3776 2740 2307 4209 535 460 3340 5539 4200 4780 2761 1840 1141 2945 2378 2890 2998 3849 824 |
| 212 | 1985 3595 989 5125 1374 1797 2484 2789 4037 2289 2274 3348 394 4391 1640 3228 1951 1026 5936 3838 3151 3860 1450 2316 1348 4344 1765 3683 1266 4048 1102 2993 2803 3777 876 2361 |
| 213 | 4789 1795 1794 5924 4495 4139 5648 1419 2482 728 1125 1622 1631 2286 3979 5336 1931 1928 1933 1896 2769 5635 5461 4518 3980 629 5804 4567 2801 951 3730 752 1247 2920 2912 3109 5985 830 1536 1778 2434 4769 2115 2949 4722 3649 2545 2420 2770 2124 4019 2616 2350 1613 3978 2229 1601 2269 2248 2570 1271 411 789 |
| 214 | 3417 4947 |
| 215 | 2405 1562 2187 2695 656 2734 2839 3232 2055 2052 2266 2588 5584 3121 3699 509 4205 4092 349 598 2221 |
| 216 | 3951 1562 2784 4355 1822 1816 3494 2055 5226 5230 3408 1408 3699 3505 3307 5124 1690 1975 3558 1819 1810 1789 5880 |
| 217 | 3888 920 5833 3892 3894 5834 923 5850 5299 948 5856 5301 950 5873 5321 969 5324 973 5908 5325 5910 5346 5347 988 5915 1003 5351 5934 5375 1004 5670 5924 3870 919 5831 3843 3220 4201 3837 1125 1626 3979 4049 1931 1896 2769 3143 1935 4920 4327 870 4518 5131 3676 4647 501 4532 6000 3176 1454 5660 2917 752 1247 3730 4737 2243 1522 4659 2470 1536 2434 2115 2949 5744 1315 3309 1339 4576 5155 4184 2370 3978 2229 1601 2269 2248 1271 3178 789 3867 903 3152 1520 3259 |
| 218 | 2967 1403 5318 4078 5871 3622 5561 2899 965 2276 4358 5656 1383 1051 2810 2661 2014 4395 2589 2689 391 1228 4149 4186 614 3849 |
| 219 | 2968 4423 3942 3943 5233 4236 4254 2595 4161 1426 1427 5663 3680 2771 3935 2027 2026 5513 5138 3009 5469 5832 5271 3963 3964 5078 5079 3707 2002 5192 3940 3921 3687 305 2329 5540 2878 5724 5235 3556 1633 3784 4113 1017 2024 2057 2000 1997 2923 3489 3490 5198 2186 4613 5887 2020 2051 2021 452 4938 5747 1598 5777 4332 4118 803 5139 1941 1945 3128 2596 2614 932 910 929 3105 3101 3080 5069 3010 3815 4264 546 5795 5153 5135 5701 1317 2936 2924 5254 5251 3672 4241 4640 1570 151 3955 922 5102 4035 4082 4031 4036 4084 4039 4059 2358 3419 2712 5652 1952 1774 2735 3728 3702 3704 591 5231 1990 1972 1974 1646 5408 5376 2642 2699 2612 4985 1116 1114 738 4225 4752 3660 6003 5114 3055 5132 5054 3914 3919 3916 1548 902 2721 3334 2718 5864 5088 4134 2121 806 1338 4244 2053 3992 5602 3944 4249 3807 979 981 982 4497 2877 2340 1926 2050 908 1581 1584 2872 3998 2282 4181 4266 2098 2345 1964 2686 5889 4704 4008 4192 5830 3193 1305 1361 1042 5442 4811 2806 2939 3639 2946 5064 4713 5929 4451 5956 5933 2644 1857 3783 3803 3786 3788 4103 2414 2529 3385 2799 2943 2941 3033 3049 1311 3074 3077 3030 3028 3962 3108 3123 3102 3103 353 336 2646 4716 3908 3808 2134 1971 609 611 2747 3840 1993 5196 1530 4781 5732 5101 |
| 220 | 4596 4599 724 699 3898 731 3181 2520 4414 4417 4441 4440 668 696 689 1805 4664 3234 3031 3346 438 2955 3554 2700 2535 925 4124 1662 4127 4129 1659 1655 3043 1542 693 3887 386 1969 2542 5364 441 1024 718 3596 3910 3225 5366 5080 4553 4510 5918 4427 2322 895 3809 4376 2496 5651 653 672 5696 2630 3189 665 366 4484 1750 5448 4800 410 2491 4638 4943 4944 1804 2757 1988 3719 3775 799 5938 2335 330 4615 1864 594 1832 4772 3877 2639 2515 1314 1283 4286 4493 4144 3425 4689 1076 4578 2862 700 4642 280 1469 5783 5687 5817 716 698 726 719 4218 1786 423 2758 2423 5566 1807 1619 |
| 221 | 1948 2237 2487 5068 3207 4549 1018 2430 4461 4584 5598 3276 5166 1072 5111 5127 5697 4745 1769 4898 634 1558 2922 2240 1811 477 1091 4435 3559 2265 1050 943 3211 2392 1048 2383 2971 3333 2207 2619 3883 4306 3981 2802 5188 5792 5896 5180 4274 4270 1397 814 3686 3948 1523 2005 413 5772 1734 5749 1906 1973 1889 4499 1866 3620 2241 3911 2258 5627 1498 358 3492 3762 1171 5433 5419 5621 3760 1681 3367 991 |
| 222 | 1330 4043 297 2653 5081 4629 5479 1438 1590 1589 2590 520 4120 1686 3858 2656 3407 2310 3409 1107 2577 1903 2652 802 1174 4283 2838 4742 4190 5900 1095 4173 2733 2403 5236 811 1201 4079 5084 2323 2888 491 2337 1065 2731 818 5185 289 1001 809 5686 4797 531 2473 3722 3720 5333 606 5769 3615 2800 3212 5570 5758 4257 1645 6009 1453 6012 6013 5163 5528 5592 4745 2039 3200 5828 288 1724 3518 2849 2869 3485 3456 5176 2150 3404 5886 5536 2684 4611 5426 847 669 2144 3339 1102 927 3777 4654 3303 2852 3264 3630 |
| 223 | 4044 4599 4596 1118 4927 3191 3187 3185 421 469 474 3181 2668 1984 4163 395 4258 4156 3043 686 370 386 1257 5781 2059 2519 1934 5213 4997 2496 3945 5344 4719 3379 2180 3001 1647 5516 5435 5493 5448 1835 3349 2759 2736 2817 4638 5642 1801 1804 3854 436 2808 2246 4158 2547 5428 5424 5455 5486 2169 4384 3352 2296 4075 3213 5491 4617 4281 4573 4277 4117 4875 3403 5273 1390 1127 2143 3254 3812 5633 2213 3045 1571 3662 1812 2816 4720 5673 3063 4816 4879 2506 5704 4183 5783 690 1295 5690 3327 3430 833 992 1726 4807 3066 3025 1020 3048 3923 |
| 224 | 3068 1379 2590 3405 745 2292 2818 3258 2928 957 956 5634 238 340 4140 3986 3144 4899 4198 1321 2081 918 2347 536 900 2594 5643 4909 1728 1679 1860 1209 1944 683 3084 3042 1981 1978 2004 5260 570 2409 3486 3714 1413 4610 5340 1999 505 3412 1346 3151 5148 1783 2415 5739 3879 3718 1796 4703 1701 3008 3537 4080 5862 1133 2123 4041 1855 542 3697 |
| 225 | 1164 1166 3451 2194 3300 2694 2554 422 5912 4444 3394 5044 4673 2911 2360 1019 2790 4023 5680 3817 3752 2860 4981 1385 2717 5303 4368 5970 4216 5409 4442 1684 376 1337 3744 362 1081 363 947 791 1237 1497 |
| 226 | 5699 2102 2835 1407 679 3506 5587 589 3186 5723 3002 2781 643 1213 1461 4561 3197 396 3095 4548 2303 2812 537 1099 4765 2106 4282 3249 2062 2574 1367 5902 3059 793 1150 5482 926 4337 6020 |
| 227 | 1654 2404 2402 1562 2295 5031 5177 3106 1611 1414 1822 1816 842 5104 3746 3721 3047 3699 1690 1819 1810 688 714 692 349 5880 4436 301 1185 |
| 228 | 624 4536 5667 561 5836 1605 1175 1953 831 3839 3107 2219 610 5894 581 2167 1946 5824 666 3018 3301 2214 2499 530 4910 1244 2675 2380 5429 3820 1288 630 3173 2309 3201 5240 1674 2255 3787 3792 3285 4826 779 1735 4056 2569 2601 2587 1531 1316 4428 2091 2319 3231 2285 1502 3712 2707 397 2564 5578 5735 |

TABLE 16-continued

| SEQ ID NO: | homolog SEQ ID NOs |
|---|---|
| 229 | 1948 2237 2487 5068 3207 4549 1018 2430 4584 4461 5166 3276 5598 1072 5111 5127 5697 747 1886 4420 1369 4898 634 1558 1618 2922 3578 477 2240 1811 1091 4435 3559 2265 1050 943 3211 1048 2392 2383 4000 2971 3333 2207 2619 3883 4306 2802 3981 5188 5792 5896 5180 4274 4270 3499 1599 3948 5943 1523 5700 3384 1389 406 1898 5749 1906 1889 1973 4499 1866 4411 5897 984 5707 865 4265 4028 5608 2258 5627 1498 358 3492 3762 1171 5419 5433 4490 5621 3760 1681 3367 3199 991 5691 |
| 230 | 1654 1562 2695 2880 655 4394 1611 5197 5721 1822 1816 2069 3853 1296 2458 4683 3699 1159 5124 1690 4210 1819 1810 786 2084 1378 4205 4092 688 714 692 349 5880 |
| 231 | 5343 1525 1526 2766 4432 5952 3051 1603 808 1831 4465 2072 4062 5011 2843 3725 1688 2876 3640 5404 3294 5367 1345 3314 5436 3208 1479 1480 839 5465 2932 3982 3292 3310 3317 2448 2446 670 3498 2930 1472 350 1468 4342 303 4936 4643 3523 5835 2453 5168 5167 5295 4739 5388 746 4253 1364 3209 755 5341 2298 3793 930 2386 2388 3432 1913 1911 5822 587 618 5841 677 710 4732 5825 4735 4725 5338 3035 832 1384 5885 2618 513 2264 3669 1621 2842 1624 4637 777 1528 994 1033 2418 1692 983 2610 976 1465 1554 840 649 5507 5037 3545 4864 |
| 232 | 1411 2629 4051 5110 2437 2843 5160 5759 3410 2662 2875 2617 2687 3638 437 2017 2579 2533 2954 443 466 467 462 1699 4160 313 4017 486 470 369 4708 5953 4957 5586 2281 4164 1592 |
| 233 | 764 3328 3330 1053 1075 2723 2725 1030 1088 2680 5450 5452 5818 5791 5494 5470 5497 5227 4850 4844 4848 2683 3427 1104 2682 2061 1038 3322 3325 4401 488 5282 5362 5359 5365 5274 3779 3713 3663 3569 3635 3661 3560 3633 3666 3565 661 4338 2527 2782 1035 2751 2755 2753 3368 2638 3372 1084 3374 3395 5288 5287 5289 4717 5802 3428 5805 5790 5788 5310 5311 5313 5949 5891 5901 5920 5959 5923 5974 5926 5980 5925 3650 3654 5210 4814 4817 4822 4820 5503 5517 5520 5500 5499 5518 5521 5332 5334 5335 5393 5389 5269 5309 5305 5426 5422 5462 5466 5458 5490 5485 5492 2703 2706 2524 3464 3527 2756 1036 4881 4878 4854 4851 592 4155 3778 3709 3764 2270 4508 4721 4718 5459 5467 5464 4917 4914 5468 4911 529 553 2592 2348 1448 2198 2956 1463 2957 2979 1444 652 4925 1894 4233 1825 5418 5420 5561 4336 5566 3461 5283 4763 4755 4758 4888 4884 4886 3547 2727 3640 3692 5041 4487 3608 4620 3304 4131 3044 4052 3534 3667 3611 3688 3609 4794 4792 4791 4796 4812 4767 4787 5765 4026 3434 4230 4786 4783 4232 4960 2636 1054 2516 3459 3493 3462 4333 955 5034 924 2417 711 885 884 2442 3495 1871 1854 487 506 5563 5593 5582 5510 5538 2959 1077 1106 2436 2422 3491 2472 5053 5750 949 953 3530 3535 5174 2701 5950 5895 5476 5480 1442 1447 3691 3694 3629 3631 3331 1058 2779 2580 2584 1034 2719 3454 1111 2720 3613 3734 3757 3632 3759 3665 4215 4588 4616 4929 4980 4933 2894 2895 5904 5957 4828 5927 5982 3804 3671 867 3062 730 |
| 234 | 2552 2110 3754 2029 5207 3021 1130 3000 2063 1471 2598 3819 |
| 235 | 5202 1642 2809 1617 4111 3024 1002 3715 5955 3589 5971 1575 4300 3290 1893 3628 4308 2162 1222 3761 |
| 236 | 2402 2466 3951 3064 1757 4355 1414 1365 4070 1822 1816 3995 5865 3699 3262 1690 1975 1810 1819 2910 539 866 3882 |
| 237 | 3937 5922 1193 3378 2697 4085 2953 5407 |
| 238 | 3068 1379 2332 745 2292 2818 3258 5265 1374 1209 1944 683 224 2927 2003 1473 430 394 5286 3042 1981 1978 2004 5260 570 2409 3486 3714 2407 1413 4610 5340 5148 1783 2415 5739 3879 3718 4703 1796 1701 3008 2549 1133 5862 4080 2123 3537 4041 1855 542 3697 796 4407 |
| 239 | 819 5267 2716 3929 615 1920 5618 3555 2428 3445 3444 5330 5967 4793 3685 4937 3928 3359 1602 1775 |
| 240 | 1654 4696 1322 5737 1216 1987 2695 3106 655 4394 2792 1334 3153 5294 5107 1769 2368 5386 708 3991 2763 637 5506 5721 1822 1816 5445 2305 5705 2458 4683 3118 3853 1296 2266 3774 939 2099 2097 3699 3716 2413 3993 3065 328 781 2394 5124 1690 2364 584 4040 2379 5778 5564 1819 1810 786 509 688 714 692 349 5880 |
| 241 | 5681 3973 2791 4701 2239 4033 1412 5740 3592 1963 1253 2031 1960 1299 2677 1695 3477 3081 4194 4754 2902 3727 1661 4669 5030 3969 1798 4560 1615 2075 1456 1236 5434 3205 2126 294 1742 4939 5751 5154 296 2793 3553 888 5793 499 2509 638 2898 3863 5276 2242 2544 2572 4746 1809 3796 5575 4222 4593 4932 5412 5149 2125 5264 3433 4446 3594 996 829 |
| 242 | 5416 2359 5038 4784 5152 2568 498 2441 1246 1192 1773 4074 1292 3562 2356 2465 2586 |
| 243 | 4406 4254 4236 1426 1427 3680 4989 2771 2829 5138 3009 5832 5271 5078 5079 5192 3940 3921 3687 305 3278 3275 2329 5540 2878 5724 1839 3556 3784 4113 3884 1997 5736 5666 1781 1779 2923 2821 3489 3490 4613 2186 5275 5887 3488 4388 805 803 5139 3739 1941 1945 3128 3133 3129 910 929 3105 3101 3080 3010 3013 3026 3012 1301 4264 546 5795 5153 1327 1317 2936 2924 4640 1563 2735 1990 1972 1974 5376 4876 4872 738 4261 4225 4752 5142 4243 5114 3055 5054 5132 3919 3914 3916 1548 3402 3076 902 5893 2985 5864 1543 2121 4244 2053 3992 3944 3710 4249 3807 979 981 982 2877 4497 1581 2340 1926 2050 908 1584 3998 2282 2872 4181 1546 4266 5369 2098 2345 1964 2686 5442 2320 4811 2806 2939 871 3859 2948 2946 5064 4713 5929 4451 5956 4831 4830 2644 293 3783 3803 3786 3788 4103 2414 2529 1908 2799 1976 2943 2941 4193 3033 3049 1311 3074 3077 3030 3028 3108 3123 3102 3103 2646 4716 2134 1971 609 2747 611 3840 1993 5196 1530 4781 4245 5732 5158 |
| 244 | 4044 4513 308 3533 2607 974 1836 1071 1069 418 421 3996 2786 3083 3684 5875 4441 4440 4417 4414 2583 2540 2273 3236 3747 5609 3750 2338 4512 316 1662 4124 4129 2651 1542 3887 5685 5684 1257 1443 3735 2635 1665 4452 640 5477 860 2966 2451 5628 896 2762 5171 5654 1715 4504 3475 2427 3132 5263 4097 3939 2975 5546 4369 4234 5213 1934 4372 653 672 1131 3167 2503 2475 2445 3005 5553 1777 5672 3206 1609 3652 4145 5976 1691 4677 6014 2951 3091 4081 3145 3756 1260 3448 2257 4800 1227 1229 1231 4943 4944 3854 436 2868 2808 2246 432 4331 5457 5861 782 784 5113 2815 1919 785 938 511 1120 1524 5022 2016 2335 3985 4027 4459 5806 3399 3283 2874 757 3706 5687 3430 3327 3053 3874 2366 582 5817 5782 |
| 245 | 697 5617 4680 4007 671 942 4312 3383 954 1220 1219 5232 4978 2105 687 2137 1806 3067 3318 3347 695 2400 2421 2705 1240 1242 4645 4650 3997 1235 5212 2118 5531 4185 5001 3957 5046 5048 1768 |
| 246 | 4304 2904 917 1059 2089 5647 318 874 736 855 3356 858 3595 2151 3150 5061 494 2310 3990 3988 1371 300 1374 1797 5169 3977 1210 1998 2390 5562 5558 4086 415 3740 3577 3617 4387 2789 1142 2289 2274 3348 3084 2937 2825 3507 5286 4391 2278 2280 571 331 1381 1022 3722 2473 1793 1772 1703 2145 3833 5935 5118 4949 3838 2961 3151 5674 5189 5567 3625 4473 3099 4458 972 3800 4509 1011 3069 1187 622 673 1102 2548 368 2993 2901 2852 2863 4526 3264 2230 2010 |
| 247 | 2359 5038 4644 1759 5989 644 3904 3906 648 3956 1484 3159 1834 5076 81 4542 565 5007 2459 2101 2425 4305 5049 5150 3573 5015 703 4635 3329 5734 5937 2989 5537 4546 1192 1773 4074 3562 5645 1788 2861 |
| 248 | 2450 409 5292 3436 1514 3766 3765 913 617 5279 1184 2244 4773 1491 4219 1970 3659 5385 4347 5411 326 5086 |
| 249 | 722 2797 484 3115 4998 1669 1392 869 5103 3437 650 4748 5092 5815 2067 907 5194 600 5962 5253 815 1512 691 2095 1553 1557 1550 1552 4296 4099 4343 4217 2511 2796 4550 4191 1936 3797 327 2259 1506 4528 3782 4061 5314 2183 4292 5157 823 5571 4469 603 2921 2969 321 1416 |
| 250 | 324 4801 2498 1000 457 987 3532 780 5616 3540 1894 3642 1481 1429 4970 5820 4952 899 3136 5762 5439 4946 4405 5509 552 3512 4837 3862 2393 875 3268 663 2671 2233 1676 1179 |
| 251 | 2353 5695 1795 1794 5504 3843 3220 3837 1335 1723 1046 1933 2769 4922 1290 4340 3798 4518 4647 501 2440 4628 4782 4738 4768 2222 5141 4912 4563 4607 3500 5542 2605 453 2773 1744 5549 3180 3974 4570 5843 2377 5660 2917 3729 4648 3514 3109 1534 4769 2115 2949 1636 798 3041 1656 4707 4098 2974 2197 5454 4840 5595 1743 4700 1666 3174 3536 4412 284 2965 2847 5058 5954 5972 1064 508 5596 2468 5484 2205 4397 3978 5626 2229 1601 1269 2248 5384 5440 |
| 252 | 1727 1725 2767 3365 4273 1103 3421 4764 5964 3273 3341 3338 3949 4586 3089 1101 5094 5892 355 2460 451 2085 2560 2556 3401 3396 1309 1880 2887 3003 3857 1207 5906 5872 5248 2408 2562 4585 3113 3210 2711 1660 2785 425 5599 4187 333 4479 1140 1143 1126 3624 1519 2485 4038 964 3829 2247 |
| 253 | 5244 5284 5184 4859 2375 4221 2154 556 4067 4449 3146 2357 990 4923 3429 5460 2553 5249 2156 5606 2674 3147 1333 5730 5990 4481 1785 5247 5268 2906 2828 2637 5397 1828 5191 3134 3668 2449 2164 5966 5611 2079 2263 1063 2490 1188 1282 2362 741 3251 2250 1802 1223 |
| 254 | 1948 2237 2487 5068 3207 4549 1018 2430 4584 4461 5166 5598 3276 1072 5111 5127 5697 747 4898 1369 634 1558 2922 2240 1811 477 1091 4435 3559 2265 1050 943 3211 1048 2392 2971 3333 2619 3883 4306 2802 3981 5188 5792 5896 5180 4274 4270 |

TABLE 16-continued

| SEQ ID NO: | homolog SEQ ID NOs |
|---|---|
| | 5394 814 3686 3948 2272 1523 5700 588 309 2597 2841 413 1734 5749 2909 4228 2905 2908 2903 2891 1889 1973 1455 2940 4499 1866 5898 4001 5707 5580 2142 2882 5488 5678 2258 5627 1498 358 3492 2236 3762 1171 5433 5419 5621 3760 1681 3367 991 4339 |
| 255 | 4044 4513 5002 967 418 3181 4392 3554 2955 2700 2535 316 370 386 1257 2185 1032 1667 1376 2536 2322 2900 5651 5342 2608 5319 4800 410 1804 432 1153 2335 3158 4852 5783 833 992 4503 5817 |
| 256 | 2353 5695 1795 1794 5504 5045 774 3979 5400 5360 2769 4922 475 4299 1375 3798 4518 4647 501 2555 1732 1852 5660 2917 3729 4648 3514 3516 3522 3487 3519 3581 2434 4769 5221 916 5315 5143 5000 490 5605 5134 5302 4885 2176 5201 448 4114 2245 2201 2083 3978 2229 1601 2269 2248 5384 1271 411 3178 5440 977 1230 3773 |
| 257 | 2466 1843 1846 4582 1562 4137 4141 4133 4108 3552 1756 4377 1822 1816 5065 2055 2964 864 2627 2794 842 317 3699 2030 3603 1921 5124 1690 812 1819 1810 786 440 3171 4539 2823 1887 509 5100 2606 688 714 692 349 5880 4436 |
| 258 | 819 5267 5093 4671 4474 2454 2710 2100 1897 3602 5942 2716 3897 1336 5997 4940 3929 5849 2925 2157 1955 5214 2428 3444 3445 3841 5241 3071 2249 2013 5330 1168 1741 5760 5406 5911 4633 |
| 259 | 1608 2783 1763 5218 1135 790 483 4630 4544 3163 1136 2834 3723 1457 5610 2114 1693 3465 5677 851 4132 2972 1139 4583 739 2009 4710 2288 4204 2795 2575 1490 1440 3202 1820 |
| 260 | 4044 1836 1517 469 472 4685 4660 1965 395 3794 850 2334 4383 3952 4470 4581 1356 445 2919 4973 4378 1131 5342 4632 841 2308 5502 4374 3027 2775 5398 5493 4587 2246 4158 5428 5424 5486 3738 2871 3326 1388 1186 4617 4665 2173 1977 3520 5383 740 944 5256 3999 5377 2893 3670 5050 635 2452 5361 1124 404 3850 1729 5353 2467 510 4730 2006 |
| 261 | 1654 2402 2404 2041 5228 3420 763 2695 3413 4603 655 4394 1611 1414 657 2615 3893 816 1527 4641 3162 4477 5712 3618 1080 1146 3802 1822 1816 5065 2055 842 1408 317 5584 3699 5124 1690 1819 1810 509 4205 4092 349 5880 3818 4853 2461 5441 3933 3821 |
| 262 | 1708 3917 500 4609 1947 2663 1047 4297 4121 1377 5581 4788 5495 1672 2519 1432 5702 5869 1215 2346 3226 4964 2277 287 3315 5682 3279 3256 482 4073 354 3034 5033 5814 3705 952 1905 4496 2226 |
| 263 | 1747 1745 3398 2767 3365 4273 3896 3341 3338 4589 3089 5094 5892 356 355 2457 451 1341 1877 4239 1044 5390 3079 1097 4806 3075 810 1422 3844 5246 4083 4187 1143 1140 3656 1519 5245 |
| 264 | 3886 3014 1021 3644 2625 461 729 4941 2332 3595 2486 494 5265 302 1374 1797 3348 3084 4391 975 1910 6022 505 3151 3693 2685 4309 2155 622 1102 2548 368 5858 2993 2803 3777 2852 4526 876 3264 3280 1112 5664 |
| 265 | 5789 1262 5043 4489 3122 4398 382 4030 1938 1714 4552 1055 496 2038 4246 1294 1566 1459 458 1652 2082 2776 4519 2023 2649 2283 5796 4293 5140 4313 4310 3901 4068 3311 4688 1612 4100 1293 820 1996 845 3195 2135 4466 3814 5996 4810 3244 |
| 266 | 4046 4476 5754 1751 959 1475 3927 2035 2665 532 2678 3029 4883 465 5979 5725 2504 2382 4891 1149 1606 1410 3588 3976 4572 3006 3435 1492 5622 1355 2788 1630 709 3934 4252 2220 538 1123 5613 2192 807 3646 4684 1252 4224 5644 5057 4543 605 575 3971 1959 4016 4723 4862 5437 3872 5463 3037 5761 4995 4646 3272 518 4472 1269 5780 1441 5945 1677 4798 4825 5200 849 1892 6019 595 1256 813 734 5753 497 2431 |
| 267 | 1394 3886 6016 3375 1814 3376 3335 3438 504 2865 4535 2048 4349 485 971 3571 3677 3253 478 4443 4437 5075 4715 3287 6010 4629 2096 1635 2892 3023 5125 3567 3570 3574 1167 5172 3959 295 4714 4712 4709 787 4227 854 3137 3130 5866 1991 493 5084 5676 2363 5808 872 3004 5787 5807 835 4969 4967 3284 1401 2495 4203 3131 5156 1545 5176 4212 2376 4882 2973 2161 1597 6006 5106 2416 4226 4533 555 1639 4170 3339 5145 3345 927 1451 2993 5181 3303 3343 2128 3217 894 |
| 268 | 5343 2766 4329 1869 3051 2897 1225 1224 2836 2833 2867 2813 2832 2728 2883 2693 2090 2811 1603 1634 808 1300 1930 1927 2692 2732 2681 1831 4465 2072 4062 4438 4413 4410 4409 1324 1319 1962 5215 2108 1688 915 5799 3040 3314 5404 3294 5367 5436 1345 3208 3292 3310 3982 3317 2448 5293 670 1273 3498 2930 1472 1501 4345 1468 3481 1499 5698 2397 2047 2660 2659 1853 5167 5168 5296 5295 4739 2831 4600 776 778 825 3768 4295 4733 4291 822 3769 3701 1738 702 1748 4951 4597 2034 |
| | 3880 3899 5988 3240 2709 5280 2068 4471 725 723 4364 4861 4829 4823 4824 1218 4727 3984 1203 1287 3924 755 3918 5733 3637 2298 1318 1916 930 2297 519 1883 1885 1884 5822 587 4564 3913 4595 2591 3708 2253 5841 677 710 3915 4728 4732 5825 4735 2037 2012 4725 5071 1711 4590 3590 5842 384 5368 4486 325 4072 5853 1033 1692 2610 976 1465 1554 1496 1904 1899 3907 768 837 838 970 1670 3767 |
| 269 | 4242 4060 4063 4012 4015 4002 4057 439 5425 1604 3233 2419 5784 |
| 270 | 3014 2332 1438 2590 3405 2127 5639 2310 5262 3871 302 1374 1797 5839 1503 2395 2471 4175 3647 3900 4986 5115 4323 3909 2886 4037 2289 2274 3586 5930 5281 533 361 357 1026 2473 1767 2113 279 5630 5936 1989 5117 3838 3124 3151 359 449 2343 4907 2316 5555 5554 5552 5573 1625 5550 5548 5529 2896 5261 4778 3664 4478 5109 733 4906 2479 3772 772 3626 607 5655 4605 4592 1540 4130 941 3529 4004 622 2539 2993 876 315 |
| 271 | 2850 4029 5797 5717 1761 434 1922 5077 4565 5577 4359 5151 4819 1967 4653 3015 1439 4537 3238 678 4272 5223 5671 5844 4090 1007 5624 3157 5003 2853 1005 4053 428 3216 978 2534 5372 966 3415 2768 935 5179 3749 3198 1206 4918 4468 1736 2543 3797 1641 4571 4663 446 5511 4196 310 5481 748 329 4827 524 |
| 272 | 1948 2237 3052 2561 4697 5960 2487 5068 3207 4549 1018 2430 4584 4461 5598 3276 5166 1072 5111 5127 5697 747 1369 634 4898 1558 2922 2240 477 1811 1091 4435 3559 2265 1050 943 3211 1048 2392 2383 2971 3333 2207 2619 3883 4306 2802 3981 5896 5188 5792 5180 4274 4270 5583 814 3948 4275 1523 5700 588 940 1906 5530 1889 1973 5272 4047 4147 3022 5042 3177 4499 1866 5898 3911 5707 4346 3184 968 5752 2258 5627 1498 358 3492 419 3762 1171 5433 5621 3760 1681 3367 991 |
| 273 | 1163 2076 1830 1303 4069 544 562 4165 4167 4174 2963 1304 5852 5848 5854 4109 4448 3733 3579 3584 828 4429 4430 5631 1784 4483 2330 3073 1205 481 2301 2915 5859 3148 1460 4538 4580 3127 3938 4770 1354 1382 281 283 5921 1161 1160 5603 1162 601 4104 4105 3811 4649 4651 4106 1544 5916 933 599 473 1637 3112 3621 2312 3039 1915 5487 5066 5776 2737 612 1366 904 794 5868 3606 5565 |
| 274 | 3538 5649 2228 2704 3658 459 3828 727 5028 2087 |
| 275 | 3886 4043 3014 3644 2625 4941 1021 461 729 1438 2590 3405 4525 360 3595 2486 2310 302 1797 5169 5483 2289 2274 3348 1901 3344 3084 3586 4629 3926 2604 762 5591 342 3722 2473 975 1999 3151 3282 3848 2819 4984 3302 3219 1867 1102 368 3777 2852 2863 876 3264 |
| 276 | 1043 1753 5074 408 2632 2112 4101 5032 5640 2502 3007 3380 4968 1009 5983 5963 4522 2551 557 2043 4579 4365 5224 3960 1372 5863 2864 1891 3597 5259 5234 6001 3319 5239 2822 2670 4341 3920 2352 2354 4445 2478 2934 742 1516 827 1671 1117 1842 5291 5883 3458 5711 5659 2931 4013 |
| 277 | 4766 1313 3531 980 2159 2935 906 4416 1068 3895 2559 |
| 278 | 4983 639 5014 5431 2860 3082 3324 1578 4195 2196 4856 2717 3229 3455 2726 3726 376 4514 528 1337 362 3744 363 1081 2913 877 1764 3360 1803 3525 856 1310 1237 1233 744 |

Example 3. Consensus Sequence Build

ClustalW program is selected for multiple sequence alignments of an amino acid sequence of SEQ ID NO: 140 and its homologs, through SEQ ID NO: 278 and its homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of 1 were chosen for multiple sequence alignment. The consensus sequence of SEQ ID NO: 237 and its 9 homologs were derived according to the procedure described above and is displayed in FIGS.

4(a) and 4(b). FIG. 4(b) is a continuation of FIG. 4(a). SEQ ID NO: 6033 is the consensus sequence built.

Example 4. Pfam Module Annotation

This example illustrates the identification of domain and domain module by Pfam analysis.

The amino acid sequence of the expressed proteins that were shown to be associated with an enhanced trait were analyzed for Pfam protein family against the current Pfam collection of multiple sequence alignments and hidden Markov models using the HMMER software in the appended computer listing. The Pfam domain modules and individual protein domain for the proteins of SEQ ID NO: 140 through 278 are shown in Table 17 and Table 18 respectively. The Hidden Markov model databases for the identified patent families are also in the appended computer listing allowing identification of other homologous proteins and their corresponding DNA to enable the full breadth of the invention for a person of ordinary skill in the art. Certain proteins are identified by a single Pfam domain and others by multiple Pfam domains. For instance, the protein with amino acids of SEQ ID NO: 180 is characterized by two Pfam domains, e.g. "Homeobox" and "HALZ". See also the protein with amino acids of SEQ ID NO: 248 which is characterized by two copies of the Pfam domain "Ank". In Table 18 "score" is the gathering score for the Hidden Markov Model of the domain which exceeds the gathering cutoff reported in Table 19.

TABLE 17

| PEP Seq ID No. | Construct ID | Pfam module | Position |
|---|---|---|---|
| 217 | CGPG3875.pep | WRKY::WRKY | 204-262::343-402 |
| 169 | CGPG2811.pep | AP2 | 206-257 |
| 252 | CGPG7367.pep | AUX_IAA | 66-359 |
| 207 | CGPG3825.pep | WRKY | 102-164 |
| 213 | CGPG3858.pep | WRKY | 146-205 |
| 192 | CGPG3451.pep | HLH | 43-95 |
| 176 | CGPG2985.pcp | Myb_DNA-binding::Linker_histone | 5-57::123-189 |
| 259 | CGPG7655.pcp | zf-B_box::zf-B_box | 1-47::53-100 |
| 181 | CGPG3287.pep | Ank::Ank::Auk::Chromo | 127-158::159-191::193-225::320-368 |
| 236 | CGPG4612.pep | NAM | 6-141 |
| 185 | CGPG3309.pep | zf-C2H2 | 68-90 |
| 171 | CGPG2935.pep | Myb_DNA-binding | 30-75 |
| 186 | CGPG3312.pep | bZIP_1 | 146-209 |
| 250 | CGPG690.pep | PHD | 196-246 |
| 245 | CGPG5324.pep | Linker_histone::AT_hook::AT_hook::AT_hook::AT_hook | 11-78::84-96::106-118::132-144::156-168 |
| 159 | CGPG2699.pep | B3::Auxin_resp | 176-281::302-384 |
| 150 | CGPG2594.pep | HLH | 277-327 |
| 253 | CGPG7369.pep | zf-Dof | 38-100 |
| 258 | CGPG7641.pep | AT_hook::DUF296 | 70-82::142-262 |
| 239 | CGPG5130.pep | AT_hook::AT_hook::DUF296 | 105-117::147-159::177-296 |
| 164 | CGPG2757.pep | NAM | 3-139 |
| 182 | CGPG3289.pep | GATA | 43-78 |
| 205 | CGPG3813.pep | NAM | 16-145 |
| 218 | CGPG3879.pep | Myb_DNA-binding | 235-286 |
| 269 | CGPG7840.pep | zf-B_box::CCT | 1-47::367-411 |
| 232 | CGPG4525.pep | POX::Homeobox | 261-385::426-484 |
| 265 | CGPG7748.pep | B3::Auxin_resp::AUX_IAA | 141-246::268-350::640-805 |
| 220 | CGPG3987.pep | Myb_DNA-binding::Myb_DNA-binding | 13-59::65-110 |
| 255 | CGPG7374.pep | Myb_DNA-binding::Myb_DNA-binding | 38-84::90-135 |
| 214 | CGPG3865.pep | zf-C2H2 | 67-89 |
| 201 | CGPG3793.pep | zf-C2H2 | 243-265 |
| 152 | CGPG2604.pep | Myb_DNA-binding::Myb_DNA-binding | 30-79::126-173 |
| 178 | CGPG3169.pep | Myb_DNA-binding::Myb_DNA-binding | 18-65::71-116 |
| 233 | CGPG4527.pep | TCP | 96-305 |
| 175 | CGPG2975.pep | KNOX1::KNOX2 | 83-127::134-185 |
| 166 | CGPG2778.pep | zf-ZPR1::zf-ZPR1 | 32-193::283-444 |
| 260 | CGPG7678.pep | Myb_DNA-binding::Myb_DNA-binding | 8-55::61-106 |
| 276 | CGPG6312.pep | DUF630::DUF632 | 1-60::186-502 |
| 256 | CGPG7376.pep | WRKY | 84-144 |
| 242 | CGPG5292.pep | Myb_DNA-binding | 88-135 |
| 145 | CGPG2551.pep | zf-C2H2 | 60-82 |
| 202 | CGPG3795.pep | HLH | 230-280 |
| 174 | CGPG2961.pep | AP2 | 129-180 |
| 154 | CGPG2639.pep | AT_hook::DUF296 | 80-92::107-232 |
| 248 | CGPG5422.pep | Ank::Ank::Ank::Ank::Ank | 36-68::70-102:104-137::138-170::184-226 |
| 183 | CGPG3296.pep | WRKY | 216-276 |
| 167 | CGPG2797.pep | zf-C2H2 | 206-228 |
| 261 | CGPG7697.pep | NAM | 14-140 |
| 195 | CGPG3476.pep | AP2 | 41-92 |
| 257 | CGPG7378.pep | NAM | 25-156 |
| 244 | CGPG5316.pep | Myb_DNA-binding::Myb_DNA-binding::Myb_DNA-binding | 60-106::112-158::164-209 |
| 216 | CGPG3869.pep | NAM | 6-134 |

TABLE 17-continued

| PEP Seq ID No. | Construct ID | Pfam module | Position |
|---|---|---|---|
| 148 | CGPG2586.pep | HLH | 154-204 |
| 168 | CGPG2805.pep | Myb_DNA-binding::Myb_DNA-binding | 20-67::73-118 |
| 177 | CGPG3107.pep | Myb_DNA-binding | 243-294 |
| 274 | CGPG4213.pep | HLH | 63-112 |
| 225 | CGPG4066.pep | bZIP_2 | 69-119 |
| 184 | CGPG3298.pep | bZIP_2 | 192-246 |
| 241 | CGPG5280.pep | BAH::PHD | 21-136::140-189 |
| 155 | CGPG2644.pep | HLH | 132-181 |
| 199 | CGPG3750.pep | NAM | 7-136 |
| 163 | CGPG2752.pep | GATA | 222-257 |
| 266 | CGPG7757.pep | SSrecog::Rtt106::HMG_box | 219-434::359-500::556-624 |
| 141 | CGPG1754.pep | DUF573 | 153-246 |
| 206 | CGPG382.pep | zf-B_box::CCT | 11-59::357-401 |
| 210 | CGPG3841.pep | HLH | 211-260 |
| 142 | CGPG1809.pep | RWP-RK | 144-195 |
| 238 | CGPG490.pep | AP2::B3 | 81-130::209-330 |
| 144 | CGPG2164.pep | AUX_IAA | 266-436 |
| 173 | CGPG2948.pep | SRF-TF | 20-73 |
| 264 | CGPG7743.pep | AP2 | 164-215 |
| 212 | CGPG3857.pep | AP2 | 74-125 |
| 221 | CGPG4004.pep | HSF_DNA-bind | 42-212 |
| 267 | CGPG7759.pep | AP2 | 27-78 |
| 151 | CGPG26.pep | SRF-TF::K-box | 9-59::75-174 |
| 196 | CGPG3505.pep | Myb_DNA-binding | 47-98 |
| 262 | CGPG7709.pep | zf-LSD1::zf-LSD1::zf-LSD1 | 7-31::46-70::82-106 |
| 231 | CGPG4195.pep | KNOX1::KNOX2::ELK | 18-62::73-128::184-205 |
| 228 | CGPG4112.pep | zf-C3HC4 | 202-242 |
| 204 | CGPG3810.pep | MFMR::bZIP_1 | 1-205::293-356 |
| 277 | CGPG7188.pep | DUF573 | 120-211 |
| 211 | CGPG3843.pep | Myb_DNA-binding | 84-135 |
| 149 | CGPG2593.pep | HLH | 163-214 |
| 153 | CGPG2615.pep | NAM | 9-138 |
| 198 | CGPG367.pep | Myb_DNA-binding::Myb_DNA-binding | 14-61::67-112 |
| 243 | CGPG5306.pep | SRF-TF::K-box | 9-59::76-173 |
| 187 | CGPG3327.pep | zf-C3HC4 | 109-149 |
| 235 | CGPG4591.pep | zf-B_box | 1-46 |
| 251 | CGPG7354.pep | WRKY | 159-219 |
| 194 | CGPG3468.pep | zf-B_box::CCT | 10-57::265-309 |
| 273 | CGPG31.pep | EIN3 | 31-422 |
| 272 | CGPG2562.pep | HSF_DNA-bind | 18-188 |
| 263 | CGPG7714.pep | AUX_IAA | 6-173 |
| 208 | CGPG3828.pep | TCP | 44-253 |
| 146 | CGPG2578.pep | Myb_DNA-binding::Myb_DNA-binding | 25-72::78-123 |
| 275 | CGPG477.pep | AP2 | 37-88 |
| 268 | CGPG7822.pep | KNOX1::KNOX2::ELK::Homeobox | 32-76::79-130::178-199::201-260 |
| 254 | CGPG7373.pep | HSF_DNA-bind | 14-194 |
| 229 | CGPG4133.pep | HSF_DNA-bind | 8-206 |
| 224 | CGPG4061.pep | AP2::B3 | 75-124::204-318 |
| 230 | CGPG4166.pep | NAM | 11-139 |
| 161 | CGPG2711.pep | SBP | 58-136 |
| 246 | CGPG5330.pep | AP2 | 128-180 |
| 179 | CGPG3171.pep | zf-C2H2 | 61-83 |
| 147 | CGPG2583.pep | SRF-TF::K-box | 9-59::79-173 |
| 170 | CGPG2907.pep | zf-C2H2 | 177-200 |
| 200 | CGPG3761.pep | GRAS | 1-320 |
| 222 | CGPG4013.pep | AP2 | 119-170 |
| 172 | CGPG2943.pep | Myb_DNA-binding | 65-110 |
| 270 | CGPG7876.pep | AP2 | 21-72 |
| 140 | CGPG113.pep | AP2-AP2 | 282-342::384-436 |
| 226 | CGPG4082.pep | HLH | 127-178 |
| 271 | CGPG858.pep | CXC::CXC | 398-439::484-525 |
| 156 | CGPG2657.pep | AP2 | 25-76 |
| 215 | CGPG3868.pep | NAM | 17-139 |
| 197 | CGPG359.pep | zf-C3HC4 | 89-132 |
| 223 | CGPG4015.pep | Myb_DNA-binding::Myb_DNA-binding | 14-61::67-112 |
| 190 | CGPG3369.pep | GRAS | 130-436 |
| 180 | CGPG3175.pep | Homeobox::HALZ | 30-86::87-131 |
| 247 | CGPG5334.pep | Myb_DNA-binding | 109-156 |
| 227 | CGPG4106.pep | NAM | 9-134 |
| 203 | CGPG3804.pep | WRKY | 135-194 |
| 209 | CGPG3837.pep | zf-C2H2 | 244-266 |
| 193 | CGPG3463.pep | zf-C2H2 | 6-28 |
| 240 | CGPG5278.pep | NAM | 20-146 |
| 165 | CGPG2767.pep | zf-C2H2 | 193-215 |
| 188 | CGPG3341.pep | AP2::AP2 | 130-180::222-273 |

TABLE 17-continued

| PEP Seq ID No. | Construct ID | Pfam module | Position |
|---|---|---|---|
| 158 | CGPG2678.pep | zf-C3HC4 | 113-153 |
| 249 | CGPG5599.pep | RWP-RK::PB1 | 605-656::811-894 |
| 219 | CGPG3947.pep | SRF-TF::K-box | 9-59::75-174 |
| 157 | CGPG2664.pep | zf-B_box | 26-72 |

TABLE 18

| PEP Seq ID No. | Construct ID | Pfam domain name | Begin | Stop | score | E-value |
|---|---|---|---|---|---|---|
| 140 | CGPG113.pep | AP2 | 282 | 342 | 60.7 | 4.90E−15 |
| 140 | CGPG113.pep | AP2 | 384 | 436 | 64.2 | 4.50E−16 |
| 141 | CGPG1754.pep | DUF573 | 153 | 246 | 225.4 | 1.30E−64 |
| 142 | CGPG1809.pep | RWP-RK | 144 | 195 | 76 | 1.20E−19 |
| 144 | CGPG2164.pep | AUX_IAA | 266 | 436 | −74.9 | 0.00043 |
| 145 | CGPG2551.pep | zf-C2H2 | 60 | 82 | 24.2 | 0.00048 |
| 146 | CGPG2578.pep | Myb_DNA-binding | 25 | 72 | 47.2 | 5.90E−11 |
| 146 | CGPG2578.pep | Myb_DNA-binding | 78 | 123 | 46.4 | 9.80E−11 |
| 147 | CGPG2583.pep | SRF-TF | 9 | 59 | 107.5 | 4.10E−29 |
| 147 | CGPG2583.pep | K-box | 79 | 173 | 44.6 | 3.50E−10 |
| 148 | CGPG2586.pep | HLH | 154 | 204 | 27.2 | 5.90E−05 |
| 149 | CGPG2593.pep | HLH | 163 | 214 | 43.8 | 6.00E−10 |
| 150 | CGPG2594.pep | HLH | 277 | 327 | 66.3 | 1.00E−16 |
| 151 | CGPG26.pep | SRF-TF | 9 | 59 | 119.5 | 1.00E−32 |
| 151 | CGPG26.pep | K-box | 75 | 174 | 166.3 | 8.30E−47 |
| 152 | CGPG2604.pep | Myb_DNA-binding | 30 | 79 | 31 | 4.30E−06 |
| 152 | CGPG2604.pep | Myb_DNA-binding | 126 | 173 | 45 | 2.70E−10 |
| 153 | CGPG2615.pep | NAM | 9 | 138 | 293.9 | 3.10E−85 |
| 154 | CGPG2639.pep | AT_hook | 80 | 92 | 7.5 | 1.2 |
| 154 | CGPG2639.pep | DUF296 | 107 | 232 | 209.5 | 8.00E−60 |
| 155 | CGPG2644.pep | HLH | 132 | 181 | 51 | 4.10E−12 |
| 156 | CGPG2657.pep | AP2 | 25 | 76 | 78.3 | 2.60E−20 |
| 157 | CGPG2664.pep | zf-B_box | 26 | 72 | 43.1 | 1.00E−09 |
| 158 | CGPG2678.pep | zf-C3HC4 | 113 | 153 | 44.5 | 3.70E−10 |
| 159 | CGPG2699.pep | B3 | 176 | 281 | 104.7 | 2.80E−28 |
| 159 | CGPG2699.pep | Auxin_resp | 302 | 384 | 204.5 | 2.50E−58 |
| 161 | CGPG2711.pep | SBP | 58 | 136 | 173.4 | 6.00E−49 |
| 163 | CGPG2752.pep | GATA | 222 | 257 | 75.4 | 1.90E−19 |
| 164 | CGPG2757.pep | NAM | 3 | 139 | 145.1 | 2.00E−40 |
| 165 | CGPG2767.pep | zf-C2H2 | 193 | 215 | 21.8 | 0.0025 |
| 166 | CGPG2778.pep | zf-ZPR1 | 32 | 193 | 253 | 6.50E−73 |
| 166 | CGPG2778.pep | zf-ZPR1 | 283 | 444 | 207.6 | 3.00E−59 |
| 167 | CGPG2797.pep | zf-C2H2 | 206 | 228 | 30.5 | 6.00E−06 |
| 168 | CGPG2805.pep | Myb_DNA-binding | 20 | 67 | 42.7 | 1.30E−09 |
| 168 | CGPG2805.pep | Myb_DNA-binding | 73 | 118 | 50.8 | 4.80E−12 |
| 169 | CGPG2811.pep | AP2 | 206 | 257 | 32.1 | 2.00E−06 |
| 170 | CGPG2907.pep | zf-C2H2 | 177 | 200 | 24.1 | 0.00052 |
| 171 | CGPG2935.pep | Myb_DNA-binding | 30 | 75 | 32.3 | 1.80E−06 |
| 172 | CGPG2943.pep | Myb_DNA-binding | 65 | 110 | 57.6 | 4.40E−14 |
| 173 | CGPG2948.pep | SRF-TF | 20 | 73 | 27.1 | 6.40E−05 |
| 174 | CGPG2961.pep | AP2 | 129 | 180 | 65 | 2.50E−16 |
| 175 | CGPG2975.pep | KNOX1 | 83 | 127 | 94.4 | 3.50E−25 |
| 175 | CGPG2975.pep | KNOX2 | 134 | 185 | 114.1 | 4.10E−31 |
| 176 | CGPG2985.pep | Myb_DNA-binding | 5 | 57 | 34.7 | 3.30E−07 |
| 176 | CGPG2985.pep | Linker_histone | 123 | 189 | 0.3 | 0.00099 |
| 177 | CGPG3107.pep | Myb_DNA-binding | 243 | 294 | 44.6 | 3.60E−10 |
| 178 | CGPG3169.pep | Myb_DNA-binding | 18 | 65 | 53.4 | 7.80E−13 |
| 178 | CGPG3169.pep | Myb_DNA-binding | 71 | 116 | 59 | 1.60E−14 |
| 179 | CGPG3171.pep | zf-C2H2 | 61 | 83 | 21.8 | 0.0026 |
| 180 | CGPG3175.pep | Homeobox | 30 | 86 | 66.5 | 8.90E−17 |
| 180 | CGPG3175.pep | HALZ | 87 | 131 | 37.6 | 4.30E−08 |
| 181 | CGPG3287.pep | Ank | 127 | 158 | 6.6 | 3.7 |
| 181 | CGPG3287.pep | Ank | 159 | 191 | 24.8 | 0.00033 |
| 181 | CGPG3287.pep | Ank | 193 | 225 | 30.7 | 5.50E−06 |
| 181 | CGPG3287.pep | Chromo | 320 | 368 | 45.7 | 1.60E−10 |
| 182 | CGPG3289.pep | GATA | 43 | 78 | 65.8 | 1.50E−16 |
| 183 | CGPG3296.pep | WRKY | 216 | 276 | 141 | 3.30E−39 |
| 184 | CGPG3298.pep | bZIP_2 | 192 | 246 | 31 | 4.30E−06 |
| 184 | CGPG3298.pep | bZIP_1 | 194 | 255 | 26.8 | 8.00E−05 |
| 185 | CGPG3309.pep | zf-C2H2 | 68 | 90 | 20.4 | 0.0066 |
| 186 | CGPG3312.pep | bZIP_1 | 146 | 209 | 34.3 | 4.50E−07 |
| 186 | CGPG3312.pep | bZIP_2 | 146 | 200 | 28.6 | 2.40E−05 |
| 187 | CGPG3327.pep | zf-C3HC4 | 109 | 149 | 49 | 1.60E−11 |
| 188 | CGPG3341.pep | AP2 | 130 | 180 | 62.3 | 1.60E−15 |

TABLE 18-continued

| PEP Seq ID No. | Construct ID | Pfam domain name | Begin | Stop | score | E-value |
|---|---|---|---|---|---|---|
| 188 | CGPG3341.pep | AP2 | 222 | 273 | 58.2 | 2.90E−14 |
| 190 | CGPG3369.pep | GRAS | 130 | 436 | 532.9 | 3.50E−157 |
| 192 | CGPG3451.pep | HLH | 43 | 95 | 33.5 | 7.80E−07 |
| 193 | CGPG3463.pep | zf-C2H2 | 6 | 28 | 24.2 | 0.00047 |
| 194 | CGPG3468.pep | zf-B_box | 10 | 57 | 39.9 | 9.30E−09 |
| 194 | CGPG3468.pep | CCT | 265 | 309 | 86.2 | 1.00E−22 |
| 195 | CGPG3476.pep | AP2 | 41 | 92 | 73.1 | 9.10E−19 |
| 196 | CGPG3505.pep | Myb_DNA-binding | 47 | 98 | 43.1 | 1.00E−09 |
| 197 | CGPG359.pep | zf-C3HC4 | 89 | 132 | 35.3 | 2.30E−07 |
| 198 | CGPG367.pep | Myb_DNA-binding | 14 | 61 | 46.6 | 8.70E−11 |
| 198 | CGPG367.pep | Myb_DNA-binding | 67 | 112 | 53.8 | 6.00E−13 |
| 199 | CGPG3750.pep | NAM | 7 | 136 | 307.5 | 2.50E−89 |
| 200 | CGPG3761.pep | GRAS | 1 | 320 | 391.8 | 1.00E−114 |
| 201 | CGPG3793.pep | zf-C2H2 | 243 | 265 | 22.2 | 0.002 |
| 202 | CGPG3795.pep | HLH | 230 | 280 | 33.3 | 8.80E−07 |
| 203 | CGPG3804.pep | WRKY | 135 | 194 | 153.9 | 4.40E−43 |
| 204 | CGPG3810.pep | MFMR | 1 | 205 | 368.8 | 9.00E−108 |
| 204 | CGPG3810.pep | bZIP_1 | 293 | 356 | 91.5 | 2.60E−24 |
| 204 | CGPG3810.pep | bZIP_2 | 293 | 347 | 29.2 | 1.50E−05 |
| 205 | CGPG3813.pep | NAM | 16 | 145 | 295.2 | 1.20E−85 |
| 206 | CGPG382.pep | zf-B_box | 11 | 59 | 38 | 3.40E−08 |
| 206 | CGPG382.pep | CCT | 357 | 401 | 85.6 | 1.60E−22 |
| 207 | CGPG3825.pep | WRKY | 102 | 164 | 94.6 | 3.10E−25 |
| 208 | CGPG3828.pep | TCP | 44 | 253 | 149.4 | 1.00E−41 |
| 209 | CGPG3837.pep | zf-C2H2 | 244 | 266 | 24.8 | 0.00032 |
| 210 | CGPG3841.pep | HLH | 211 | 260 | 44.6 | 3.50E−10 |
| 211 | CGPG3843.pep | Myb_DNA-binding | 84 | 135 | 47.7 | 4.00E−11 |
| 212 | CGPG3857.pep | AP2 | 74 | 125 | 83.2 | 8.60E−22 |
| 213 | CGPG3858.pep | WRKY | 146 | 205 | 144.2 | 3.80E−40 |
| 214 | CGPG3865.pep | zf-C2H2 | 67 | 89 | 22.1 | 0.0021 |
| 215 | CGPG3868.pep | NAM | 17 | 139 | 58.4 | 2.50E−14 |
| 216 | CGPG3869.pep | NAM | 6 | 134 | 304.9 | 1.50E−88 |
| 217 | CGPG3875.pep | WRKY | 204 | 262 | 141.3 | 2.70E−39 |
| 217 | CGPG3875.pep | WRKY | 343 | 402 | 151.5 | 2.30E−42 |
| 218 | CGPG3879.pep | Myb_DNA-binding | 235 | 286 | 35.8 | 1.60E−07 |
| 219 | CGPG3947.pep | SRF-TF | 9 | 59 | 118.6 | 1.90E−32 |
| 219 | CGPG3947.pep | K-box | 75 | 174 | 165.8 | 1.20E−46 |
| 220 | CGPG3987.pep | Myb_DNA-binding | 13 | 59 | 59.2 | 1.40E−14 |
| 220 | CGPG3987.pep | Myb_DNA-binding | 65 | 110 | 50.8 | 4.90E−12 |
| 221 | CGPG4004.pep | HSF_DNA-bind | 42 | 212 | 267.1 | 3.60E−77 |
| 222 | CGPG4013.pep | AP2 | 119 | 170 | 87.4 | 4.70E−23 |
| 223 | CGPG4015.pep | Myb_DNA-binding | 14 | 61 | 46.6 | 8.80E−11 |
| 223 | CGPG4015.pep | Myb_DNA-binding | 67 | 112 | 40.9 | 4.40E−09 |
| 224 | CGPG4061.pep | AP2 | 75 | 124 | 50.7 | 5.30E−12 |
| 224 | CGPG4061.pep | B3 | 204 | 318 | 116.1 | 1.00E−31 |
| 225 | CGPG4066.pep | bZIP_2 | 69 | 119 | 24.4 | 0.00043 |
| 226 | CGPG4082.pep | HLH | 127 | 178 | 59.2 | 1.40E−14 |
| 227 | CGPG4106.pep | NAM | 9 | 134 | 300.7 | 2.80E−87 |
| 228 | CGPG4112.pep | zf-C3HC4 | 202 | 242 | 39.7 | 1.00E−08 |
| 229 | CGPG4133.pep | HSF_DNA-bind | 8 | 206 | 179.6 | 7.80E−51 |
| 230 | CGPG4166.pep | NAM | 11 | 139 | 316.4 | 5.10E−92 |
| 231 | CGPG4195.pep | KNOX1 | 18 | 62 | 72.1 | 1.90E−18 |
| 231 | CGPG4195.pep | KNOX2 | 73 | 128 | 86.8 | 7.00E−23 |
| 231 | CGPG4195.pep | ELK | 184 | 205 | 25.4 | 0.0002 |
| 232 | CGPG4525.pep | POX | 261 | 385 | 200.7 | 3.60E−57 |
| 232 | CGPG4525.pep | Homeobox | 426 | 484 | 6.6 | 0.0024 |
| 233 | CGPG4527.pcp | TCP | 96 | 305 | 303.9 | 3.10E−88 |
| 235 | CGPG4591.pep | zf-B_box | 1 | 46 | 22.6 | 0.00055 |
| 236 | CGPG4612.pep | NAM | 6 | 141 | 278.3 | 1.60E−80 |
| 238 | CGPG490.pep | AP2 | 81 | 130 | 55.4 | 1.90E−13 |
| 238 | CGPG490.pep | B3 | 209 | 330 | 110.8 | 4.00E−30 |
| 239 | CGPG5130.pep | AT_hook | 105 | 117 | 19 | 0.013 |
| 239 | CGPG5130.pep | AT_hook | 147 | 159 | 6.3 | 1.9 |
| 239 | CGPG5130.pep | DUF296 | 177 | 296 | 206.6 | 6.00E−59 |
| 240 | CGPG5278.pep | NAM | 20 | 146 | 307.2 | 3.00E−89 |
| 241 | CGPG5280.pep | BAH | 21 | 136 | 139.8 | 7.60E−39 |
| 241 | CGPG5280.pep | PHD | 140 | 189 | 56.9 | 6.90E−14 |
| 242 | CGPG5292.pep | Myb_DNA-binding | 88 | 135 | 49 | 1.70E−11 |
| 243 | CGPG5306.pep | SRF-TF | 9 | 59 | 98.7 | 1.90E−26 |
| 243 | CGPG5306.pep | K-box | 76 | 173 | 133.1 | 8.00E−37 |
| 244 | CGPG5316.pep | Myb_DNA-binding | 60 | 106 | 51.8 | 2.40E−12 |
| 244 | CGPG5316.pep | Myb_DNA-binding | 112 | 158 | 59.9 | 8.70E−15 |
| 244 | CGPG5316.pep | Myb_DNA-binding | 164 | 209 | 45.4 | 2.00E−10 |
| 245 | CGPG5324.pep | Linker_histone | 11 | 78 | 93.2 | 8.30E−25 |
| 245 | CGPG5324.pep | AT_hook | 84 | 96 | 9.3 | 0.6 |
| 245 | CGPG5324.pep | AT_hook | 106 | 118 | 16.7 | 0.031 |
| 245 | CGPG5324.pep | AT_hook | 132 | 144 | 11.7 | 0.23 |

TABLE 18-continued

| PEP Seq ID No. | Construct ID | Pfam domain name | Begin | Stop | score | E-value |
|---|---|---|---|---|---|---|
| 245 | CGPG5324.pep | AT_hook | 156 | 168 | 13.4 | 0.12 |
| 246 | CGPG5330.pep | AP2 | 128 | 180 | 85.5 | 1.70E−22 |
| 247 | CGPG5334.pep | Myb_DNA-binding | 109 | 156 | 48.1 | 3.10E−11 |
| 248 | CGPG5422.pep | Ank | 36 | 68 | 3.5 | 10 |
| 248 | CGPG5422.pep | Ank | 70 | 102 | 9.1 | 1.6 |
| 248 | CGPG5422.pep | Ank | 104 | 137 | 11 | 0.85 |
| 248 | CGPG5422.pep | Ank | 138 | 170 | 8.5 | 2 |
| 248 | CGPG5422.pep | Ank | 184 | 226 | 13.3 | 0.39 |
| 249 | CGPG5599.pep | RWP-RK | 605 | 656 | 106.1 | 1.10E−28 |
| 249 | CGPG5599.pep | PB1 | 811 | 894 | 87.3 | 5.00E−23 |
| 250 | CGPG690.pep | PHD | 196 | 246 | 53.8 | 5.80E−13 |
| 251 | CGPG7354.pep | WRKY | 159 | 219 | 139.2 | 1.20E−38 |
| 252 | CGPG7367.pep | AUX_IAA | 66 | 359 | 448.6 | 8.70E−132 |
| 253 | CGPG7369.pep | zf-Dof | 38 | 100 | 138.6 | 1.80E−35 |
| 254 | CGPG7373.pep | HSF_DNA-bind | 14 | 194 | 189.2 | 1.00E−53 |
| 255 | CGPG7374.pep | Myb_DNA-binding | 38 | 84 | 57.8 | 3.80E−14 |
| 255 | CGPG7374.pep | Myb_DNA-binding | 90 | 135 | 58.8 | 1.80E−34 |
| 256 | CGPG7376.pep | WRKY | 84 | 144 | 130.5 | 4.70E−36 |
| 257 | CGPG7378.pep | NAM | 25 | 156 | 247.7 | 2.50E−71 |
| 258 | CGPG7641.pep | AT_hook | 70 | 82 | 19.1 | 0.012 |
| 258 | CGPG7641.pep | DUF296 | 142 | 262 | 232.7 | 8.20E−67 |
| 259 | CGPG7655.pep | zf-B_box | 1 | 47 | 41.2 | 3.60E−09 |
| 259 | CGPG7655.pep | zf-B_box | 53 | 100 | 54.5 | 3.80E−13 |
| 260 | CGPG7678.pep | Myb_DNA-binding | 8 | 55 | 50.2 | 7.30E−12 |
| 260 | CGPG7678.pep | Myb_DNA-binding | 61 | 106 | 57.2 | 5.50E−14 |
| 261 | CGPG7697.pep | NAM | 14 | 140 | 299.2 | 7.80E−87 |
| 262 | CGPG7709.pep | zf-LSD1 | 7 | 31 | 38.1 | 3.20E−08 |
| 262 | CGPG7709.pep | zf-LSD1 | 46 | 70 | 52 | 2.10E−12 |
| 262 | CGPG7709.pep | zf-LSD1 | 82 | 106 | 46.7 | 8.20E−11 |
| 263 | CGPG7714.pep | AUX_IAA | 6 | 173 | 339.7 | 5.10E−99 |
| 264 | CGPG7743.pep | AP2 | 164 | 215 | 80.1 | 7.30E−21 |
| 265 | CGPG7748.pep | B3 | 141 | 246 | 110.7 | 4.50E−30 |
| 265 | CGPG7748.pep | Auxin_resp | 268 | 350 | 198.6 | 1.50E−56 |
| 265 | CGPG7748.pep | AUX_IAA | 640 | 805 | −72.2 | 0.00028 |
| 266 | CGPG7757.pep | SSrecog | 219 | 434 | 495.1 | 8.70E−146 |
| 266 | CGPG7757.pep | Rtt106 | 359 | 500 | 179.1 | 1.20E−50 |
| 266 | CGPG7757.pep | HMG_box | 556 | 624 | 110.2 | 6.50E−30 |
| 267 | CGPG7759.pep | AP2 | 27 | 78 | 79.5 | 1.10E−20 |
| 268 | CGPG7822.pep | KNOX1 | 32 | 76 | 81.2 | 3.30E−21 |
| 268 | CGPG7822.pep | KNOX2 | 79 | 130 | 92.5 | 1.30E−24 |
| 268 | CGPG7822.pep | ELK | 178 | 199 | 30 | 8.50E−06 |
| 268 | CGPG7822.pep | Homeobox | 201 | 260 | 0.4 | 0.0098 |
| 269 | CGPG7840.pep | zf-B_box | 1 | 47 | 23.5 | 0.00044 |
| 269 | CGPG7840.pep | CCT | 367 | 411 | 80.2 | 6.50E−21 |
| 270 | CGPG7876.pep | AP2 | 21 | 72 | 82.5 | 1.40E−21 |
| 271 | CGPG858.pep | CXC | 398 | 439 | 89.7 | 9.20E−24 |
| 271 | CGPG858.pep | CXC | 484 | 525 | 82.7 | 1.10E−21 |
| 272 | CGPG2562.pep | HSF_DNA-bind | 18 | 188 | 213.9 | 3.70E−61 |
| 273 | CGPG31.pep | EIN3 | 31 | 422 | 1032.5 | 0 |
| 274 | CGPG4213.pep | HLH | 63 | 112 | 44.3 | 4.40E−10 |
| 275 | CGPG477.pep | AP2 | 37 | 88 | 79.6 | 9.90E−21 |
| 276 | CGPG6312.pep | DUF630 | 1 | 60 | 123.9 | 4.80E−34 |
| 276 | CGPG6312.pep | DUF632 | 186 | 502 | 465.8 | 5.80E−137 |
| 277 | CGPG7188.pep | DUF573 | 120 | 211 | 191.2 | 2.60E−54 |

TABLE 19

| Pfam domain name | Accession # | gathering cutoff | domain description |
|---|---|---|---|
| AT_hook | PF02178.10 | 3.6 | AT hook motif |
| AUX_IAA | PF02309.7 | −83 | AUX/IAA family |
| Ank | PF00023.21 | 0 | Ankyrin repeat |
| Auxin_resp | PF06507.4 | 25 | Auxin response factor |
| B3 | PF02362.12 | 26.5 | B3 DNA binding domain |
| BAH | PF01426.9 | 7 | BAH domain |
| CCT | PF06203.5 | 25 | CCT motif |
| CXC | PF03638.6 | 25 | Tesmin/TSO1-like CXC domain |
| Chromo | PF00385.15 | 27.5 | 'chromo' (CHRromatin Organisation MOdifier) domain |
| DUF296 | PF03479.6 | −11 | Domain of unknown function (DUF296) |
| DUF573 | PF04504.5 | 25 | Protein of unknown function, DUF573 |
| DUF630 | PF04783.3 | 25 | Protein of unknown function (DUF630) |
| DUF632 | PF04782.3 | 25 | Protein of unknown function (DUF632) |

TABLE 19-continued

| Pfam domain name | Accession # | gathering cutoff | domain description |
|---|---|---|---|
| EIN3 | PF04873.4 | −137.6 | Ethylene insensitive 3 |
| ELK | PF03789.4 | 25 | ELK domain |
| GATA | PF00320.18 | 28.5 | GATA zinc finger |
| GRAS | PF03514.5 | −78 | GRAS family transcription factor |
| HALZ | PF02183.9 | 18.1 | Homeobox associated leucine zipper |
| HLH | PF00010.17 | 8.3 | Helix-loop-helix DNA-binding domain |
| HMG_box | PF00505.10 | 4.1 | HMG (high mobility group) box |
| HSF_DNA-bind | PF00447.8 | −70 | HSF-type DNA-binding |
| Homeobox | PF00046.20 | −4.1 | Homeobox domain |
| K-box | PF01486.8 | 0 | K-box region |
| KNOX1 | PF03790.4 | 25 | KNOX1 domain |
| KNOX2 | PF03791.4 | 25 | KNOX2 domain |
| Linker_histone | PF00538.10 | −8 | linker histone H1 and H5 family |
| MFMR | PF07777.2 | −46.7 | G-box binding protein MFMR |
| Myb_DNA-binding | PF00249.22 | 14 | Myb-like DNA-binding domain |
| NAM | PF02365.6 | −19 | No apical meristem (NAM) protein |
| PB1 | PF00564.15 | 12.3 | PB1 domain |
| PHD | PF00628.20 | 26.2 | PHD-finger |
| POX | PF07526.2 | −39.4 | Associated with HOX |
| RWP-RK | PF02042.6 | 25 | RWP-RK domain |
| Rtt106 | PF08512.3 | 10.1 | Histone chaperone Rtt106-like |
| SBP | PF03110.5 | 25 | SBP domain |
| SRF-TF | PF00319.9 | 11 | SRF-type transcription factor (DNA-binding and dimerisation domain) |
| SSrecog | PF03531.5 | −73.6 | Structure-specific recognition protein (SSRP1) |
| TCP | PF03634.4 | −38 | TCP family transcription factor |
| WRKY | PF03106.6 | −6.7 | WRKY DNA-binding domain |
| bZIP_1 | PF00170.12 | 24.8 | bZIP transcription factor |
| bZIP_2 | PF07716.6 | 15 | Basic region leucine zipper |
| zf-B_box | PF00643.15 | 15.3 | B-box zinc finger |
| zf-C2H2 | PF00096.17 | 17.7 | Zinc finger, C2H2 type |
| zf-C3HC4 | PF00097.16 | 16 | Zinc finger, C3HC4 type (RING finger) |
| zf-Dof | PF02701.6 | 25 | Dof domain, zinc finger |
| zf-LSD1 | PF06943.3 | 25 | LSD1 zinc finger |
| zf-ZPR1 | PF03367.4 | 25 | ZPR1 zinc-finger domain |

Example 5. Plasmid Construction for Transferring Recombinant DNA

This example illustrates the construction of plasmids for transferring recombinant DNA into the nucleus of a plant cell which can be regenerated into a transgenic crop plant of this invention. Primers for PCR amplification of protein coding nucleotides of recombinant DNA are designed at or near the start and stop codons of the coding sequence, in order to eliminate most of the 5' and 3' untranslated regions. DNA of interest, e.g., each DNA identified in Table 2 and the DNA for the identified homologous genes, are cloned and amplified by PCR prior to insertion into the insertion site the base vector.

A. Plant Expression Constructs for Corn Transformation

Figure 2:
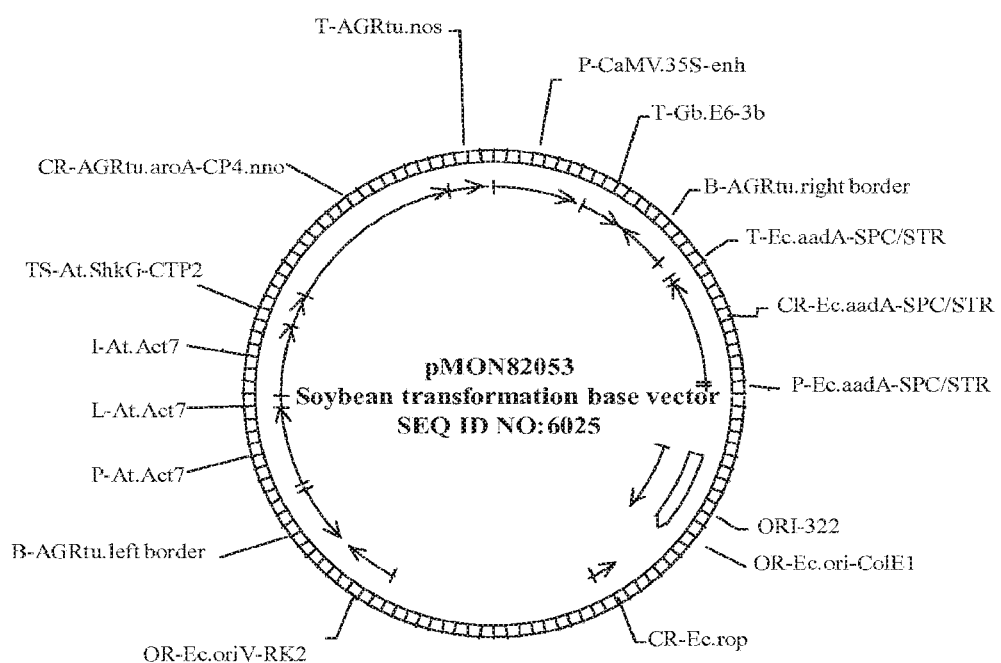

Elements of an exemplary common expression vector, pMON93039 are illustrated in Table 20. The exemplary base vector which is especially useful for corn transformation is illustrated in FIG. 2 and assembled using technology known in the art.

TABLE 20

| | pMON93039 | | |
|---|---|---|---|
| function | name | annotation | Coordinates of SEQ ID NO: 6024 |
| Agrobacterium T-DNA trabsfer | B-AGRtu.right border | Agro right border sequence, essential for transfer of T-DNA. | 11364-11720 |
| Gene of interest expression cassette | E-Os.Act1 | upstream promoter region of the rice actin 1 gene | 19-775 |
| | E-CaMV.35S.2xA1-B3 | duplicated 35S A1-B3 domain without TATA box | 788-1120 |
| | P-Os.Act1 | promoter region of the rice actin 1 gene | 1125-1204 |

TABLE 20-continued pMON93039

| function | name | annotation | Coordinates of SEQ ID NO: 6024 |
|---|---|---|---|
| | L-Ta.Lhcb1 | 5' untranslated leader of wheat major chlorophyll a/b binding protein | 1210-1270 |
| | I-Os.Act1 | first intron and flanking UTR exon sequences from the rice actin 1 gene | 1287-1766 |
| | T-St.Pis4 | 3' non-translated region of the potato proteinase inhibitor II gene which functions to direct polyadenylation of the mRNA | 1838-2780 |
| Plant selectable marker expression cassette | P-Os.Act1 | Promoter from the rice actin 1 gene | 2830-3670 |
| | L-Os.Act1 | first exon of the rice actin 1 gene | 3671-3750 |
| | I-Os.Act1 | first intron and flanking UTR exon sequences from the rice actin 1 gene | 3751-4228 |
| | TS-At.ShkG-CTP2 | Transit peptide region of *Arabidopsis* EPSPS | 4238-4465 |
| | CR-AGRtu.aroA-CP4.nat | coding region for bacterial strain CP4 native arogA gene | 4466-5833 |
| | T-AGRtu.nos | A 3' non-translated region of the nopaline synthase gene of *Agrobacterium tumefaciens* Ti plasmid which functions to direct polyadenylation of the mRNA. | 5849-6101 |
| *Agrobacterium* T-DNA transfer | B-AGRtu.left border | Agro left border sequence, essential for transfer of T-DNA. | 6168-6609 |
| Maintenance in *E. coli* | OR-Ec.oriV-RK2 | The vegetative origin of replication from plasmid RK2. | 6696-7092 |
| | CR-Ec.rop | Coding region for repressor of primer from the ColE1 plasmid. Expression of this gene product interferes with primer binding at the origin of replication, keeping plasmid copy number low. | 8601-8792 |
| | OR-Ec.ori-ColE1 | The minimal origin of replication from the *E. coli* plasmid ColE1. | 9220-9808 |
| | P-Ec.aadA-SPC/STR | romoter for Tn7 adenylyltransferase (AAD(3")) | 10339-10380 |
| | CR-Ec.aadA-SPC/STR | Coding region for Tn7 adenylyltransferase (AAD(3")) conferring spectinomycin and streptomycin resistance. | 10381-11169 |
| | T-Ec.aadA-SPC/STR | 3' UTR from the Tn7 adenylyltransferase (AAD(3")) gene of *E. coli*. | 11170-11227 |

B. Plant Expression Constructs for Soybean or Canola Transformation

Plasmids for use in transformation of soybean are also prepared. Elements of an exemplary common expression vector plasmid pMON82053 are shown in Table 21 below. This exemplary soybean transformation base vector illustrated in FIG. 2 is assembled using the technology known in the art. DNA of interest, e.g., each DNA identified in Table 2 and the DNA for the identified homologous genes, is cloned and amplified by PCR prior to insertion into the insertion site the base vector at the insertion site between the enhanced 35S CaMV promoter and the termination sequence of cotton E6 gene.

TABLE 21 pMON82053

| function | name | annotation | Coordinates of SEQ ID NO: 6025 |
|---|---|---|---|
| *Agrobacterium* T-DNA transfer | B-AGRtu.left border | Agro left border sequence, essential for transfer of T-DNA. | 6144-6585 |
| Plant selectable marker expression cassette | P-At.Act7 | Promoter from the *arabidopsis* actin 7 gene | |
| | L-At.Act7 | 5'UTR of *Arabidopsis* Act7 gene | |
| | I-At.Act7 | Intron from the *Arabidopsis* actin7 gene | 6624-7861 |
| | TS-At.ShkG-CTP2 | Transit peptide region of *Arabidopsis* EPSPS | 7864-8091 |
| | CR-AGRtu.aroA-CP4.nno__At | Synthetic CP4 coding region with dicot preferred codon usage. | 8092-9459 |
| | T-AGRtu.nos | A 3' non-translated region of the nopaline synthase gene of *Agrobacterium tumefaciens* Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-633 |
| | T-Gb.E6-3b | 3' untranslated region from the fiber protein E6 gene of sea-island cotton; | 688-1002 |
| *Agrobaterium* T-DNA transfer | B-AGRtu.right border | Agro right border sequence, essential for transfer of T-DNA. | 1033-1389 |
| Maintenance in *E. coli* | OR-Ec.oriV-RK2 | The vegetative origin of replication from plasmid RK2. | 5661-6057 |
| | CR-Ec.rop | Coding region for repressor of primer from the ColE1 plasmid. Expression of this gene product interferes with primer binding at the origin of replication, keeping plasmid copy number low. | 3961-4152 |
| | OR-Ec.ori-ColE1 | The minimal origin of replication from the *E. coli* plasmid ColE1. | 2945-3533 |
| | P-Ec.aadA-SPC/STR | romoter for Tn7 adenylyltransferase (AAD(3")) | 2373-2414 |
| | CR-Ec.aadA-SPC/STR | Coding region for Tn7 adenylyltransferase (AAD(3")) conferring spectinomycin and streptomycin resistance. | 1584-2372 |
| | T-Ec.aadA-SPC/STR | 3' UTR from the Tn7 adenylyltransferase (AAD(3")) gene of *E. coli*. | 1526-1583 |

C. Plant Expression Constructs for Cotton Transformation

Figure 3:
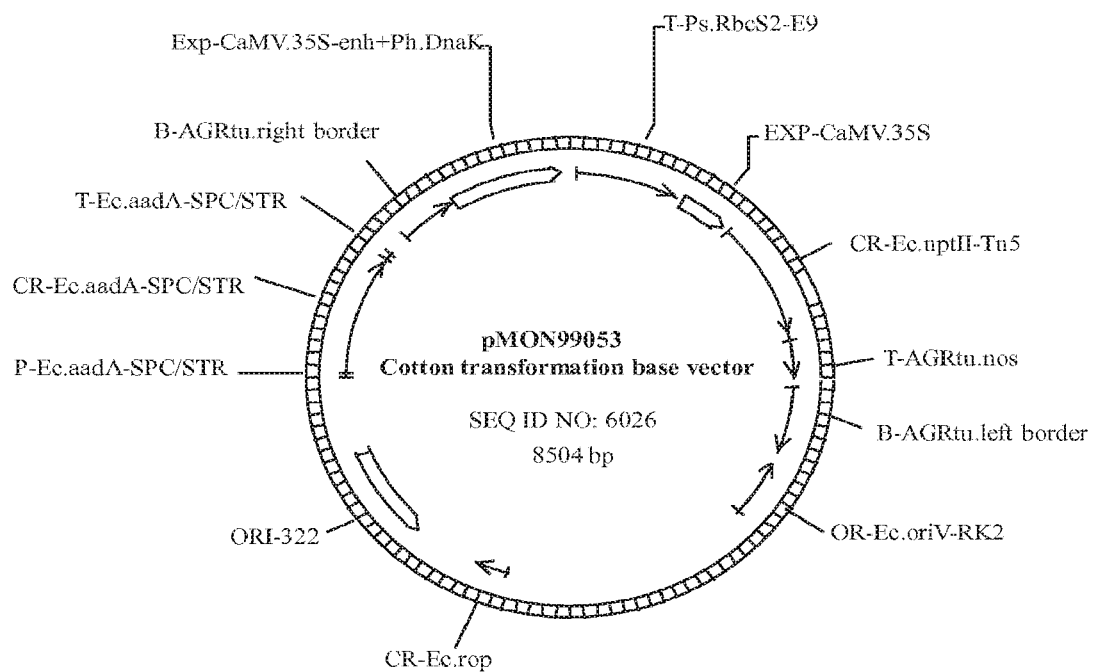

Plasmids for use in transformation of cotton are also prepared. Elements of an exemplary common expression vector plasmid pMON99053 are shown in Table 22 below and FIG. 3. Primers for PCR amplification of protein coding nucleotides of recombinant DNA are designed at or near the start and stop codons of the coding sequence, in order to eliminate most of the 5' and 3' untranslated regions. Each recombinant DNA coding for a protein identified in Table 2 is amplified by PCR prior to insertion into the insertion site within the gene of interest expression cassette of one of the base.

TABLE 22 pMON99053

| function | name | annotation | Coordinates of SEQ ID NO: 6026 |
|---|---|---|---|
| *Agrobacterium* T-DNA transfer | B-AGRtu.right border | Agro right border sequence, essential for transfer of T-DNA. | 1-357 |
| Gene of interest expression cassette | Exp-CaMV.35S-enh + ph.DnaK | Enhanced version of the 35S RNA promoter from CaMV plus the petunia hsp70 5' untranslated region | 388-1091 |
| | T-Ps.RbcS2-E9 | The 3' non-translated region of the pea RbcS2 gene which functions to direct polyadenylation of the mRNA. | 1165-1797 |
| Plant selectable marker expression cassette | Exp-CaMV.35S | Promoter and 5' untranslated region of the 35S RNA from CaMV | 1828-2151 |
| | CR-Ec.nptII-Tn5 | Neomycin Phosphotransferase II gene that confers resistance to neomycin and kanamycin | 2185-2979 |

TABLE 22-continued pMON99053

| function | name | annotation | Coordinates of SEQ ID NO: 6026 |
|---|---|---|---|
| | T-AGRtu.nos | A 3' non-translated region of the nopaline synthase gene of *Agrobacterium tumefaciens* Ti plasmid which functions to direct polyadenylation of the mRNA. | 3011-3263 |
| *Agrobacterium* T-DNA transfer | B-AGRtu.left border | Agro left border sequence, essential for transfer of T-DNA. | 3309-3750 |
| Maintenance in *E. coli* | OR-Ec.oriV-RK2 | The vegetative origin of replication from plasmid RK2. | 3837-4233 |
| | CR-Ec.rop | Coding region for repressor of primer from the ColE1 plasmid. Expression of this gene product interferes with primer binding at the origin of replication, keeping plasmid copy number low. | 5742-5933 |
| | OR-Ec.ori-ColE1 | The minimal origin of replication from the *E. coli* plasmid ColE1. | 6361-6949 |
| | P-Ec.aadA-SPC/STR | romoter for Tn7 adenylyltransferase (AAD(3")) | 7480-7521 |
| | CR-Ec.aadA-SPC/STR | Coding region for Tn7 adenylyltransferase (AAD(3")) conferring spectinomycin and streptomycin resistance. | 7522-8310 |
| | T-Ec.aadA-SPC/STR | 3' UTR from the Tn7 adenylyltransferase (AAD(3")) gene of *E. coli*. | 8311-8368 |

Example 6. Corn Plant Transformation

This example illustrates the production and identification of transgenic corn cells in seed of transgenic corn plants having an enhanced agronomic trait, e.g., enhanced nitrogen use efficiency, increased yield, enhanced water use efficiency, enhanced tolerance to cold and/or enhanced seed compositions as compared to control plants. Transgenic corn cells are prepared with recombinant DNA expressing each of the protein encoding DNAs listed in Table 2 by *Agrobacterium*-mediated transformation using the corn transformation constructs as disclosed in Example 5.

Corn transformation is effected using methods disclosed in U.S. Patent Application Publication 2004/0344075 A1 where corn embryos are inoculated and co-cultured with the *Agrobacterium tumefaciens* strain ABI and the corn transformation vector. To regenerate transgenic corn plants the transgenic callus resulting from transformation is placed on media to initiate shoot development in plantlets which are transferred to potting soil for initial growth in a growth chamber followed by a mist bench before transplanting to pots where plants are grown to maturity. The plants are self fertilized and seed is harvested for screening as seed, seedlings or progeny R2 plants or hybrids, e.g., for yield trials in the screens indicated above.

Many transgenic events which survive to fertile transgenic plants that produce seeds and progeny plants do not exhibit an enhanced agronomic trait. The transgenic plants and seeds having the transgenic cells of this invention which have recombinant DNA imparting the enhanced agronomic traits are identified by screening for nitrogen use efficiency, yield, water use efficiency, cold tolerance and enhanced seed composition.

Example 7. Soybean Plant Transformation

This example illustrates the production and identification of transgenic soybean cells in seed of transgenic soybean plants having an enhanced agronomic trait, e.g., enhanced nitrogen use efficiency, increased yield, enhanced water use efficiency, enhanced tolerance to cold and/or enhanced seed compositions as compared to control plants. Transgenic soybean cells are prepared with recombinant DNA expressing each of the protein encoding DNAs listed in Table 1 by *Agrobacterium*-mediated transformation using the soybean transformation constructs disclosed in Example 5. Soybean transformation is effected using methods disclosed in U.S. Pat. No. 6,384,301 where soybean meristem explants are wounded then inoculated and co-cultured with the soybean transformation vector, then transferred to selection media for 6-8 weeks to allow selection and growth of transgenic shoots.

The transformation is repeated for each of the protein encoding DNAs identified in Table 2.

Transgenic shoots producing roots are transferred to the greenhouse and potted in soil. Many transgenic events which survive to fertile transgenic plants that produce seeds and progeny plants do not exhibit an enhanced agronomic trait. The transgenic plants and seeds having the transgenic cells of this invention which have recombinant DNA imparting the enhanced agronomic traits are identified by screening for nitrogen use efficiency, yield, water use efficiency, cold tolerance and enhanced seed composition.

Example 8. Selection of Transgenic Plants with Enhanced Agronomic Trait(s)

This example illustrates identification of nuclei of the invention by screening derived plants and seeds for an enhanced trait identified below.

Many transgenic events which survive to fertile transgenic plants that produce seeds and progeny plants will not exhibit an enhanced agronomic trait. Populations of transgenic seed and plants prepared in Examples 6 and 7 are screened to identify those transgenic events providing transgenic plant cells with a nucleus having recombinant DNA imparting an enhanced trait. Each population is screened for enhanced nitrogen use efficiency, increased yield, enhanced water use efficiency, enhanced tolerance to cold and heat, increased level of oil and protein in seed using assays described below. Plant cell nuclei having recombinant DNA with each of the genes identified in Table 2 and the identified homologs are identified in plants and seeds with at least one of the enhanced traits.

A. Selection for Enhanced Nitrogen Use Efficiency

Transgenic corn plants with nuclei of the invention are planted in fields with three levels of nitrogen (N) fertilizer being applied, i.e. low level (0 pounds per acre N), medium level (80 pounds per acre N) and high level (180 pounds per acre N). Liquid 28% or 32% UAN (Urea, Ammonium Nitrogen) are used as the N source and apply by broadcast boom and incorporate with a field cultivator with rear rolling basket in the same direction as intended crop rows. Although there is no N applied in the low level treatment, the soil should still be disturbed in the same fashion as the treated area. Transgenic plants and control plants can be grouped by genotype and construct with controls arranged randomly within genotype blocks. For improved statistical analysis each type of transgenic plant can be tested by 3 replications and across 4 locations. Nitrogen levels in the fields are analyzed before planting by collecting sample soil cores from 0-24" and 24 to 48" soil layer. Soil samples are analyzed for nitrate-nitrogen, phosphorus (P), potassium (K), organic matter and pH to provide baseline values. P, K and micronutrients are applied based upon soil test recommendations.

Transgenic corn plants prepared in Example 6 and which exhibit a 2 to 5% yield increase as compared to control plants when grown in the high nitrogen field are selected as having nuclei of the invention. Transgenic corn plants which have at least the same or higher yield as compared to control plants when grown in the medium nitrogen field are selected as having nuclei of the invention. Transgenic corn plants having a nucleus with DNA identified in Table 3 as imparting nitrogen use efficiency (LN) and homologous DNA are selected from a nitrogen use efficiency screen as having a nucleus of this invention.

B. Selection for Increased Yield

Many transgenic plants of this invention exhibit increased yield as compared to a control plant. Increased yield can result from enhanced seed sink potential, e.g., the number and size of endosperm cells or kernels and/or enhanced sink strength, e.g., the rate of starch biosynthesis. Sink potential can be established very early during kernel development, as endosperm cell number and size are determined within the first few days after pollination.

Much of the increase in corn yield of the past several decades has resulted from an increase in planting density. During that period, corn yield has been increasing at a rate of 2.1 bushels/acre/year, but the planting density has increased at a rate of 250 plants/acre/year. A characteristic of modern hybrid corn is the ability of these varieties to be planted at high density. Many studies have shown that a higher than current planting density should result in more biomass production, but current germplasm does not perform well at these higher densities. One approach to increasing yield is to increase harvest index (HI), the proportion of biomass that is allocated to the kernel compared to total biomass, in high density plantings.

Effective yield selection of enhanced yielding transgenic corn events uses hybrid progeny of the transgenic event over multiple locations with plants grown under optimal production management practices, and maximum pest control. A useful target for increased yield is a 5% to 10% increase in yield as compared to yield produced by plants grown from seed for a control plant. Selection methods can be applied in multiple and diverse geographic locations, for example up to 16 or more locations, over one or more planting seasons, for example at least two planting seasons to statistically distinguish yield improvement from natural environmental effects. Each of the transgenic corn plants and soybean plants with a nucleus of the invention prepared in Examples 6 and 7 are screened for yield enhancement. At least one event from each of the corn plants is selected as having at least between 3 and 5% increase in yield as compared to a control plant as having a nucleus of this invention.

C. Selection for Enhanced Water Use Efficiency (WUE)

The following is a high-throughput method for screening for water use efficiency in a greenhouse to identify the transgenic corn plants with a nucleus of this invention. This selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment. The hydration status of the shoot tissues following the drought is also measured. The plant heights are measured at three time points. The first is taken just prior to the onset drought when the plant is 11 days old, which is the shoot initial height (SIH). The plant height is also measured halfway throughout the drought/re-water regimen, on day 18 after planting, to give rise to the shoot mid-drought height (SMH). Upon the completion of the final drought cycle on day 26 after planting, the shoot portion of the plant is harvested and measured for a final height, which is the shoot wilt height (SWH) and also measured for shoot wilted biomass (SWM). The shoot is placed in water at 40 degree Celsius in the dark. Three days later, the shoot is weighted to give rise to the shoot turgid weight (STM). After drying in an oven for four days, the shoots are weighted for shoot dry biomass (SDM). The shoot average height (SAH) is the mean plant height across the 3 height measurements. The procedure described above can be adjusted for +/- ~one day for each step given the situation.

To correct for slight differences between plants, a size corrected growth value is derived from STH and SWH. This is the Relative Growth Rate (RGR). Relative Growth Rate (RGR) is calculated for each shoot using the formula [RGR %=(SWH−SIH)/((SWH+SIH)/2)×100]. Relative water content (RWC) is a measurement of how much (%) of the plant was water at harvest. Water Content (RWC) is calculated for each shoot using the formula [RWC %=(SWM−SDM)/(STM−SDM)×100]. Fully watered corn plants of this age run around 98% RWC.

Transgenic corn plants and soybean plants prepared in Examples 6 and 7 are screened for water use efficiency. Transgenic plants having at least a 1% increase in RGR and RWC as compared to control plants are identified as having enhanced water used efficiency and are selected as having a nucleus of this invention. Transgenic corn and soybean plants having in their nucleus DNA identified in Table 3 as imparting drought tolerance enhancement (DS, HS, SS, and PEG) and homologous DNA are identified as showing increased water use efficiency as compared to control plants and are selected as having a nucleus of this invention.

D. Selection for Growth Under Cold Stress

Cold Germination Assay—

Three sets of seeds are used for the assay. The first set consists of positive transgenic events (F 1 hybrid) where the genes of the present invention are expressed in the seed. The second seed set is nontransgenic, wild-type negative control made from the same genotype as the transgenic events. The third set consisted of two cold tolerant and one cold sensitive commercial check lines of corn. All seeds are treated with a fungicide "Captan" (MAESTRO® 80DF Fungicide, Arvesta Corporation, San Francisco, Calif., USA). 0.43 mL Captan is applied per 45 g of corn seeds by mixing it well and drying the fungicide prior to the demonstration.

Corn kernels are placed embryo side down on blotter paper within an individual cell (8.9×8.9 cm) of a germination tray (54×36 cm). Ten seeds from an event are placed into one cell of the germination tray. Each tray can hold 21 transgenic events and 3 replicates of wildtype (LH244SDms+LH59), which is randomized in a complete block design. For every event there are five replications (five trays). The trays are placed at 9.7 C for 24 days (no light) in a Convrion® growth chamber (Conviron Model PGV36, Controlled Environments, Winnipeg, Canada). Two hundred and fifty milliliters of deionized water are added to each germination tray. Germination counts are taken 10th, 11th, 12th, 13th, 14th, 17th, 19th, 21st, and 24th day after start date of the demonstration. Seeds are considered germinated if the emerged radical size is 1 cm. From the germination counts germination index is calculated.

The germination index is calculated as per:

Germination index=$(\Sigma([T+1-n_i]*[P_i-P_{i-1}]))/T$ where T is the total number of days for which the germination assay is performed. The number of days after planting is defined by n. "i" indicated the number of times the germination had been counted, including the current day. P is the percentage of seeds germinated during any given rating. Statistical differences are calculated between transgenic events and wild type control. After statistical analysis, the events that show a statistical significance at the p level of less than 0.1 relative to wild-type controls will advance to a secondary cold selection. The secondary cold screen is conducted in the same manner of the primary selection only increasing the number of repetitions to ten. Statistical analysis of the data from the secondary selection is conducted to identify the events that show a statistical significance at the p level of less than 0.05 relative to wild-type controls.

Transgenic corn plants and soybean plants prepared in Examples 6 and 7 are screened for water use efficiency. Transgenic plants having at least a 5% increase in germination index as compared to control plants are identified as having enhanced cold stress tolerance and are selected as having a nucleus of this invention. Transgenic corn and soybean plants having in their nucleus DNA identified in Table 3 as imparting cold tolerance enhancement (CK or CS) and homologous DNA are identified as showing increased cold stress tolerance as compared to control plants and are selected as having a nucleus of this invention.

E. Screens for Transgenic Plant Seeds with Increased Protein and/or Oil Levels

The following is a high-throughput selection method for identifying plant seeds with improvement in seed composition using the Infratec® 1200 series Grain Analyzer, which is a near-infrared transmittance spectrometer used to determine the composition of a bulk seed sample. Near infrared analysis is a non-destructive, high-throughput method that can analyze multiple traits in a single sample scan. An NIR calibration for the analytes of interest is used to predict the values of an unknown sample. The NIR spectrum is obtained for the sample and compared to the calibration using a complex chemometric software package that provides a predicted values as well as information on how well the sample fits in the calibration.

Infratec® Model 1221, 1225, or 1227 analyzer with transport module by Foss North America is used with cuvette, item #1000-4033, Foss North America or for small samples with small cell cuvette, Foss standard cuvette modified by Leon Girard Co. Corn and soy check samples of varying composition maintained in check cell cuvettes are supplied by Leon Girard Co. NIT collection software is provided by Maximum Consulting Inc. Calculations are performed automatically by the software. Seed samples are received in packets or containers with barcode labels from the customer. The seed is poured into the cuvettes and analyzed as received.

TABLE 23

| | |
|---|---|
| Typical sample(s): | Whole grain corn and soybean seeds |
| Analytical time to run method: | Less than 0.75 min per sample |
| Total elapsed time per run: | 1.5 minute per sample |
| Typical and minimum sample size: | Corn typical: 50 cc; minimum 30 cc<br>Soybean typical: 50 cc; minimum 5 cc |
| Typical analytical range: | Determined in part by the specific calibration.<br>Corn - moisture 5-15%, oil 5-20%, protein 5-30%, starch 50-75%, and density 1.0-1.3%.<br>Soybean - moisture 5-15%, oil 15-25%, and protein 35-50%. |

Transgenic corn plants and soybean plants prepared in Examples 6 and 7 are screened for increased protein and oil in seed. Transgenic inbred corn and soybean plants having an increase of at least 1 percentage point in the total percent seed protein or at least 0.3 percentage point in total seed oil and transgenic hybrid corn plants having an increase of at least 0.4 percentage point in the total percent seed protein as compared to control plants are identified as having enhanced seed protein or enhanced seed oil and are selected as having a nucleus of this invention.

Example 9. Cotton Transgenic Plants with Enhanced Agronomic Traits

Cotton transformation is performed as generally described in WO0036911 and in U.S. Pat. No. 5,846,797 and are incorporated herein by reference. Transgenic cotton plants containing each of the recombinant DNA having a sequence of SEQ ID NO: 1 through SEQ ID NO: 139 are obtained by transforming with recombinant DNA from each of the genes identified in Table 1. Progeny transgenic plants are selected from a population of transgenic cotton events under specified growing conditions and are compared with control cotton plants. Control cotton plants are substantially the same cotton genotype but without the recombinant DNA, for example, either a parental cotton plant of the same genotype that was not transformed with the identical recombinant DNA or a negative isoline of the transformed plant. Additionally, a commercial cotton cultivar adapted to the geographical region and cultivation conditions, i.e. cotton variety ST474, cotton variety FM 958, and cotton variety Siokra L-23, are used to compare the relative performance of the transgenic cotton plants containing the recombinant DNA. The specified culture conditions are growing a first set of transgenic and control plants under "wet" conditions, e.g., irrigated in the range of 85 to 100 percent of evapotranspiration to provide leaf water potential of −14 to −18 bars, and growing a second set of transgenic and control plants under "dry" conditions, e.g., irrigated in the range of 40 to 60 percent of evapotranspiration to provide a leaf water potential of −21 to −25 bars. Pest control, such as weed and insect control is applied equally to both wet and dry treatments as needed. Data gathered during the trial includes weather records throughout the growing season including detailed records of rainfall; soil characterization information; any herbicide or insecticide applications: any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for the trial area. Enhanced water use efficiency is indicated by increased yield, improved relative water content, enhanced leaf water potential, increased biomass, enhanced leaf extension rates, and improved fiber parameters.

The transgenic cotton plants of this invention are identified from among the transgenic cotton plants by agronomic trait screening as having increased yield and enhanced water use efficiency.

Example 10. Canola Plants with Enhanced Agrominic Traits

This example illustrates plant transformation useful in producing the transgenic canola plants of this invention and the production and identification of transgenic seed for transgenic canola having enhanced water use efficiency, enhanced cold tolerance, increased yield, enhanced nitrogen use efficiency, enhanced seed protein and enhanced seed oil.

Tissues from in vitro grown canola seedlings are prepared and inoculated with a suspension of overnight grown *Agrobacterium* containing plasmid DNA with the gene of interest cassette and a plant selectable marker cassette. Following co-cultivation with *Agrobacterium*, the infected tissues are allowed to grow on selection to promote growth of transgenic shoots, followed by growth of roots from the transgenic shoots. The selected plantlets are then transferred to the greenhouse and potted in soil. Molecular characterizations are performed to confirm the presence of the gene of interest, and its expression in transgenic plants and progenies. Progeny transgenic plants are selected from a population of transgenic canola events under specified growing conditions and are compared with control canola plants. Control canola plants are substantially the same canola genotype but without the recombinant DNA, for example, either a parental canola plant of the same genotype that is not transformed with the identical recombinant DNA or a negative isoline of the transformed plant Transgenic canola plant cells are transformed with recombinant DNA from each of the genes identified in Table 2. Transgenic progeny plants and seed of the transformed plant cells are screened for enhanced water use efficiency, enhanced cold tolerance, increased yield, enhanced nitrogen use efficiency, enhanced seed protein and enhanced seed oil.

Example 11. Monocot and Dicot Plant Transformation for the Suppression of Endogeneous Protein This example illustrates monocot and dicot plant transformation to produce nuclei of this invention in cells of a transgenic plant by transformation where the recombinant DNA suppresses the expression of an endogenous protein identified in Table 24.

Corn, soybean, cotton, or canola tissue are transformed as describe in Examples 6, 7, 9 or 10 using recombinant DNA in the nucleus with DNA that transcribes to RNA that forms double-stranded RNA targeted to an endogenous gene with DNA encoding the protein. The genes for which the double-stranded RNAs are targeted are the native gene in corn and soybean that are homolog of the genes encoding the protein of *Arabidopsis thaliana* as identified in table 24.

Populations of transgenic plants prepared in Examples 5, 6, 7, 9 or 10 with DNA for suppressing a gene identified in Table 2 as providing an enhanced trait by gene suppression are screened to identify an event from those plants with a nucleus of the invention by selecting the trait identified in this specification.

TABLE 24

| PEP SEQ ID | Pfam module | Construct ID | Traits |
|---|---|---|---|
| 142 | RWP-RK | 70733 | SP |
| 144 | AUX_IAA | 15707 | SS |
| 151 | SRF-TF | 10106 | LN |
| 197 | zf-C3HC4 | 10456 | LL |
| 198 | Myb_DNA-binding | 11115 | PEG |
| 206 | CCT | 10362 | HS |
| 250 | PHD | 12179 | HS |
| 273 | EIN3 | 10114 | SS |
| 275 | AP2 | 10804 | LN |

SEQUENCE LISTING (6034 sequences)

SEQ ID NO: 1 - DNA, 1668 bp, Arabidopsis thaliana
atgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaagacatagatggactggtagatatgaagctcatctatgggacaatagtttcaagaaggaaggtcacagtagaaaaggaagacaagtttatctgggaggttatgatatggaggagaaagctgctcgagcatatgatcttgctgcactcaagtactggggtccctctactcacaccaatttctctgcggagaattatcagaaagagattgaagacatgaagaacatgactagacaagaatatgttgcacatttgagaaggaagagcagtggtttctctaggggtgcttccatctatagaggagtcacaagacatcaccagcatggaaggtggcaagcacggattggtagagtcgctggaaacaaagatctctaccttggaacttttggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttga

SEQ ID NO: 2 - DNA, 1131 bp, Arabidopsis thaliana
atgacgaagaaactcaatccactggaagatccaccaacggcaacttcaagcgacgaagatgacgtcgagacttccgaagctggtgaagcttcagacgattcctcttcatctgaagaagacgtaccaatcaaaattcgaatcaaatccccttccgccacaaccgccgccgctcctccagctaaatccaccgccgtctccaccgccgctgattcagattctggatccgagactgaaacagattcggattctgaatcaacaaatccaccgaattctggatctgggaagacaatcgctttaaacacagtgaatctaaagaagaaagaggatccaacgtcgtcgtcagctactttagctttaccggcgatgaaatcaggaacaaaacggccagcgagtgaagctgctgctacgacttcaacgaaacgagtgaagaaagatgaagagagtgtgaagaaaccaggaggttttcaaagactatggagtgaagaagacgaaatcttagtgttacaaggaatgattgatttcaaagctgatacagggaagtctccttatgtagatactaatgcgttttacgatttcttgaagaaatcgattagctttgaggttagtaagaatcaattcatggataagattaggagtttaaggaagaagtatattggtaaagaaggaaggaacgaacctagttttgtgaaagctcatgataagaaagcttttgaattgtctaagtttatttggggacctaaaggaatagctcttgattctaatgttaagtcgaacggtgtatcgaaaaagagtgtggcgaagaagaagattgattctgttaagcaagagttggtgtttgccggtggttcttcaactaatggtaaaaaagttgaagaagatggtggtgatgatggatgtgattggtttgataactcgtctcttgttaggatgattgctagtttgggtgttgatgagtattatgtgaagcagcaatggagtttggtttcggttgagagtaagaagattgttgaagagaagtataagttgttgcaagctaaggagttggaatttgtgttggagaagactaagtttttgaatgaggttgcttctatgttcgttgaagcttctaagaacaagccattagatacatag

SEQ ID NO: 3 - DNA, 982 bp, Arabidopsis thaliana
atgagttcgtcaaaacattcctctgtttttaactattctgctctgtttctatcactgtttcttcaacaaatggatcagaactctcttcatcatctcgattctccaaaaatcgaaaacgagtatgaaccagattcgttatacgacatgttagataagtaagttggaaaccctttgatactttttcttgctaaacaagttatctctcttttctttactgttttttctcattcgtttttggtctacaggttgcctccgcttgattctctcctagatatggaagatttgaaaccaaatgcagggttgcactttcagttccattacaatagctttgaagatttcttcgaaaacattgaagtggataacacaattccatctgatattcacttgttgacacaagagccctacttctcaagtgactcctcttcctcttcaccattggctatccaaaacgacggtctcatttccaacgtgaaagttgaaaaggtaacagttaagaagaagaggaaccttaagaaaaagaggcaagacaaattggagatgtctgagatcaaacaatttttcgataggccgatcatgaaagcggctaaagaactgaacgtgggactcactgtgttgaagaagcgatgcagggaattaggaatttaccggtggcctcaccggaagctcaagagtctaaactctcttataaagaatctcaaggtgcaacaacattaatttattaatagcatttgcttgtgattcacgagtagcgttttaggttttattatattacgttcttgatttcgaaaggttaatagtttgttcatgtttttggtgatagaatgttggaatggaagaggaagtgaagaacttggaggaacataggtttcttattgaacaagaacctgatgcagaactcagtgatggaaccaagaagctaaggcaagcttgtttcaaagccaattataagagaagaaaatcacttggtgatgattattattga

SEQ ID NO: 4 - DNA, 1022 bp, Arabidopsis thaliana
atggaacaccaaggttggagttttgaggagaattatagtttgtccactaatagaagatctatcaggtattatttaataatctttgatctaatgttttcattcattaaaaaaaaaactttataatatagtctgtgtgtgtgtgtattgatgtctaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgtatgcttcctttaattctaactcatgataattacttcttgaaaacgtaatcttggtctatctcagagagtaatacataatacattttgcaggcaatcggtaacaagtcgaaccaacgatcaggatcaaaccgaaggagtcgagcagctgaagttcataatctctccgaaagggtacttcatcggttcgtctatataatatataatatatag

SEQ ID NO: 5 - DNA, 1443 bp, Arabidopsis thaliana
ttaattaaagagccagctcttgctcctcctgctttgagtcctgttccaatgcctaggcctaagaggcccagatcaaatatagcaccttcatctcctgactcttcgatgcttaccagagaaggtacaactaaggcaaacatggaccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaaacaaacaaaataaccaacaaccggcgcgcc

SEQ ID NO: 6 - DNA, 636 bp, Arabidopsis thaliana
atgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataa

SEQ ID NO: 7 - DNA, 750 bp, Arabidopsis thaliana
atgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactag

SEQ ID NO: 8 - DNA, 633 bp, Arabidopsis thaliana
atggcgagagaaaagattcagatcaggaagatcgacaacgcaacggcgagacaagtgacgttttcgaaacgaagaagagggcttttcaagaaagctgaagaactctccgttctctgcgacgccgatgtcgctctcatcatcttctcttccaccggaaaactgttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaagtatgtgtcttaccctctctgttgataacaaatccctttcttttgtctaccattaacgtacacacccctaaatttaatccccagttgtctacaacacatatgtttgatcatactgtgagataa

SEQ ID NO: 9 - DNA, 786 bp, Arabidopsis thaliana
atggcgaatctctcttctgattttcagacatttacaatggatgatcccataagacaactagcagaactgagcaacacgcttcatcatttccaaacatttcctcctcctttctcttcttctctcgattctcttttctttcataatcaattccctgatcattttcccggaaaatctctcgagaataattttcatcaagggatattcttcccttctaatatccaaaacaacgaagagtcttcttcacaattcgataccaagaagagaaaatcattaatggaagctgtttctacgtcggagaacagtgtctctgatcaaactctctctacctcttctgctcaagtttccataaatggaaatatttcgacaaaaaataattcttcaaggagagggaagaggtcgaagaatagagaagaagagaaagagagagaagttgttcatgttagagctagaagaggccaagccactgatagccacagcatagcagaacgggttcgacgagggaaaataaacgagagattgaaatgcttgcaagatatagtccccggatgttataagacaatgggaatggctactatgcttgatgagataattaattacgtccagtccttacaaaatcaagtcgagtttttatctatgaagcttacagcagcaagttcgtattatgactttaactcggagactgatgctgtggaatccatgcagaaggcaaaggcacgtgaggcagtggagatgggtcaagggagggatgggagttctgtcttccattcatcatcgtggaccctttga

SEQ ID NO: 10 - DNA, 963 bp, Arabidopsis thaliana
atgtatccatcaatcgaagacgatgatgatcttctcgctgctctttgttttgatcaaagcaatggagtagaagatccttatggatatatgcaaacaaatgaagataacatatttcaggattttgggtcttgtggtgtgaatctgatgcagccacaacaagaacaatttgattcttttaatggaaatcttgagcaagtttgtagtagctttagaggaggaaacaatggagttgtttatagtagtagcattggatcagcacaattggatttggctgcatcgtttagtggagttttgcagcaagagacacatcaagtctgtggctttagaggacaaaacgacgattctgcagtgcctcatttgcagcagcaacaaggacaggtgtttagtggtgtagtggaaatcaattcttcgtcatctgttggagctgttaaggaagagtttgaggaagaatgttcggggaagaggagacgaactggatcatgtagcaagccaggaaccaaagcctgtcgcgagaaactaagaagggaaaagctaaatgacaagttcatggacttgagctctgttttagagcctggcaggactccaaagacggataaatcagctatactcgacgatgcaatccgggttgtgaatcagcttagaggtgaagctcatgagcttcaagaaaccaaccaaaagcttctagaagagatcaagagtctaaaggcggataaaaacgagctacgagaggaaaagctggtgttgaaggcggagaaggagaagatggagcaacagttaaaatctatggtggttccatcaccaggtttcatgccctcccagcatccagcagctttccattcccataagatggcggtggcttacccttacggctactatcctccaaacatgccaatgtggtcacccttacctcctgctgaccgtgatacgtctcgtgatctcaaaaatcttcctcctgttgcttaa

SEQ ID NO: 11 - DNA, 1606 bp, Arabidopsis thaliana
ttaattaaatggagcttcctcaacctcgtcccttcaaaacccaagggagaaaaccaacacatgattttttatcgctctgcagtcattcaaccgtccacccagatccaaagccaacaccaccaccttcttctcaaggtagtcacttgaaaacccatgattttcttcaaccgttagaatgtgttggtgctaaagaagacgtaagtaggattaactctaccactacagcgtccgagaagccaccgccccctgctccacctccaccgttgcagcacgtgcttcccggtggtatagggacttatacgattagccccattccttacttccatcatcatcatcagagaattcctaagccggagttgtcaccaccaatgatgttcaatgctaatgagagaaacgttttggatgagaattctaactctaattgcagctcgtacgccgctgcatcaagcgggttcactctgtgggatgaatctgcttctgggaagaagggacagacaaggaaggagaatagtgttggggagagagtaaacatgagagctgatgttgcagcaactgtgggacaatggccagtggcggagagacggtcccagtctttgacaaacaaccatatgagcggtttcagttctctctcttcctctcaagggtctgtgcttaagagccagagcttcatggacatgataaggtcagcaaaaggaagttcacaggaagatgatttagatgatgaagaagattttatcatgaagaaagaaagctcctcgactagccagagccatagagtggatttgagggtaaaagcagatgtgagaggctctcctaacgatcaaaagctgaacacacctaggtctaaacattctgctacagagcaacggagaaggagcaagatcaatgatagatttcagatgttgagacaactaatacctaacagcgaccaaaagcgggataaggcctccttcctactagaggttatcgagtatattcaattcttacaagagaaagcagacaagtatgtgacctcttaccaaggatggaatcacgaacctgcgaagctattgaattggcagagtaacaacaaccaacagctagtacctgaaggagttgcttttgctccaaaattggaagaagagaaaaacaacattccggtttcggtccttgcaactgcacaaggtgttgttattgatcatccaacaaccgcgacgacctctccatttccattgtcgattcaaagcaacagttttttctctcctgtgattgcgggtaatcccgtaccccagttccacgcaagagtcgcatcatcagaggctgtagagccaagtccgagttcccggagtcaaaaagaagaagaagatgaggaagttcttgagggtaacatcagaatttcaagtgtttactcacaaggattagtgaaaacactgagagaagcattggagaattcaggagtggacttaacgaaagcaagcatctccgttgaaatcgagctcgctaaacaatcctcgtcttcttccttcaaggatcatgaagttcgtgaaccggtttctcgaaccagaaacgacaatgtcaagcaaactcggaaaccaaaacggctcaagacgggacagtagggcgcgcc

SEQ ID NO: 12 - DNA, 771 bp, Arabidopsis thaliana
atgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataagggaaaactcttcgaatactccactgattcttgtatggagaagatacttgaacgctatgagaggtactcttacgccgaaagacagcttattgcacctgagtccgacgtcaatacaaactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaaggagaaggccatacaggagcaaaacagcatgctttctaaacagatcaaggagagggaaaaaattcttagggctcaacaggagcagtgggatcagcagaaccaaggccacaatatgcctccccctctgccaccgcagcagcaccaaatccagcatccttacatgctctctcatcagccatctccttttctcaacatgggtggtctgtatcaagaagatgatcctatggcaatgaggaggaatgatctcgaactgactcttgaacccgtttacaactgcaaccttggctgcttcgccgcatga

SEQ ID NO: 13 - DNA, 878 bp, Arabidopsis thaliana
aactctttgtttcttgtttgttgattaacccttaattaaatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcgcgccaaaaattggagctctgcagagctttcgttcgtatcatcg

SEQ ID NO: 14 - DNA, 991 bp, Arabidopsis thaliana
ttaattaaatggataatataatgcaatcgtcaatgccaccgggattccgatttcatccgacagaggaagagcttgtgggttattacctagataggaagatcaattcaatgaagagtgctttagatgtcattgtagagattgatctctacaaaatggagccatgggatatacaagcgaggtgtaaactagggtatgaagagcaaaacgagtggtacttctttagtcataaggacaggaagtaccctaccgggactaggaccaaccgagccactgcggctgggttctggaaagccacgggtagagacaaggcggtactatcaaaaaacagtgtcatcggaatgcggaagacacttgtctactacaagggtcgagctcctaatggaagaaagtccgattggatcatgcacgaataccgtctccaaaactccgagcttgccccggttcaggaggaaggctgggtggtgtgtcgagcatttaggaagccaattccaaaccagaggccattagggtacgagccatggcagaaccagctctaccacgtcgaaagtagtaacaactactcatcttcagtgacaatgaacacgagtcatcatatcggtgcatcttcatcaagtcataaccttaatcaaatgctcatgagcaataaccactacaatcctaataatacatcctcatcgatgcatcaatatggcaacattgagctcccgcagttggacagcccgagcttgtcgcctagtttagggacgaataaagatcagaacgagagtttcgagcaagaagaagagaagagctttaactgtgtggattggagaacactagataccttgcttgagacacaagtcatacatccgcataaccctaatattcttatgttcgaaacgcagtcgtataatccggcgccaagcttcccttccatgcatcaaagctataatgaggtcgaagctaatattcatcattctcttggatgcttccctgactcgtaaggcgcgcc

SEQ ID NO: 15 - DNA, 948 bp, Arabidopsis thaliana
atggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaa

SEQ ID NO: 16 - DNA, 1035 bp, Arabidopsis thaliana
atgtacgcaatgaaagaagaagactgtcttcaaacatttcacaacttacaagactatcaagaccagtttcatcttcatcatcatccacaaattctcccctggtcgtcgacatctttaccttcttttgacccactccatttcccatctaacccgacccgttattctgacccggttcactacttcaacagaagagcttcttcttcctcttcttcttttgactataacgacggttttgtctctcctcctccttccatggatcatcctcagaaccatctaaggattttatccgaagctcttggacccatcatgcgtcgtggctcgtcctttgggttcgatggtgagatcatgggaaaattgagtgcacaagaagtcatggatgctaaggctttagctgcttcaaagagtcatagtgaagctgagagaagaagacgagagagaatcaacactcatcttgctaagctgcgtagtatattaccaaacacaaccaaaacggacaaagcttctttgctagcggaagtgatccaacacatgaaggagctaaaacgacaaacatcacagatcaccgacacgtatcaagtcccaacagagtgcgatgatctgaccgtagattcgtcttacaacgacgaggaaggaaacttggtgataagagcatccttttgctgccaagacaggactgacctcatgcatgacgtcatcaatgccttaaagtctcttcgtcttcgaactctcaaagctgagatcgcaaccgtaggtggtagagtcaagaacatcttgttcttgagccgagaatacgatgatgaagaagatcatgattcatatcgtagaaacttcgatggtgatgacgtggaggattatgatgaagagaggatgatgaataatcgtgtgagttcgatagaagaagcgttaaaggcggttatagagaagtgtgttcataataatgatgaaagtaacgataacaataacttggagaaatcatcttcagggggtattaagaggcaaaggactagtaagatggtgaatcgatgttataattag

SEQ ID NO: 17 - DNA, 735 bp, Arabidopsis thaliana
atgaggaaagggagaggctcttccgtcgttggacccgcccttccagtaaccgccggtggatctgtgaaggagccgaggtatagaggcgttaggaagagaccttggggtcgattcgcagctgagatccgtgatccattaaaaaaatctcgtgtctggctcggtactttcgattccgccgtagatgctgcacgcgcttacgataccgccgcacgtaacctccgtggtccaaaggccaagaccaatttcccgatcgattgttctccttcttctcctctccaacctctcacctacctccacaatcaaaacctctgttctcctccggtgattcagaaccagatcgatccgtttatggaccatcggttatacggcggaggtaatttccaggagcagcagcagcagcagattattagtcggccggcgagtagcagcatgagcagcaccgttaaatcttgtagcggaccgagaccgatggaagccgcggcggcgtcttcgtcggtggcgaaaccgttacatgcgattaagagatatccgagaactccaccggtagctccggaggattgtcatagcgactgcgattcttcgtcgtctgttattgacgacggagatgatatcgcatcttcgtcttcccgccggaaaacgccgtttcagtttgatcttaatttcccgccgttggatggcgttgacttattcgctggcgggatagatgatctccactgtaccgatctacgtctctga

SEQ ID NO: 18 - DNA, 366 bp, Arabidopsis thaliana
atgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctga

SEQ ID NO: 19 - DNA, 631 bp, Arabidopsis thaliana
ttaattaaatggcgacagaacaagaagctgaagttggaacagagacatcctctgtttccggaaggtttttgaggaacagagatttatatctcttcttgccttttctcttaggcttctctgatcaagaatcatcaaacggagatgatgatgatgttgcttcatcgcgtgagagaatcattttagtcaacccttttacacaaggaatgattgtgctcgaaggctcatcaggaatgaatcctctgcttcgtagcttactggagtcacgtgaggaaggtcgtcctcctgcgtccaaggcttccatcgatgcgatgccgatcgttgagattgatggctgtgaaggagagtgtgtgatctgtttggaggagtggaagtccgaggagacggtgaaggagatgccgtgtaagcataggtttcacggtggatgtatagagaaatggttagggtttcatgggtcgtgtcctgtttgtaggtacgagatgcctgttgatggagatgagattgggaagaaaagaaacgatgggaatgagatttgggttaggttcagtttcaacgatggtcggagaattagagatttttctgcgcaggacggtggaaacagtgatggtgttgagtccgagaattagggcgcgcc

SEQ ID NO: 20 - DNA, 2496 bp, Arabidopsis thaliana
acaagtttgtacaaaaaagcaggctcctgcaggaccgttttcttcttgtctccttttgctcttaaaagagaagctttttcaatggaatttgacttgaatactgagattgcggaggtggaagaggaggagaatgatgatgtaggagtaggagtaggaggaggaacaagaattgacaagggtaggcttggaatttcaccatcttcttcttcttcatgctcttccggatcatcatcgtcatcatcttctacaggctctgcatcttccatttactctgagctttggcatgcttgtgctggtcctctcacttgtcttcccaagaaaggcaatgtagttgtctatttccctcaaggtcatttggagcaagatgctatggtttcatattcgtctcctcttgaaatccccaaatttgaccttaatccccaaatcgtctgcagggtggttaatgtccagttgcttgctaataaggacaccgatgaggtctacactcaagtcactctgcttccacttcaagagttttcgatgctaaatggggaggggaaagaggtcaaggagttaggaggggaggaagagaggaacggaagctcatccgtcaagcggacacctcatatgttctgtaaaaccttaacagcgtctgacacaagcacacatggaggcttctctgtacctagaagagccgctgaagattgttttgctcctcttgactacaaacaacagaggccatctcaagagctcattgcaaaggacctccatggagtagagtggaagtttcgccatatctatagaggtcaaccaaggaggcatctactcaccactggttggagtatctttgtcagtcaaaagaatctcgtctctggtgatgcggttctctttctgagagacgaaggaggagagctgagattaggaatcagaagagcagcacggccaagaaatggacttcctgactcaatcattgagaagaattcatgttcaaacattctgtctcttgtggctaatgctgtatctacaaaaagcatgtttcatgtgttctacagtccacgagcgacgcatgcagagtttgtgattccttatgagaagtatatcacaagcatcaggagtcctgtttgcataggcacaagatttagaatgcgatttgaaatggacgattctcctgagagaagatgcgctggtgtagtgactggagtctgtgacttggacccgtataggtggccaaactctaaatggaggtgcttgttggtgcgatgggatgagtcttttgtgagtgatcatcaagaaagagtttcaccttgggagattgatccctcggtttctctcccacacttgagcattcagtcatctccaaggcctaaaaggccatgggcaggtttactggatactaccccacccggaaaccccataacaaaaaggggtggttttttggactttgaggagtcggttagaccctctaaggtcttgcaaggtcaagaaaatataggttctgcatcaccctcacaggggtttgatgttatgaaccgccggatactggattttgcgatgcagtctcatgcaaatccagttcttgtgtcgagtagagtcaaggatcgatttggtgagtttgtagatgctactggcgtgaacccagcttgttcaggtgttatggacctggataggtttccaagggtcttgcaaggtcaagaaatttgctcgcttaaatcattcccgcaatttgctggtttcagtccagctgctgctcctaatccctttgcttaccaagccaacaagtcaagttactatccgctagctttgcatgggattaggagcactcatgttccgtatcagaatccatacaatgcgggaaaccaatcctcgggtcccccttcacgtgcaataaactttggtgaagagactagaaagtttgatgcacaaaatgaaggtggcctaccaaataatgttacagctgatttgccattcaagattgatatgatgggaaaacagaaaggcagtgagttgaatatgaatgcttcatcaggatgtaaacttttcggattctccttaccagtggagacacctgcatctaagccgcaaagctcgagcaaaagaatctgtacaaaggttcacaagcaaggaagccaagtggggagagctattgatttgtcgcgacttaacgggtatgatgatctccttatggagcttgaacggctgttcaacatggaagggcttctcagggatcctgaaaaaggatggaggatcttatatactgatagtgagaacgatatgatggtcgttggcgatgatccatggcatgatttctgcaatgtggtgtggaagatacacttatacacgaaagaggaagtggagaatgcgaatgacgataacaagagttgtttagagcaagctgctctcatgatggaagcatcaaagtcatcttctgtgagccagcctgattcttctcctacaatcactagggtttgatacccataaagaagcttctcgagacccagctttcttgtacaaagtggt

SEQ ID NO: 21 - DNA, 2400 bp, Arabidopsis thaliana
ttaattaaatcgcttgtggcaatcacatcatctgtgttatgcatccaagtaatggtgtcacataaagtcttagaatttggagatgatggttacaaattacctgctcaagctcgagctccgagatcactccgggtaaatgaccctttgctatattctctgtttagctgttaaagaatttatcagttacatgaatgatcactcgcatgtttgttcacatttttgctagaagaagcgcatttacgaaaagaagataccaggagatgataagatgtgcgcgattgacttattggccaccgtagctggaagcttgcttctcgagagcaaaagtccggtaaacgcgtgtctagttgtacaaaatactgtaaagaatgaatacccggctgatgaaaaccccgtaaaggcggttccttattcggaatccccgagcctatttgacaatggcaagtgtggatttagctctgtgataacaaatcctaatcacttgttggtaggtgacaaagtaggaaaggaggtggagggttttagtagtttgggtgtgagtggtgatgtaaagcctgatgttgtagctagtataggtagtaacagtagtaccgaggtgggagcatgtgggaacggtagtcccaacgagtctcgggatgatgtaaatttgtttagtagaaatgatgatgatgaaaacttttcgggttacattcgaactcgtatgactaggcctgtgcctcgtattggagacagaagaattaggaagatattggcatctagacattggaaaggaggttcgaagaacaacacaggtaaaatcgccttttgttttagttttgactatctttattattgtgatttgatgtttggtatttgtagatgcaaagccatggtattgctcaaagaggagttattacttgcaccatcatcagaggagttatcccatcaagaaaaggaaatactttgacagtgtttacgactcgaactctgatgattaccgtttgcaaggaaagactcataaaggtccaaaacttgtaatcttctcattctcttgttagtatgttgtaagtctttgctgttgtaacacggttttgcaaattcatccgcaggaagcagaacaatatcttccatgaaaagtcgaaatgcgtcctttgtgtcaagggatcatcatggtaatttaatggagtctcaagtctcaatctatcctttgttcgcttattgtttcgttgaaatatttttgttttgttttgttactctttagtgaagctgcggatcaagtcttttagggtgcctgagcttttcgtagagattccagaaactgctactgttggctccttgaaggtgtaataacaaaacctagttgtgctgaaaatcctgatcaagaagaacttatatttgtatttttgtaatgtcggggttgtcagcggatggtgatggaagcagtgaccaccatactgggtgatggacttcgagtcgggctgatggttcaaggaaagaaagtccgagatgatggcaaaactcttcttcagactgggatctctgaggagaacaaccacttggattctcttggtttcagccttgaacctagcttagagaccacccctcaaccactgttatccaggttcactcttctcttcactctcagagatgccacatcgataaaaaatcaatcttttgcggcttaagggccttgttttctctctgccagttatctgtcagatcatgcctgtgatgatgtgacgttatgccacgacaatgcgttggattctagtcatgagccagaaccatccccagctgactcatttgggaaactaggcacaagtgatcattctagagctttgattcctgttgcctcagcagcaatgctggctcctcggcctcctaaccgtaagtttaaaaggactgagcagcagctagctgcacaacgcagaattcgtcgacctttctcagttactgaagtagaagcactggtccaagccgttgagaaactcggaaccggaaggtacaaaacaaagaaatagcactttctcttcttcatgttgctgacaaaatgtgtttgaaaactacaggtggagagatgtgaaggttcgtgctttcgaggacgcagaccatcgtacctatgttgatctcaaggttagttagttttttaactaactcttaaccttaatatatacagtttggtattgagtctttgcctttgtaggataagtggaagacgctggtccacacggcaaggatatctccacaacagcggagaggagagccggtgccacaggaacttctggaccgtgttttgaaggcacacgcttactggtcacaacacctaatgcatcaactgcagactgagccaccatccactcaggtagaggctctctaatctgaacaggttcttggtctaaagaaccttgtgtattatggcgc

SEQ ID NO: 22 - DNA, 1404 bp, Arabidopsis thaliana
atggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcccccttttttcttcttccttttatttactcattttgccatttccggtgatcggaatagttctaagggaaccatagctttacgcttttttcaggttttatgttccttttgagctttttgagttttggctcttaacgtcattgaagagtcttatcaaaacttaaactttacagctagttattatgtggtcttgtctcttgtcttatgcattatttaggttgcttttctttgaagctttcttttctttatatcaaatcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggttagatcccaatatacacagcccttttcagctcaatgagtctcaaaaacaagttattgaatttcctgtgtgtcaggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcaccacaatgggtggatttgagctgtatcttcatcagcaggttctgaagcaatacatggaacccgagaacacaagagcttatgactcctctcctcaacatttcaattggtctctttgag

SEQ ID NO: 23 - DNA, 731 bp, Arabidopsis thaliana
tcaaactctttgtttcttgtttgttgattaacccttaattaaatggagccaacacacagagctttgcccgtaggattcaggtttcgttctacaaactgtgagatttcaaactattttttgaagaaaaaagctttaggacaacccatgaaagctcgtacgatacctgaagagtgtcatgatatcttctcaagacatccgcatgatctgcctggtgagaattcgtggatctaaacttttataaagacaatgtccatctttaatcatcctgtgaaagagccaactgaattttctttgtttccttctttcaggttatccaagtgaagaacattggtactatttttgcagaaaacgtgacaaccaagttactagtaactctcataatctctggacaccaatcggagaagaaaccaatgtgctagatccaaagaataatgatgcattagttggtattaagcgtcggtttactcttattgcgcaagaagaagaagaatctgataatatttgtttatctgatgatgaagaagctttaaagtataattggttcatggatgaaattagcctcccacaaacagtagcgaatactgattgggttttatgccatatttttggcaagaagactaaacccgaaactactgatttgtccacaatcgattccgaatccgaatagggcgcgccaaaaattggagctctgcagagctttcgttcgtatcatcggtttcgacaacgttcgt

SEQ ID NO: 24 - DNA, 912 bp, Arabidopsis thaliana
atgaattggttacctgaagctgaagctgaggatgacttcaaaggtcttctctctggtgatttctttgatgatctcatcaatcaccttgacgtccctcttgatgacattgataccaccaatggtgaaggagattgggttgacaggtttcaagaccttgagcctcctcccatggatatgttccccactttgccttctgacctcacctcttgcggctctggcatggccaaggcccctcgtgtggatattcaaaggaacattcctgctttgaaacagtcctattcttctgaagccttgtccagcactctccaccaatcttcagctcctcctgaaatcaaagtttcgaaactatttcagtctttaagtccagtgtcagttctcgagaacagttatggttctctctcgacccacaacaatggatctcagagattggctttccctgtgaaaggcatgagaagcaagcgcaaacgccccacaacactgagacttagctaccttttcccctctgaaccccgaaagcccgagaagtcaaccccgggcaaacctgaatccgagtgttacttttcttctgagcaacatgccaagaagaaacgcaagatccacctgaccacccgcacggtctcttccactctggaggcaagcaactcggatgggatagtccgcaaatgcactcattgcgagacaaccaagaccccacagtggagggaaggacccagtggaccgaagaccctctgcaatgcttgcggagtgaggttcagatctggtcgcctagttccagaataccgaccagcctcaagccccaccttcatcccagctgtgcattcaaactcacacaggaagatcattgagatgagaaggaaggacgacgaacagtttgatagcagcatgattcgggcagtgatatccagagggtaa

SEQ ID NO: 25 - DNA, 1290 bp, Arabidopsis thaliana
atggaggatcaagttgggtttgggttccgtccgaacgacgaggagctcgttggtcactatctccgtaacaaaatcgaaggaaacactagccgcgacgttgaagtagccatcagcgaggtcaacatctgtagctacgatccttggaacttgcgcttccagtcaaagtacaaatcgagagatgctatgtggtacttcttctctcgtagagaaaacaacaaagggaatcgacagagcaggacaacggtttctggtaaatggaagcttaccggagaatctgttgaggtcaaggaccagtggggattttgtagtgagggctttcgtggtaagattggtcataaaagggttttggtgttcctcgatggaagataccctgacaaaaccaaatctgattgggttatccacgagttccactacgacctcttaccagaacatcagaggacatatgtcatctgcagacttgagtacaagggtgatgatgcggacattctatctgcttatgcaatagatcccactcccgcttttgtccccaatatgactagtagtgcaggttctgtggtcaaccaatcacgtcaacgaaattcaggatcttacaacacttactctgagtatgattcagcaaatcatggccagcagtttaatgaaaactctaacattatgcagcagcaaccacttcaaggatcattcaaccctctccttgagtatgattttgcaaatcacggcggtcagtggctgagtgactatatcgacctgcaacagcaagttccttacttggcaccttatgaaaatgagtcggagatgatttggaagcatgtgattgaagaaaattttgagtttttggtagatgaaaggacatctatgcaacagcattacagtgatcaccggcccaaaaaacctgtgtctggggttttgcctgatgatagcagtgatactgaaactggatcaatgattttcgaagacacttcgagctccactgatagtgttggtagttcagatgaaccgggccatactcgtatagatgatattccatcattgaacattattgagcctttgcacaattataaggcacaagagcaaccaaagcagcagagcaaagaaaaggtgataagttcgcagaaaagcgaatgcgagtggaaaatggctgaagactcgatcaagatacctccatccaccaacacggtgaagcagagctggattgttttggagaatgcacagtggaactatctcaagaacatgatcattggtgtcttgttgttcatctccgtcattagttggatcattcttgttggttaa

SEQ ID NO: 26 - DNA, 1260 bp, Arabidopsis thaliana
atggatctcaagacgttgaatcaattttcgccgttgacaaagcttaccgttccaaatcacagagatgtacaagtcaggacagaccagttgataacttacgaacgatcgaaacgaaagtcttctcttcatgatgatgaagatcttatttcgaaacgccgatgcttagattttcagcgaaaaatagaagacaacgagtgtgcaaacgacggcgttttcgttgcgcctcctaggtttaaaagtggtcaagtgtctatacgacagcgttctgacgctcctctctcttctcaggcggtgaaacacgacgagtttgcaaacgatgctttctacaagccttggttggatagtttccggctgaaacgacagcgtttgggtgacgatgaagatccttcctcttcttcttctccatctgaagttgatatcgctgctctcactctcttacagttttcctgtgatagacgccatccgcaaacacaaacgctaacgcggccgcagccgcaaactcacaaaactcaactgcagaggccgccgccgcaacttcaatcacaaactcaaacggcgcctcctaagtctgatttgttcaagtgtagcatctgtgaaaaagtgtttacttcgtatcaagctttaggtggtcacaaagctagccacagtattaaggccgcgcaacttgaaaacgcaggcgcagacgctggagaaaaaacgcggtcaaagatgttgtcaccgtctgggaaaatccacaagtgtgatatatgtcatgttctgtttcccaccggacaagccctaggtggacacaaacgccgtcactacgaaggccttctcggcggtcacaaacgcggtaatgacgaggctgttctcaagttgagtcccaatagcaataagagcgttgtaacaaaagtgttagatgcagaacagagtttaagggcaagtgacaacattcacaaacgcaatcaggacgaggttgttcccagcagagacaagtggagtctcagtaatgtgagtgttgttaaaaatgtgttggatctaaagctgagcctaggggaaagtgacggcggtcacaaagacagtcaggacgaggttgttgttcatgaagacaagtgtagtcctagtagcaatgggagtattgtaacaaatgtgtccgatccagagcagagcgtaaggagattgatagatcttaataacccgccttcactcgagtttgatcaatctagaggcggagacgtggaggaagttgaaagtgcaatgatattagcaaagcagccttga

SEQ ID NO: 27 - DNA, 1545 bp, Arabidopsis thaliana
ttaattaacggtcaatcggatttcttgggattgtttggagaaactttggaggtgatggacaacaaaaatgatcaggatattgatgttagatcagtggttgaagctgtttccgccgatctttcctttggtgctcccctctatgtggttgagagcatgtgcatgcgctgccaagaaaatggaacaaccagatttctattgaccttaattcctcacttcagaaaggtcttaatatctgcatttgaatgtccgcattgcggggaaaggaataatgaagttcagttcgcaggcgagattcaaccccgtggatgctgttacaatctagaggttctagctggtgatgtgaagatatttgaccggcaagttgtgaaatctgaatcagccactattaagattcctgaactggattttgagattccaccagaggcccaacgtggaagtttgtctactgtggaagggatattagcacgggctgctgatgaactgagtgcccttcaagaagaacgcaagaaagttgatcctaaaactgctgaagcaatagaccaattcttgtccaaactgagagcttgtgctaaagcagagacatccttcaccttcattttggatgatcctgctggaaacagtttcattgagaacccacatgctccatcaccagatccctctctaaccatcaaattctatgagcgaacaccagagcaacaagcaacacttggatatgttgctaacccatctcaggctggacaatcagaaggaagccttggcgcaccttctactaaaacagcttatgtacctaatggaacaatcggagcaactgctggtcatcgcgcgattgctcagagtaatagcactgatatttccgacaacttgttcagatactctgcgcctgaagaggtgatgactttcccttcaacttgcggagcatgtacggagccgtgtgagacacggatgttcgtgactaaaatcccgtactttcaggaagttattgtcatggcatctacatgtgacagttgtggctatcgtaattctgagttgaagcctggtggtgcaattcctgaaaagggaaagaagattactctctctgtgaggaacattacagaccttagccgagatgttatcaagtcggacactgcaggagtgataatcccagaacttgatctggagctagctggtggtacacttggtggaatggtaacaacagttgaagggttggttacacagatcagagaaagcctagcgagagttcacggattcacttttggtgatagtatggaagagagtaagttgaacaaatggagagaatttggagccaggctcactaagctcctaagctttgaacagccgtggacattgattcttgatgatgaattagcaaattcctttattgcaccagtaacagatgatatcaaagatgaccatcagctcacatttgaagagtacgagaggtcatgggatcaaaacgaggagttgggtctcaacgacatagatacttcttcagctgatgctgcttatgaatccacagagacgactaaattaccttaagggcgcgcc

SEQ ID NO: 28 - DNA, 1384 bp, Arabidopsis thaliana
atggaaactgaagacgatttgtgcaacaccaattggggaagctcttcttcgaaatcgcgagagccgggttcatcagactgtgggaattcgacattcgcaggttttacgtcccagcagaagtgggaagatgcttcaatcttggattatgagatgggtgtggagcctggattgcaagagagcattcaagcaaatgttgatttcttacaaggtgttagggctcaagcgtgggatccaaggacgatgttgagtaacctttcttttatggagcagaagattcaccagctgcaggatcttgttcatcttcttgttggtcgtggtgggcagcttcaaggtcgtcaagacgagctcgcggctcagcagcagcagcttataacgacggatcttacttccattatcatacagcttatttcaactgcagagtcagaacaataacaactgtggtgctcgagagttcgatttgcctaagccggttcttgttgatgagagggaaggtcatgttgtggaggaacatgagatgaaagatgaagatgatgtggaagaaggagagaaccttcctcccggttcgtatgagatattgcagcttgagaaagaagagattctcgcaccgcatactcacttctgcacgatatgtggcaagggtttcaagagagacgcgaatttgaggatgcatatgagagggcatggagatgagtacaaaacagcagctgctctggcgaaaccgaacaaagaatccgtacccgggtctgagccgatgctgatcaagaggtactcgtgcccattccttggttgcaaacgtaacaaggagcacaaaaagttccagcctttgaaaacgattctatgcgtgaagaatcactataaacgcacccactgcgataaaagcttcacttgcagccggtgccataccaagaaattctctgtcattgcagatcttaaaacccacgagaagcactgcgggaaaaacaagtggctttgttcctgtggtacaacattttcaaggaaagacaagttgtttggtcacatagctctgttccagggacacacgcctgcaatccctcttgaagagacaaaaccatcagccagtacatctactcagagagggagctctgaaggcgggaacaacaaccaaggaatggttggcttcaatcttggttctgcatcaaatgctaaccaagaaaccacacagcctggaatgactgatgggaggatatgttttgaggagtcgttctcaccaatgaactttgatacatgtaattttggagggttccacgagtttccgcgactgatgtttgatgattcagagagttcttttcaaatgcttattgcgaatgcctgtggtttctcgcccaggaatgttggtgagtctgtttcagatactagtctctaa

SEQ ID NO: 29 - DNA, 1062 bp, Arabidopsis thaliana
atgtcaaatataacaaagaagaagtgtaatggaaatgaagagggtgcagagcagaggaaagggccttggacactcgaggaagacactcttctcaccaattacatttcccataacggtgaaggccgatggaatctgctcgctaaatcttctggtaatattcttttcttttatgttttctttgtactattccaacaaaatgcaattggtgaaaatgtcttcctcccacttcatatttttgtattaaaagtttgatctctttttacaaaaaaacaaaaaaacagggctaaagagagcaggaaaaagttgtagattgagatggttgaattaccttaaacccgacataaagcgtgggaatctcactcctcaagaacaacttttaatccttgagctccattctaaatggggtaataggtaagttagttactcaaatgctctctttagctttataattttcttataatctaacgtgtaacatgttgcttcttaattaggtggtcaaaaatttcgaagtatttaccaggaagaacagacaacgatatcaaaaactactggagaactagagtccagaaacaagcacgccagctcaacatagattccaatagccacaagttcatagaagttgttcgtagcttttggtttccaagactgatcaacgagattaaagacaactcatacaccaacaatattaaagctaatgctcctgatttacttggaccaattttacgagacagcaaagatttgggtttcaacaacatggattgttccacttccatgtcagaagatctcaagaaaacttcacaattcatggatttttctgatcttgaaaccacaatgtccttggaaggatcacgagggggtagtagtcaatgtgtgagtgaggtttatagctccttcccttgcctagaggaggagtacatggtggccgttatgggcagttcagacatttcagcattgcatgattgtcacgtggctgattccaagtacgaggatgatgtgacacaagatctaatgtggaacatggatgacatttggcagtttaacgagtatgcacactttaattag

SEQ ID NO: 30 - DNA, 1245 bp, Arabidopsis thaliana
atgtcggctgtgtctgaatcggctgcgatttcgtctctgtttctaatctcctttgcaattcaatcgtcttcttcttcttcctcgtctgtcttgttctttggtctgagtctgacggctgttcttaacgctcttcgcttctgctccgaacagaggcttattcttgaggttccttccatttccatgggcttaagacttaaaaggacttgttctggtgttgaagtatttgggggttttcacgaaaagcaaaaaataccctttttcatagttcgctgaaacagagaaatctttttcctgaaaaaaacctcatccgatttagcagtttttgatcagagatttttgagtggggtttttttggtgtgttcttggtgtgtttgagaagatatgaagtcctttgtgaaacctgagagagactctttgttgagaacagttcgtattgttttcactgatcctgatgctactgatgattcctcttcctctagcgatgaatggttacctaaacctcgaaaggtaaagcgttttgttcatgagattactttcctccctcaggtctccgagagttctcaggatcgtagcaatgctgtcaaaacccctagaaggaaatctactaggcagtttaagtatcctgtgggagttaggccgaggccatcaggcaaatttgctgctgagattttgaacccattcactaaaactaagaaatggttgggtacttatgaaactcctgcagaagctgagaaggcttatgttgacaagaaggttgagtatgatgcactggcttcttcaggttctgctgtttcctcatcggttgtaacagtgactagccagtgcttgcgttcccctacttctgcttctgtttcttgtgtaagtgctgatgatttgtctaaagaaaagacgtctctgaacaaagatgttgctgcgtctggtgattcaaccaccaaagaagtgttcactactttcgacttttcggatgtgaaaatacctgatctgagattcttagcagcagaagaggattctatggtttctaatgcaaatggtgcagagctagactttgattgtttccttactgactctaacattctgctggatgattactcattgctcgaaaatgatatcaacttcagcaggtttgaaaacagtcttccaagtgagctacctgactgtgatttcactgaaatggaattccagcttgatgatttcaaatttgcctatacagatcatctgacaacaccgcctctcggtttggtttaa

SEQ ID NO: 31 - DNA, 1260 bp, Arabidopsis thaliana
atggctcctctccctttcataccggaacaaacccgttcgcaaacgcgtttatcttcagacacaaagaagaagaacagaaacaagaaaacgtcccaaccaccgcctcaaacgcaaaagataaagcagaagacggtaccatcaacatcatcatcgtcgtcatggagccagataaagaaccttttgagttgcaaacaaatcgaagggccacgagtgcacgaaccatcaaagattacgtcatcatcttgtggctcctctctttgtaagtttagtgatgttatttacggtaatgcccgtgtgattcaccgctccgatcactcccctgagagtagcaatcttggacaagatacccggttgttgacccgaaaacccattagtacccgtggatcttcttcatcggttagatccaacggttgtggcgcttacacgtcatattcaacttccaaagctatgcacttcagaaacctctcaggttgctatgagtgtcacatgattgttgatccaagcaggtatccaatagcaccaagaatatgtgcatgtccacagtgtggggaggtcttccctaagcttgaatcattggagcatcatcaagcagttcgtcacgctgtgtcggagttggggccagaggattcagggagaaacatagtggacatcatcttcaaatctagctggttacgtaaagacagtcccatctacaagatcgaacggatattaaaagtccacaacactcaacgaacgatccaacggtttgaagattgtcgcgacgcagtcaagtcccatgcacatgcctctaccagaaaagaggctcggtccgccgccgacggcaacgagcttctccgcttccactgcaccacagtttcttgctccctcggctcacgcggctcgacctccatttgctccgccatccctggctgccgcgtttgcaccattatccgccatggcttccacgccaaaacggtacgtgtaggcaatggtgaaggaaaagaggagattaagggcgtgaggaccactgcaagcagtggaagagcacacgatgcgttgaggtgttttgaccagcggagggcgatgcttgtttgccgtgtgatcgcgggaagagtgaggcgcgtgcagagtgatgtgccggaagatgaaagtggttctggctcgtatgattcggttgcgggggccgctggggtctacacaaaccttgacgacttggttgtgtataatccaaaagctatacttccttgctttgtagttatctacaaagtctccgagccttaa

SEQ ID NO: 32 - DNA, 321 bp, Arabidopsis thaliana
atggataacactgaccgtcgtcgccgtcgtaagcaacacaaaatcgccctccatgactctgaagaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctag

SEQ ID NO: 33 - DNA, 1445 bp, Arabidopsis thaliana
atggccgctgaggtaataattgactagagattgatgaattaagagtagttattgacgcttatagaagaagtagattctatatgaagaaagtttctttttttggaagaacttgaagtaaaagccatttaatttcatttcttgtttccacttcaggatcgaagtgaggaactaagcagcaatgtagaaaatggaagttgcaattccaatgaaggaattaatcctgaaaccagcagtcattggattgaaaacgttgtcaaggtactatatgttttgtcacaactttggagaagagacaaatttcagattttgccagtggatcttacctctcctctgtgtattgttcttcaaggttaggaaaccgtacacagtaactaagcagagagagaagtggagtgaggaagagcatgataggtttcttgaagctatcaagctttatggtcgtggttggcgtcaaatccaaggtattatttgacttggagcttaaattgagcttagaatctagctgctattagatgtagttctgaagaacctaagtcttgactttgctgcagaacacataggtacaaaaaccgctgtacagatacgaagccatgctcaaaagttcttctccaaggtcttgtttgttcatatgttccataacatcagtagtactgatttggttagtttgtaacctgacagttttttatccattgcagatggctcaggaagctgacagtagaagtgaaggatcggttaaagcgattgtgatcccgcctcctcgtccaaagagaaaaccggcacatccttatcctcggaaatcgcctgttccatatactcagtctcctccaccaaatttgtcagctatggagaaaggaaccaagtctccaacctcagtgttatcatcgtttggttcagaggatcaagtcaatagatgctcttcgcctaattcgtgtaccagtgacatccaatccattggtgcaacttccattgataaaaagaataactacacaacatccaagcaacctttcaaagatgattctgacattggttcaacacccatttcaagcattactcttttcgggaagattgtccttgtcgcggaagaatctcacaaaccatcctcttacaatgatgatgatcttaaacaaatgacgtgtcaggagaatcactactcagggatgctagttgacactaatttatctcttggtgtatgggaaacgttttgtactggttctaatgcatttggctcggttacagaagcatctgagaacttggagaaaagtgcagagccgataagttcttcatggaaacggttaagctccttagaaaaacaaggatcttgtaatcctgtaaatgcaagtgggttcaggccatacaagagatgcctatcagaaagagaagtaacatcatcattgacgctggtagcttcagatgaaaagaaaagccaaagagcacgtatatgctag

SEQ ID NO: 34 - DNA, 921 bp, Arabidopsis thaliana
atgccttcatctgattccacgatgatgaagaaaggaacaaagcgcaaaatcgaaataaagaaacgagaaaccaaagagcaacgagccgtgacttgctctaaacgccgtcaaactgttttttccaaagccgccgatctctgtcttatctccggtgctaacatcgccgtcttcgtaacctctccctccgatagttccgatgttgtctattccttctccggttactcctctgcctacgaaatcgctgattgttacctaaatcgcaagcctccacccaagattgttaacccggccggatccaaactaggattttggtgggaagaccctgatctctaccattcgtgtgatgatctctctgagttaagcattatcgaggatcgtttacagagaatgaagaagcatgtgatggcttgccttgagaaggaagaaaaatctcaacttgtttctagtttcgaccaaaaccctaatagtacttgttctctcgacgtcgaggattgtgatggatcttcttattcgcaaattgcttctacttttactccaaactctgtcaacgagtattgcagcgatcaaaccttttcttctttccatggcgatcaaaaccctaacctctcgtctccgtcttttgatcaggactgttactcctctctctatcagatctgtggagaatcatcttcacaagttgcttcttttgatcaaaaccctagctccgagatccaaggatttgaaacagaggaagagattaaccaaatcaatctactactacaagaaacacaaacagaggccaatgtcaatttggatgatgagatctgcttttggaatgatctatccaacgatgatgtgtttggtctaaacagctacttcggtctcgataacaccaatgcaatgatcaacttcggagattccgactttagacgtcatgtctga

SEQ ID NO: 35 - DNA, 1000 bp, Arabidopsis thaliana
atggctgaacgaaagaaacgctcttctattcaaaccaataaacccaacaaaaaacccatgaagaagaaaccttttcagctaaatcacctcccaggtttatctgaagatttgaagactatgagaaaactccgtttcgttgtgaatgatccttacgctactgactactcatcaagcgaagaagaagaaaggagtcagagaaggaaacgttatgtctgtgagatcgatcttcctttcgctcaagctgctactcaagcagaatctgaaagctcatattgtcaggagagtaacaataatggtgtaagcaagactaaaatctcagcttgtagcaaaaaggttttacgcagcaaagcatctccggtcgttggacgttcttctactactgtctcgaagcctgttggtgttaggcagaggaaatggggtaaatgggctgctgagattagacatccaatcaccaaagtaagaacttggttgggtacttacgagacgcttgaacaagcagctgatgcttatgctaccaagaagcttgagtttgatgctctggctgcagccacttctgctgcttcctctgttttgtcaaatgagtctggttctatgatctcagcctcagggtcaagcattgatcttgacaagaagctagttgattcgactcttgatcaacaagctggtgaatcgaagaaagcgagttttgatttcgactttgcagatctacagattcctgaaatgggttgcttcattgatgactcattcatcccaaatgcttgtgagcttgattttctcttaacagaagagaacaacaaccaaatgttggatgattactgtggcatagatgatctggacatcattggtcttgaatgtgacggtccaagcgaacttccagactatgatttctcagatgtggagatcgatcttggtctcattggaaccaccattgacaagtatgctttcgttgatcatatcgcaacaactactcccactcctcttaatatcgcgtgcccataag

SEQ ID NO: 36 - DNA, 839 bp, Arabidopsis thaliana
atggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtgatcgttaactctttctttttttatcacttagataaaatctaggttttactttttaaagataaagataagattgagaagctttgatatttgattgttttttttataattttatggtttaacaatttcataatttagaaacaggtcggagcaccaccggagatagcgtgtttactagaggagattcaacgggagagtgatgtttataagcaagaggttgttccttcttcttgctttggagctgatcctgagcttgatgaatttatggtctctctctttttttccctcgattttttttcggatttttatttttgttaaaatatttttttttggaaatttttgtacttaagaagataatttattatcaggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctggtatgtcttaa

SEQ ID NO: 37 - DNA, 916 bp, Arabidopsis thaliana
ttaattaaatgggtgcaccaaagcagaagtggacaccggaagaagaagcagctcttaaagctggagttcttaagcatgggactgggaagtggcgtaccatactctcggatactgagtttagtttaatccttaagtctcgctctaatgttgatcttaaggacaaatggagaaatataagcgtgacagctttatggggttcaaggaagaaggctaaacttgcgcttaagaggactccaccaggtactaaacaggatgataacaacacagctcttaccattgtggctttgactaatgatgatgaacgtgcaaaaccaacttcccccggaggttctggtggtggatcaccacgcacttgtgcttctaagagatcaattacaagtttggataagatcatctttgaggcaattaccaacttgagggaactacgcggttctgacagaacatcaatctttctgtatatagaggagaatttcaagactccaccgaatatgaaaaggcatgtcgcagtacgattaaagcatttatcatcgaatggaacattagttaagataaagcacaagtacaggttttcttctaattttattcccgcaggtgcaagacagaaggctcctcaactctttctggaaggaaacaacaagaaagacccaacaaaacccgaggagaacggtgccaacagtctcactaaattccgagtagacggtgaattatatatgataaaaggcatgacagctcaagaagctgcagaggctgcagcaagagcagttgcagaggcagaatttgctatcacagaggctgaacaagcagcaaaagaggcagaaagagcagaagcagaagctgaagctgctcagatatttgcaaaggcagccatgaaagctttgaagttcaggatccgtaatcatccttggtgaggcgcgcc

SEQ ID NO: 38 - DNA, 1465 bp, Arabidopsis thaliana
ttaattaactaactgcaaactaatgggggatcttgtcaagagacagttttgattgttgatgtacatcaaagcaatcatgaacagacacaggcttctctcagcggcaacagatgaatgcaataaaaaacttggtcaagcttgctcttcttctttatctccagtccataactttctgaatgtccagccagaacaccggaaaactcctttcataaggtcacaatctccagattcacctggtcagctatggccaaagaatagttctcagagcaccttctctcggtcttccaccttttgcacaaacctctacttgtcatcatcttcaacctctgagactcagaaacatctaggaaacagtcttcctttcctccctgatccctcctcttacacccactcagcttctggtgtggagtctgcaagatctccatctattttcactgaggatttgggcaatcaatgtgatggaggcaactccgggtcgcttctcaaagacttccttaatctttctggagatgcttgttccgatggcgattttcatgattttggctgttcgaatgacagctattgcttatcagatcaaatggaattacagttcctgtctgatgaacttgagctggctatcacagaccgcgctgaaactcccaggcttgatgagatctatgaaacgccattggcgtcaaatccagtgacgagattgagtccaagccaaagctgtgttcctggagcaatgtctgtagacgtagtttcatctcacccttctccgggatcagcagccaatcaaaagtcgagaatgagatggactcctgagctccacgagtcttttgtaaaggcggtgatcaaacttgaagggcctgaaaaggccactccaaaggctgttaagaagctcatgaatgttgagggcttgacgatctatcatgtaaaaagccacttgcagaagtatagactagccaagtatatgccagagaaaaaagaagagaaaaggactgataactcagaagaaaagaaactggctttgagtaagagtgaagctgacgagaagaagaaaggggccatacaattaactgaagcactgcgtatgcagatggaagttcagaagcaattgcatgaacagctggaggtgcaacgggtgcttcagctacgaattgaagagcatgctaaatacttggaaaagatgttggaagaacaacgcaaaacaggaaggtggatttcttcttcttcgcagacagtgttatcacctagtgatgactctataccagattctcaaaacatgtccaaaaccaaagcatcttcgcctcagccgccattacctgcagagaacaaagcgtcggaaaccgaagacgataaatgtgaaagccctcagaaacgtcgcaggcttgagaacatagctgaatctgaagatcctaagaggtagtaagattcttcaagtatgtaaatatggtccgttttgtgtaatttagtgaggcgcgcc

SEQ ID NO: 39 - DNA, 1083 bp, Arabidopsis thaliana
atgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtctctttcctctctatctctctctctaatcgtattgacataatttatgaattctttgtcacatgattttcttttacgaatggtttaaagttaaggttctatatattatatatgttattttagatttaacttttaatctatgttaatagagtccatatatcgcaaaagcaacttgaatcaggatatttatctagggtcacctttttgttgtttttatttttatgaattaaggtcctcagttaaataattgtatatgtgtgttaggtttaaagagatgtggaaagagttgtagattgaggtggatgaattatctcagccctaatgtgaaaagaggcaatttcaccgagcaagaagaggatcttatcattaggctccacaagttgcttggtaataggtataacttcatttgctcaaaattagtttctctactcaattaatcataaaaacagctatttctatccattttgtatcaagttaaataatcataaatattcgtgattgtcttcacaaacttgcttggtaacacatgtttttattctcaaaatttcaatacattatatttcacatgataattatattgtttatctgtgtgtttaattaggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttga

SEQ ID NO: 40 - DNA, 708 bp, Arabidopsis thaliana
atggacgcttcaatagtttcctcatccactgcttttccatatcaagattctctaaaccagagcatcgaagacgaagaaagagacgttcataattctagtcacgaactcaatctcatcgactgcatagacgacacaacgagtatcgttaacgaatctacaacatccacagaacaaaagcttttctcatgcaactattgtcaaagaactttctatagctcacaagcacttggtggtcaccaaaacgcacacaagagagagagaacgttggcgaagagaggacaacgtatggcagcgtcagcctcagcttttggacatccttacggtttctctccacttcctttccacggacagtacaacaaccataggtctttagggatccaagcgcattcgataagccacaagctaagttcttataacgggtttggtggtcactatggtcagatcaactggtcaagacttccatttgatcaacaaccagccataggtaaatttccctcaatggataattttcatcatcatcatcatcagatgatgatgatggctccttcagtaaattcacggtccaataacatcgatagcccaagcaacacaggacgggttctagaagggtcaccgactcttgaacaatggcacggagacaaaggattgttgttaagtacaagtcatcatgaagagcagcagaaacttgacttgtccctcaagctttga

SEQ ID NO: 41 - DNA, 777 bp, Arabidopsis thaliana
atgacagaaggtggagaatattctccggcgatgatgtcagcagagccattcttgaccatgaagaagatgaagaagagcaaccacaacaagaacaatcagagaaggtttagcgacgagcagatcaagtcactggagatgatgtttgagtctgagacaaggcttgagccaaggaagaaggttcaattagctagagagctagggttgcagccgaggcaagtggctatatggtttcagaacaagagggctcgttggaaatccaagcagctcgagactgagtacaacattctcagacaaaactacgacaacttggcttctcagttcgagtccttaaagaaagaaaaacaagctttagtctctgagttgcagaggctaaaagaggcgacgcaaaagaagacacaggaggaggaaaggcagtgtagtggagatcaagcggtggttgctctaagcagcacacatcatgaatcagaaaacgaagagaaccggaggcgtaaaccggaagaggttagaccggagatggagatgaaagatgataagggtcatcatggggttatgtgtgatcatcatgattatgaagatgatgataatggttatagtaacaacatcaagagagagtattttggtgggtttgaggaagaaccagatcacttaatgaacattgttgaaccagctgatagttgtttgacatcatctgatgattggagaggtttcaaatcagatactactactctcttggaccaatccagcaacaattacccttggcgggatttttggtcatga

SEQ ID NO: 42 - DNA, 1122 bp, Arabidopsis thaliana
atgcaaaaggtcttcttggccatggatacttgtgctctagtaatccatcagtctctgtctcgcatcaaactttctcctcccaaatcttcttcttcttcttcttctgctttctcccctgaatccttaccgatcagacggatcgagctgtgtttccgaggagctatatgtgccgccgtacaaagaaactacgaagaaacgacctcctccgtggaagaggcagaggaagatgatgagtcatcatcatcgtacggagaagtgaacaagatcattggaagccgaacggcgggggaaggagccatggagtaccttatcgagtggaaggacggccattctccgtcgtgggttccatcgagctacatcgcagcagacgtagtgtcggagtacgagacaccctggtggacggcagctagaaaagccgacgagcaggccctgtcacagctcctggaggaccgagacgtcgatgccgtggacgaaaacggccggacggctctgcttttcgtggcaggtctggggtcggacaagtgcgtaaggcttctggcggaggctggagccgatctcgaccaccgagacatgaggggaggcttgacggcgctgcacatggcggctggttacgtgaggccggaggtggtggaggcgctggtggagctgggagctgatattgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaatgaatgaatga

SEQ ID NO: 43 - DNA, 450 bp, Arabidopsis thaliana
atgctagatcccaccgagaaagtaatcgattcagaatcaatggaaagcaaactcacatcagtagatgcgatcgaagaacacagcagcagtagcagtaatgaagctatcagcaacgagaagaagagttgtgccatttgtggtaccagcaaaacccctctttggcgaggcggtcctgccggtcccaagtcgctttgtaacgcatgcgggatcagaaacagaaagaaaagaagaacactgatctcaaatagatcagaagataagaagaagaagagtcataacagaaacccgaagtttggtgactcgttgaagcagcgattaatggaattggggagagaagtgatgatgcagcgatcaacggctgagaatcaacggcggaataagcttggcgaagaagagcaagccgccgtgttactcatggctctctcttatgcttcttccgtttatgcttaa

SEQ ID NO: 44 - DNA, 1309 bp, Arabidopsis thaliana
ttaattaaatgtgcagcgtctctgagcttcttgacatggaaaacttccaaggagacttaaccgacgtcgtacgaggaatcggaggccacgtgttatcaccggagactcctccctcgaacatctggcctcttcctctgtcacatccaacaccatcaccgtcagatcttaacataaaccccttcggagatccctttgtgagcatggacgatccactcctccaagaactaaactccatcacaaactccggctatttctccaccgtaggagataacaacaacaacattcacaacaacaatggtttcttggttccaaaggtatttgaggaggatcatataaagagtcaatgtagtatcttcccaagaatccggatctcgcatagtaacatcatccacgattcttctccgtgtaattctccggccatgtcggctcacgttgtcgcagccgcagcagccgcctcgccgagaggcatcatcaacgtagacacaaacagtcctagaaactgtctattggttgatggtaccacgttctcctcgcagattcagatatcttcccctcggaatctaggccttaaaagaaggaagagtcaggcaaagaaggtggtgtgtattccggccccggctgcaatgaacagccgatcaagcggagaagtggttccatcggatctatgggcttggcgtaaatacggtcaaaaacctatcaaaggctctccttttccaaggggttattatagatgcagcagctcaaaaggttgttcagcaagaaagcaagtcgaaagaagccgaaccgatccaaacatgttggtgattacatatacctccgaacataaccatccttggcccatccaacgcaacgctctcgccggctccacacgctcctccacctcctcctcatctaaccctaatccttccaaaccctcaaccgcaaacgtaaactcctcatccattggctcccaaaacaccatctacttgccttcctccaccactcctcctcctaccctctcatcctccgccatcaaagatgaacgaggggacgatatggagttggaaaacgtagatgatgatgatgataaccagattgctccatacagaccggagcttcatgatcatcagcaccaaccagatgatttctttgcagatcttgaagagctagaaggagattctctaagcatgttgctttctcatggctgtggcggcgacgggaaggataaaacgaccgcgtccgatgggatcagcaatttcttcgggtggtcgggagataataattataataattacgacgaccaagactcaaggtcgttatagggcgcgcc

SEQ ID NO: 45 - DNA, 1026 bp, Arabidopsis thaliana
atggaaggaggaggaagaggaccaaatcaaacgattctcagtgaaatagaacatatgcctgaagctccacgtcaacgtatctctcatcaccgtcgagctcgctctgaaaccttcttctccggcgaatcaatcgacgatctcctcttattcgatccttccgatatcgatttctcttctctagacttcctcaacgctccaccaccaccacaacaatcacaacaacaaccgcaagcttctcccatgtccgttgattcggaagaaacctcatcgaacggtgttgttcctcctaattctcttcctccaaaacccgaagctagattcggtcgccatgttcgtagcttctcggttgattccgatttcttcgatgatttgggtgttactgaggagaagtttatagctacaagttcaggagagaagaagaaagggaatcatcatcatagcaggagtaattctatggatggagagatgagttcggcgtcgtttaatatcgaatcgattttagcttctgtgagtggtaaagatagtgggaagaagaatatgggtatgggtggtgatagacttgctgagcttgctttgcttgatcctaaaagagctaaaaggattttagcgaatagacaatctgcggcgaggtcgaaagagaggaagattaggtatactggtgagttagagaggaaggttcagacacttcagaatgaagctactacattgtctgctcaagtcactatgttacagagaggaacatcagagctgaacactgaaaataaacacctcaaaatgcggcttcaagctttagagcaacaagctgaacttagggatgctttgaatgaagcactgcgggatgaactgaaccgacttaaggtggtagctggagaaattcctcaggggaatggaaattcttacaaccgtgctcaattctcatctcagcaatcggcaatgaatcagtttgggaacaaaacgaaccaacagatgagtacaaacgggcagccatcgctcccaagctacatggatttcaccaagagaggctga

SEQ ID NO: 46 - DNA, 687 bp, Arabidopsis thaliana
atggaaccgtccatcaaaggagatcaagaaatgttaaaaatcaagaaacaaggtcatcaagatcttgagttggggttgacccttttgtcacgtggaaccgcgacctcatcagagctcaatctcatcgattctttcaaaaccagctcatcatcgacttctcatcatcagcaccagcaagaacaattggcagatccgagagtgttctcgtgtaattattgtcaaagaaagttctatagttcacaagcgctaggcggtcaccaaaacgctcataaacgtgagcgcaccttagccaaacgtggacagtattacaagatgactctctcctccttgccttcttcagcgtttgcgtttggccacggttcagtcagcagattcgcaagcatggcatcgttaccattacatggctcggtgaataacaggtcaacgttagggattcaagctcattcaacgatccataagcccagcttcttaggaagacaaacgacgagtttaagtcatgttttcaaacagagcattcaccagaaaccgaccataggaaagatgttgccggagaaatttcaccttgaagtcgccggaaataataacagtaacatggttgctgctaagttggagagaattggacatttcaagagcaaccaagaagatcataatcagtttaagaaaattgacttgactcttaagctatga

SEQ ID NO: 47 - DNA, 1202 bp, Arabidopsis thaliana
ttaattaacgcgaaacagagagaaaataagaagaagaaggacgatccagatatggaggatccttctaacccacaaccaaaccagagcaatctctcgcaatgcccgcctttagccacagctccgacacctgcgccagttcgtggtccgtaccaccggagagcacattcggaggtccaattccgtctccctgaagatctggatctctctgaaccattcggaggattcgatgagcttggatccgaagatgatctcttttgctcatacatggacattgagaaacttggatccggatccggatccgcatccgattcggctggtccttctgctcctaggtctgataacccgttttccgctgagaatggaggtgcggaggctgggaattcgagacctcgacacaggcatagcctctccgttgatggctcttcgactttggagtcaattgaggctaagaaagctatggctcctgataagctcgctgagctttgggtcgtcgaccctaaaagagctaaaaggataattgctaatcgacagtctgctgctcgttcgaaagagaggaaggctcggtatatcttggagctcgagaggaaagttcagaccttgcaaactgaagctactaccctttcagcacagttgtctttgttccagagagacacaactggtttgtcatctgagaatacagagctcaagcttcgtttacaggtcatggaacaacaagctaagttgcgagatgcactgaacgagcaactgaaaaaggaagttgagaggctgaaattcgccacgggagaagtctcacccgcggatgcttataacctcggaatggcacacatgcaatatcagcaacaaccacaacaatccttctttcaacatcatcatcagcaacaaaccgatgctcaaaacctgcaacaaatgactcatcagtttcatctcttccagcctaacaacaaccagaaccaatcttctcgcacaaaccctcccaccgctcatcagcttatgcatcacgctacttctaatgccccggctcaatctcattcctattcagaggcaatgcatgaagaccatcttggccggttacaggggcttgacattagcagctgtggcagaggctcaaactttggtaggtctgacaccgtcagtgaaagcagcagcactatgtgaggctgcctttcccagattcccctttgtcgataaacctatggcgcgcc

SEQ ID NO: 48 - DNA, 540 bp, Arabidopsis thaliana
atgtcttctgagaatgatttcgttgagttttcttctatgttcgagagaattatacaaggaagaggtgatggtctctctcgatttttgccggtgattgtagctttagccgccagagaagacgatgatgaccaaggatctaccgatcaaacaacgagacggggagatccgttgagtccaaggttcgtgatgatcggatcgcgatcgggactcgacgatttctttagcgacggtggaaaacaagggaggtcgccggcgttgaagtcagaagtggagaatatgccacgtgtcgtgatcggagaagataaggagaaatatggtggttcttgcgcgatttgtttggatgagtggtctaaaggtgacgtggcggcggagatgccttgtaaacataagtttcactcaaagtgtgtggaggagtggttagggaggcacgccacgtgtcctatgtgtaggtatgagatgcctgttgaagaagttgaagaagagaagaagattgggatttggattggtttctccattaacgccggcgacagaagaaactaa

SEQ ID NO: 49 - DNA, 1299 bp, Arabidopsis thaliana
atgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgaatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatttgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttga

SEQ ID NO: 50 - DNA, 693 bp, Arabidopsis thaliana
atggagtctatatctccggtatcgaatcagcttcttcagccgacgacgacgagctctaattccgatcgctctcgtcgtaagcgtaagaagaaatcatcgccatcatcggttgagaaatctccatctccgtcaatatcgttggagaaatggagatcggagaagcagcaacagatctactcaacgaagctagttcatgctttaagagagctacgaatcagccaacaaccatcttcatcatcatcttcttcgattccacgtggaggtagagccgtacgtgaagtcgccgatagagctttagcagttgcggcgagaggtaaaacgttatggagtcgagcgatactttcaaaagctgtaaaactcaaattcaggaaacacaaacgccagagaatctctaatccgacgacgacgacgttaaccaccgggagtatcaggtcaaagaaacagagagcgacggttttgaggcttaaggctaaaggtttgccagctgtacagaggaaagtgaaagtactgagccggttagttcccggttgccgtaaacaatcattaccggtggttttagaagaaaccactgattatatagctgcgatggagatgcagattcgtactatgactgcgattctctccgccgttagttcttctcctccgccgccaacgccaggtcacgaagggggacaaacacacatgcttggttag

SEQ ID NO: 51 - DNA, 1581 bp, Arabidopsis thaliana
atggaagctactcagaaacatatgattcaagaaggatcttcaatgttttaccatcaaccatcttcagtcaaacaaatggacctttctgttcagacatttgattcttactgcacacttgaatcctcttcaggcaccaagtctcatccttgtcttaacaacaaaaacaactcttcttcaaccacaagcttttcctctaatgaaagtcccatttctcaagccaacaacaacaacttatcaaggtttaacaatcattcccctgaagaaaacaataactctcccttgagcggttcttcagcgacaaacaccaacgagacagagcttagtctcatgcttaaagatttggagactgcaatgatggagcctgatgtagacaacagctataacaatcaaggcgggtttggacagcagcatggagttgtttcttcagctatgtatagatctatggagatgatctctaggggagatttaaaaggagtgctctatgaatgcgcaaaagctgttgaaaactatgatttggaaatgactgattggttgatctctcagttacagcaaatggtttctgtttctggtgagcctgttcagcgcttaggagcttatatgcttgaaggtctcgttgctaggttagcttcttcgggtagctccatctataaagcattgagatgcaaagacccaacgggtcctgagcttcttacttatatgcatatcttgtatgaagcctgcccttatttcaaattcggttatgaatctgctaatggagctatagctgaagctgtgaagaacgaaagttttgtgcacattatcgatttccagatttctcaaggtggtcaatgggtgagtttgatccgtgctcttggtgctagacctggtggacctccgaacgttaggataacgggaattgatgatccgagatcatcgtttgctcgtcaaggaggacttgagttagttggacaaagacttgggaagctagctgaaatgtgcggtgttccgtttgagttccatggagctgctttatgctgcacggaagtcgaaatcgagaagctaggagttagaaatggagaagcgctcgcggttaacttcccgcttgttcttcaccacatgcctgatgagagtgtaactgtggagaatcacagagatagattgttgagattggtcaaacacttgtcaccaaacgttgtgactctggttgagcaagaagcgaatacaaacactgcgccgtttcttccccggtttgtcgagacaatgaaccattacttggcagttttcgaatcaatagatgtgaaactcgctagagatcacaaggaaaggatcaatgttgagcagcattgtttggctagagaggttgtgaatcttatagcttgtgaaggtgttgaaagagaagagaggcacgagccactagggaaatggaggtctcggtttcacatggcgggatttaaaccgtatcctttgagctcgtatgtgaacgcaacaatcaaaggattgcttgagagttattcagagaagtatacacttgaagaaagagatggagcattgtatttaggatggaagaatcaacctcttatcacttcttgtgcttggaggtaa

SEQ ID NO: 52 - DNA, 1234 bp, Arabidopsis thaliana
ttaattaaatgcctttaccttggaagaaatctaaatctagtcggatctctagattcgtatcagactttcaacaatctcctaaacatggtggatctctcgttgttgaaactggtttcccaacttctttaatcgatctctttgttaagaatcgcgatcgtctcaaaaaacaatcttcaaaacgtaacaacaagaacaacaaagcccagactgaaacgcgtgttttgtctccacctcctcctcatatgtctttgcagcgtcgtatgtctcttccttccaagcttgatccagctttggttacagaggattctcctttggtgagaaagatcgaggaaacttctgttccggagattatccatgaagacgacggtggtcatcgcggtggaggaggaggagggtgtgttttgatagtggtggtgtttaaggtttttatggtggctgtgcttgccttgagcacgaagaagctcgccgtggggatcacgctctctgcttttgcccttctcttcctcgagcttgcggtggcgcgtgtcttcacgtacttgaatctctgtcccgacgcgcagattcggatagattctttgatcgataagctcatagggaagcgacataaagagaagctagaagaagaagaagaatcaacatcgacgcatgacagaagaaacaatgtctactttgaaatcatcgaagaacctagagaggagattagagtcactcctcaatcggattcgtcgtcattggagaaggcgaaacttgtggtggatgagaagaaagaaatgcagacgataagagatgttatgtttaagactgagaaaagcaaaagcgcgaagctgaaatcaaagattgtgaagaagattgtgccaaagaagctaaggagttataagaagaagaagaagatgaagaacaaagaaaaagaagaagaagaagttgaacttgaaactgaagaagaagggtctatgacagaagtttctagcttgtattcagatgagagaatcgggagtgaaatctctgagagggatgatttgagttcgaatccgccatttttagagagttgtacagaggttgaagaagaagaagagactggaccaaaagaggatctaacgaaagtgattggtttgatagtgattgttcttgttggattgctgtgtgggaaagtctttgctattggtctgacactctcttggtgtctgattctcagagttttctgttgcaaatctcaaaccagtttctgaggcgcgcc

SEQ ID NO: 53 - DNA, 912 bp, Arabidopsis thaliana
atggatccttataagaatcttaatccaaaaggttaccagagacagagaccgtttagctcagccggcgagagtggcggcagcggcggctccggtacggcccatgaaacagatgacaataagaagaagaagaagcttctccaccgcgacatcgaacgccaaagaagacaagaaatggctacactctttgctactcttcgtactcacttacctcttaaatacatcaaggttcatattcttaattactcactcttttctctcaaatttatttactttttcgttatatcaattgttcgaagaaaccaagatttggtgagatttggctgctagggttgtgaatatgtcgttttttgtatttaatttagttttgtatttaatctttatttatagggaaaaagagctgtgtcggatcatgtaaatggagcggtaaatttcattaaggacacggaagcacggattaaagaacttagtgcaagaagagacgagttaagtagagaaaccggccaaggatataaatcgaatccggatccaggaaaaactggatccgatgtaggcaaatcggagccggcgactgtgatggtgcaaccacacgtgagcggtttagaagtggtagtgagcagcaactcctcaggccccgaagctttgccactatcaaaagtgctcgagacaattcaggagaaagggcttgaagtcatgagctccttcactacaagagtcaatgataggctcatgcacactattcaagtagaggtatggttggttacaacatgtcaacatgccatgtcaatggaagttaatctagggtttcattacatttaactatattcaatacaggttaatagtttcggatgcatagacttattatggttgcagcagaagctagttgaggatttgatactttcgacggggtactaa

SEQ ID NO: 54 - DNA, 1179 bp, Arabidopsis thaliana
atggcgacaaatcggttcttttgtgaaatttgtaacaaggggtttcagagagaacagaaccttcagctccacaaaagaggccacaacctgccatggaagctgaagcagaaaacgaacaagaatcaggtgaagaagaaagtttatatatgccctgagaagagttgcgtccatcatgatccagctcgagccctaggagaccttactggaataaagaagcactttagcaggaaacatggagagaagaagtggaaatgcgataagtgttccaagaagtatgctgtgatatccgattggaaagctcataacaagatttgtggtagcagagagtttagatgtgattgtggtactcttttctccaggaaggacagtttcatctcacatagatccttctgtgatgtcttagctgaagaaagttctaaattcttctcagttccttcaccattagccgccaattcgaccatcgccactgtcactgataccaacaatccaattctcattcaatcacaattggatcaatcttccacaggtacggccgatcttaacgtcaacaacaatcacaccaccctatttggacaaaagttcaccaactccaacccaacccaacaacaacccaatgctttggcgttgtcctcaccaccatcacctcgtagtacatctgattcggttcataatctatggaagttacaagaagaggaatgtgcacaccagtggttactcaatgaatatatgaacaataacaaaaacatattccataagggaatattcaagaatcaagaagatgagataaagaagggaaatatctacagcggctcaaacccaaccgatggaaacatagcatccttgttctcgtataatcaagaagcagtgaatatggcttcattttcggcaacaacattgcttcaaaaggtagctcaaacgggaacaccatcaagctccgaaactagcaccaccatgtttgggcaaatgacttcctccatcttcaacaatacgatgctaaactcctattgtttaacggcgaagaataatgaagaagagttgaccagagactttcttggtgtgggaagtagtgaggaccaacaacgtctacatcgtcatcgcttcccatcaagcgtgccattgacggcgaaccatgatattcccaagttggccgcaaccattgtaggcaggaagcaaccatag

SEQ ID NO: 55 - DNA, 942 bp, Arabidopsis thaliana
atgatttcaaagtaccaagaagatgtcaagcagccacgagcttgcgaactttgtctgaacaaacacgcagtttggtactgtgcctccgatgatgctttcttgtgccatgtttgtgatgaatcagtgcattctgcaaaccatgtagcgacaaaacacgagagagtttgtcttagaacaaacgagatatcgaatgatgtgcgtgggggaacaacattaacctcggtttggcacagcgggtttcgaagaaaagcaagaactcctagatctcggtatgagaaaaagccacaacaaaagatagatgatgagagaagaagggaagatcctcgtgttcccgagattggaggcgaagtgatgtttttcataccagaagcaaatgatgatgatatgacttctcttgtgccagagtttgagggattcacagagatgggattcttcttgagcaaccacaatggtactgaagaaacaacgaaacaattcaactttgaagaagaagctgacacaatggaggatctatattacaatggagaagaagaagataaaactgatggagctgaagcatgtcctggacaatatttgatgagctgcaagaaagattacgacaatgtcataacggtttcagaaaagacagaagaaattgaagattgttatgagaataatgcaaggcatagactgaattacgaaaatgttatagcagcttgggataaacaagaatctcctagagatgtaaaaaacaacacaagtagcttccagctagttcctccagggatagaggagaagagagtaagaagtgagagagaagctagagtttggagatacagagataaaaggaagaatcgtttgttcgagaagaagataaggtacgaggttagaaaggttaacgccgacaaaaggccgagaatgaaaggtcgatttgtccgacgatctttagccatcgactcttag

SEQ ID NO: 56 - DNA, 735 bp, Arabidopsis thaliana
atggtgaaacaagaactcaagatccaagttactacttcctcatcatcactctctcattcttcatcttcttcttcttcttcaacgtcggcactacgtcatcaatcttgtaagaacaagataaagaagtataaaggtgtgaggatgcgaagttggggatcatgggttactgaaattagggcaccaaatcaaaagacaagaatctggttaggttcttactccaccgcagaagcagctgctagggcttacgacgctgctctcttgtgtcttaagggacctaaagctaatctcaacttccctaacatcaccactacttctccttttcttatgaacatcgacgaaaagacccttttgtccccaaaatcaatccaaaaggtcgccgctcaagccgctaactcctcttctgaccattttacccctccgtccgatgaaaatgatcatgatcatgatgacggactcgatcaccatccatctgcttcttcttcagctgcatcttcaccaccagatgatgatcatcataatgatgacgatggtgatttggtatcgttgatggaatctttcgtggattacaacgaacacgtgtctctgatggatccatcgctgtatgaatttggacataatgagatcttcttcaccaacggagatccgtttgattattctccacagttacatagctcagaggcaacgatggatgacttctacgacgatgttgatattccgctatggagtttcagttaa

SEQ ID NO: 57 - DNA, 1185 bp, Arabidopsis thaliana
atgtattaccaaaaccagcaccaaggaaagaacatcctctcatcttcaagaatgcatataacttctgaaaggcatccattccttagagggaatagtccaggtgattctggacttatcctatcaaccgatgcaaagccacgcctaaaatggactccagatcttcatgagagattcattgaagcagtcaatcaactcggtggagcagataaagctactcctaagacaatcatgaaagtcatggggattccaggccttaccttataccatctcaaaagtcatcttcagaaatacaggctgagcaagaatctcaacggacaagctaacaacagcttcaacaaaataggtataatgaccatgatggaagaaaagactcctgatgcagacgaaattcaaagcgagaatttaagcattggaccacagccaaacaagaattcaccaataggtgaagcactgcaaatgcaaatagaggtccaaagaaggcttcatgagcaacttgaggtacagcgacatttgcagcttaggatagaggctcaagggaagtacctgcaatcggttttggagaaagcacaagagactcttggaagacagaacctcggtgcagctgggatcgaagctgccaaagttcaactctcggaactagtatctaaagtatcagcagagtacccaaactctagtttcctagaaccaaaagaacttcaaaacctatgctcacaacagatgcaaacaaactatccacctgattgctctcttgaaagttgcctgacctcaagcgagggaacgcagaaaaactcgaaaatgctagagaacaacagattaggactaagaacgtatattggtgattcaacatcggagcagaaagagattatggaagaaccattgttccaaagaatggagctcacatggacagaaggtctaagagggaatccatatctttcaacaatggtgagtgaagcagaacaaagaatctcatattcagaaagaagtccaggtagattatcaataggagtaggattgcacggacacaaaagccaacatcaacaaggcaacaatgaggatcataagcttgaaacacgaaaccggaaaggcatggattcaacaacagagctagatctcaacacacatgttgaaaactattgtacaacgcgtacgaaacagttcgacttgaatggtttcagctggaactga

SEQ ID NO: 58 - DNA, 501 bp, Arabidopsis thaliana
atgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttag

SEQ ID NO: 59 - DNA, 816 bp, Arabidopsis thaliana
atggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaagaagaagaaatcatcaaataccatgctcttcttggaaacaggtgggcagcaatagctaagcaaatgccaaacagaacagataatgacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacggtgtgtacgtatctgatttctacgatgagactgaacaccttgacctgttccttctttga

SEQ ID NO: 60 - DNA, 1044 bp, Arabidopsis thaliana
ttaattaatgaattcattttcccacgtccctccgggttttagatttcacccgacagatgaagaacttgtagactactacctgaggaaaaaagtcgcatcgaagagaatagaaattgatttcataaaggacattgatctttacaagattgagccatgggaccttcaagagttgtgcaaaattgggcatgaagagcagagtgattggtacttctttagccataaagacaagaagtatcccacagggactcgaaccaatagagcaacaaaagcagggttttggaaagccaccggaagagataaggctatctatttgaggcatagtctaattggcatgaggaaaacacttgtgttttacaagggaagagccccaaatggacaaaagtctgattggatcatgcacgaataccgcttagaaaccgatgaaaacggaactcctcaggaagaaggatgggttgtgtgtagggttttcaagaagagattggctgcagttagacgaatgggagattacgactcatccccttcacattggtacgatgatcaactttcttttatggcctccgagctcgagacaaacggtcaacgacggattctccccaatcatcatcagcagcagcagcacgagcaccaacaacatatgccatatggcctcaatgcatctgcttacgctctcaacaaccctaacttgcaatgcaagcaagagctagaactacactacaaccacctgcaatcaaatatcgcgcatgaggaacaattgaatcaaggaaatcagaacttcagctctctatacatgaacagcggcaacgagcaagtgatggaccaagtcacagactggagagttctcgataaatttgttgcttctcagctaagcaacgaggaggctgccacagcttctgcatctatacagaataatgccaaggacacaagcaatgctgagtaccaagttgatgaagaaaaagatccgaaaagggcttcagacatgggagaagaatatactgcttctacttcttcgagttgtcagattgatctatggaagtgaggcgcgcc

SEQ ID NO: 61 - DNA, 1249 bp, Arabidopsis thaliana
ttaattaaatgaccaaaacccggattctcaacccgacccgattcccttctcccaaacccttacgtggctgcggcgacgctaacttcatggaacagctcctccttcactgcgccaccgccatagactccaacgacgctgcattaactcaccaaatcctctgggtcctcaacaacatcgctccaccagacggtgactccacccaacgtcttacatccgcattcctccgcgcgttgctctcacgcgccgtctccaaaacccctacactatcatccaccattagcttcctacctcaggccgatgaactccatcgtttctcagtcgtggagttagccgctttcgtagacctcactccgtggcaccggttcggattcattgcagccaacgccgcgatcttaaccgccgttgaaggttactcaacggttcacatcgttgacttaagtttgactcattgtatgcaaatccctactcttatagacgccatggcaagccgactcaacaaacctcctccgcttcttaaactcaccgtcgtctcttcctccgaccacttcccaccattcatcaacatctcctacgaagaactcggatctaaactagtcaacttcgccaccacacgaaacattacaatggagttcacaatcgtaccttctacttactccgatggcttctcctccctcttacaacagttacggatttatccttcttcattcaacgaagctctcgtcgttaactgtcacatgatgctccgttacatccctgaagaacccctaacttcatcatcatcatcgctccgaacagttttcttgaaacaactccgatctttgaatccaagaatcgtaaccctaatcgaagaagacgtagatctcacatcggagaacttggttaaccggttaaaatcggcgtttaactacttctggattccgttcgatacgacggacacgtttatgagtgagcagagacggtggtacgaggcggagataagttggaagatagaaaacgtggtggcgaaggaaggtgcggagagagtggagaggacggagacgaagagacggtggatagagagaatgagagaggctgagttcggtggagttagggttaaagaagatgcggtggcggatgtgaaggcgatgctggaggagcacgctgtcgggtggggaatgaagaaggaagacgacgacgagagtctcgtgctgacgtggaaaggtcatagtgttgtgtttgctaccgtttgggttcccatttaaggcgcgcc

SEQ ID NO: 62 - DNA, 919 bp, Arabidopsis thaliana
ttaattaaatgtcttccatcccaaataggttcaatatttatggtggtgataccacaaaccatcgtgaatcgcttcccatcgaaatgaatcacaactctcgaatggttcgatccatgttcattacatctgatcgcatgaatcatagagatttgttttcttctcctccttctttctcttcttatcaaaattcacatatctcttcatcttctgttgggtttaataattcacatatgacttatcatatgctgaaaagaaattatgattctgtttcccgtgctgattatttctctactaaagatcattctcattttactcaagtatctttcactcaaaccatcacaaataagtatactactattgttccttccaatatatttgacactgttcactatgatattggtcgtgtcaaacgtgccatagattttagaaatatttggaatcctaaatctcatcttccaaaaaaatttaataggcaatgcgagattttgaatcctacccctcttaatatcgtctttccgcaccaggattcagctgatcgtcaacatttagacattattttctcgtcatcaaagcacaaccatgttttccaagatggtcgatccttgaagaaaatttccgaaccaaccaatctgtttgaaaaatctaattcttatgattctcaagaagatgagaaaatcgatgcttatcaatatgatggtcgtacacatagtctaccgtatacgaaatacggtccatatacatgtcccaggtgtaacggtgtgtttgatacttctcaaaaatttgctgcacatatgttatctcactacaataatgagacggacaaagaaagagaccaaagatttcgtgcaagaaataaaaaacgatatcgtaagtttatggacagtcttaaaatatcaaaacagaagatatgaggcgcgcc

SEQ ID NO: 63 - DNA, 1189 bp, Arabidopsis thaliana
ttaattaaatgagtgacaaagacgagtttgccgcaaagaagaaggatttggtcaatacgccagtggatttgtatcctccggagaatccaatgttgggtccttctccgatgatggattcattcagagaaactctttggcatgatggtggtttcaatgtccacacagatgcagacacttcctttagaggtaataataatattgatatacctcttgaaatgggttggaatatggctcagttccctgcagattcaggattcattgagcgtgctgcaaagttttctttttttggatgtggtgaaatgatgatgaaccaacaacaatcatctcttggagttccagattcaactggcttgtttcttcaagatacacagattcctagtggatccaaactagataatggtcctcttactgatgcatctaagttagtgaaagagagatcgattaataatgtatcagaggattctcaatctagtggaggtaatggtcatgatgatgctaagtgtgggcaaacatcttccaaggggtttagtagtaagaagaggaaaagaattgggaaggattgtgaagaagaagaagataaaaagcaaaaggatgagcaaagtccaacttcaaatgcgaacaagacaaacagtgagaagcaaccttctgattctttaaaggatgggtatattcacatgagggcacgaagaggccaggctactaatagtcacagtcttgctgaaagagtaagaagagaaaaaatcagtgaaaggatgaagttcttgcaagatcttgtgccaggttgcgacaaggtgactggtaaggcagttatgctcgatgaaatcattaactatgtgcaatcacttcaatgccaaatcgagtttttatcgatgaaactttcggctgtgaatcctgtgctcgattttaacctcgaaagcctccttgcaaaagatgctcttcaatcatctgcaccgacatttccccacaacatgtcgatgctttatcctcctgtatcgtatctctctcaaacaggattcatgcaaccgaacatttcctcaatgtcgctattgagtggaggattaaaacggcaggaaacacatggatatgaaagtgatcaccacaatcttgtccacatgaaccatgaaaccggcactgcacctgatcatgaagatacaacagctgacatgaaggtggagccgtagggcgcgcc

SEQ ID NO: 64 - DNA, 1240 bp, Arabidopsis thaliana
ttaattaaaagtttgaagaaccaaatctcttcctcttcttctctttctcctcttcttcaatggatgatcatgttgagcacaattataacacatctttagaagaagtacacttcaagagcttaagtgattgcttacaaagctcattagtaatggattataactcactagagaaggtcttcaaattctcaccttatagttccccttttcaatcggtttcaccgtcagtaaacaacccttacttaaatctcacttcgaattctccggtggtctcatcttcctccaatgaaggcgagcctaaagagaacaccaacgataagagtgaccaaatggaggataacgaaggcgacctacatggtgttggtgaaagctccaagcaactgtgagtttttttcaaccttttacttttctttcggagttcctcacatatttttgttctttatggactagatgtcctgaaacaaaatttagactatataattaacgtgaagcttataaaaatcaacaatcacttgccaacatagaacgtggaaacccttgagattgatatgctttagatggatggggtatggtcaggacaaaacaaggtaaaaagaaaggagagaagaaagagagagaagttagggttgcatttatgaccaaaagcgagattgatcatcttgaagatggttatagatggcgaaaatatggacaaaaagcagtgaagaacagcccttatccaaggttcatttattcactacactctattcaaatccacacatttataagttacagatatatatatcataatggttttgtaagaaaataaagtgtatattatcataatatcataatttgtttatgcgttttcaggagttactataggtgcacaacacagaagtgtaacgtgaagaaacgtgtagagagatcgtttcaagatccgtcgatcgtaattacaacctacgaaggaaaacacaaccatccgatcccatcgacgttgagaggaaccgtggcagctgaacatctactagtccaccgtggtggtggaggcagtttactccatagcttccctcgtcaccatcaagattttctcatgatgaaacattctccggccaattatcaatcggtgggatctctgtcgtacgaacatggccatgggacctctagttacaattttaataataatcaaccagttgttgactatggtcttcttcaggacattgttccttcaatgttctccaagaacgagtcttgagggcgcgcc

SEQ ID NO: 65 - DNA, 1218 bp, Arabidopsis thaliana
ttaattaacactggttttggaaattggtgaatgtgattaatgggtagcagtgagatggaaaaatcaggtaaagagaaagaacctaagactacaccgccttcgacttcttcatctgctcctgctactgttgtttcacaggaaccttcttctgctgtgagtgctggagtggctgttactcaagattggtctggcttccaggcttattctcctatgccgcctcatggttatgtagcatcaagtcctcaacctcatccttatatgtggggcgttcagcatatgatgccgccttatggaacaccgcctcatccgtatgttacgatgtatcctccaggtggcatgtatgctcatccttcattacctccggggtcttatccatatagtccctatgcaatgccttctcctaatggaatggctgaagcttctggtaatactggaagtgttattgagggtgatggtaaaccatctgatgggaaggaaaaattgccaatcaaaagatcaaaaggaagcttgggaagtttgaatatgattataggaaagaacaatgaagctggaaaaaactcaggagcatcagctaatggagcttgttctaaaagtgctgagagcggttctgatggatcaagtgacggaagtgatgcaaattcacaaaacgactctggctctagacacaacgggaaggatggtgaaacagcttcagagagtggtggttctgctcatggaccaccccgtaatggaagtaatctaccagtgaaccagaccgtcgctatcatgccagtgtcggctacaggtgttccaggcccaccaacaaatctaaatatcggaatggattattggagcggtcatgggaatgtttctggagcagttcctggagttgtagtagatggttcccaatcacagccatggttacaggtttctgatgagagagagattaagcgacagagacggaagcaatccaatagggaatctgctcgtagatccaggttgcgtaaacaggcggagtgtgatgagctagcacaacgagcagaggttttgaatggagagaactcaagtcttagagcagaaattaacaagcttaaaagccaatatgaagagcttcttgctgaaaatagctctctcaagaataagttctcgtcagccccgtcactggaaggtggagacttggacaagaacgagcaagaaccacagagaagtacacgtcaggatgttgcgtagaggcgcgcc

SEQ ID NO: 66 - DNA, 1093 bp, Arabidopsis thaliana
ttaattaaatggctgataataaggtcaatctttcgattaatggacaatcaaaagtgcctccaggtttcagattccatcccaccgaagaagaacttctccattactatctccgtaagaaagttaactctcaaaagatcgatcttgatgtcattcgtgaagttgatctaaacaagcttgagccttgggatattcaagaggaatgtagaatcggttcaacgccacaaaacgactggtacttcttcagccacaaggacaagaagtatccaaccgggaccaggacgaaccgggcaacagtcgctggattctggaaagctaccggacgtgacaaaatcatctgcagttgtgtccggagaattggactgaggaagacactcgtgttctacaaaggaagagctcctcacggtcagaaatccgactggatcatgcatgagtatcgcctcgacgatactccaatgtctaatggctatgctgatgttgttacagaagatccaatgagctataacgaagaaggttgggtggtatgtcgagtgttcaggaagaagaactatcaaaagattgacgattgtcctaaaatcactctatcttctttacctgatgacacggaggaagagaaggggcccacctttcacaacactcaaaacgttaccggtttagaccatgttcttctctacatggaccgtaccggttctaacatttgcatgcccgagagccaaacaacgactcaacatcaagatgatgtcttattcatgcaactcccaagtcttgagacacctaaatccgagagcccggtcgaccaaagtttcctgactccaagcaaactcgatttctctcccgttcaagagaagataaccgaaagaccggtttgcagcaactgggctagtcttgaccggctcgtagcttggcaattgaacaatggtcatcataatccgtgtcatcgtaagagttttgatgaagaagaagaaaatggtgatactatgatgcagcgatgggatcttcattggaataatgatgataatgttgatctttggagtagtttcactgagtcttcttcgtctttagacccacttcttcatttatctgtatgaggcgcgcc

SEQ ID NO: 67 - DNA, 1219 bp, Arabidopsis thaliana
atgaaaagtttggctagtgcggttggagggaagacggcgagggcatgtgatagctgcgtgaagaggcgggcacgttggtattgcgcagctgatgatgcctttctttgccatgccttgtgacggttcggtccactcggcaaaccctcttgctcgtaggcacgagagagttcgcttgaaatcggctagcgccggaaagtatcgccatgcctcgccgcctcaccaagccacgtggcatcagggatttacacgtaaagctcggaccccacgtggaggcaagaagagccacacgatggtttttcatgatcttgtgccggagatgagcacggaggatcaagcggagagttacgaggtggaagagcagctcatatttgaggtgccggtgatgaactcgatggttgaggagcaatgctttaaccaatccctggagaaacagaatgagtttccaatgatgcccttaagtttcaagagtagtgacgaagaagatgacgacaacgctgagagttgtctgaatggtttgttcccaaccgacatggaactagctcagttcacagctgacgtggagactctactcggtggaggggatcgagagtttcattccatagaagaactagggttaggtgagatgttaaagatcgaaaaagaggaggtggaggaagagggagttgtgacaagagaagtgcatgatcaagatgaaggtgatgagacatccccatttgaaataagctttgactacgagtacacacacaagaccacattcgatgaaggagaagaagatgagaaagaagacgtgatgaagaatgtgatggagatgggagtgaatgagatgagtggtgggattaaagaagagaagaaggagaaggctcttatgcttagattggactatgaatcagtcatttccacttggggaggccaagggatcccatggaccgcccgggtgccatctgaaatagacctcgacatggtttgtttcccaacccataccatgggtgaaagtggagcagaggctcatcatcacaaccacttccgcggcctagggttacacctaggagatgctggggatggaggaagagaggctagggtttcaagataccgagagaaaaggaggacaaggttgttctccaagaagataaggtacgaggtacgtaaattgaatgcagagaaaaggcctcgcatgaaaggaaggttcgtcaagagatcttcaattggtgttgctcactaa

SEQ ID NO: 68 - DNA, 1069 bp, Arabidopsis thaliana
ttaattaaatgttctccaacatcgatcaaacagctgtggcagcactcctccgtggccaaggatgcgctaacagtctcaagaggctcctcgaaaaccacaagttaagctcagattcaacagagccgctcatctacaccatactcaattctttctcacttgctctctcttttgtggacccgcctagtcttctaccacacaatgagtcttctcttcaaaacatgacaagtcatgttcttcagagatcatcaaagaagtaagttaccaacaaaaagctaaacactcattgcatatgttacgaacaaagttcatgagtttctagctaactcaaaataaagttaaatagcaattgttttttcatgttacttttatgtctcgtataatttttgatatgcaattatgtcttctatatttttaagcatttctccaatacatcattgtagaaaatattatggagcagaagatttagagtattacagagacgaatccccgactccacgccccgatgacggcttcacctggaggaaatatggacaaaaaactatcaaaacctcaccgtaccaaaggttagtcaattaggttacctagaaaaacagagcaagttctctgttcttacaaaaagaaagtaaattctcttctttattctttgaaatacatgtaaataaaagtgctatattcacaggtgttactatcggtgtacctatgcaaaagaccaaaactgcaatgctagaaagcgggtgcagatgatccaagataaccctccagtgtacagaactacttatttgggaaaacatgtgtgtaaagctgttgcagttcatgatgatacatatggttctgaaatgataaaattcgaccaagttgtatctgaatcggttatgcctcaactcgcaacaattgacgaacaagcaattaccatggaggacgaagccatagaccatatcatgaaccaagaatgtgatattaatgatttttctgtggatgatgacccattttgggctagtcaatttcctccattttcatcggaagacattatgttttttgacaatattgctaatcttgattagggcgcgcc

SEQ ID NO: 69 - DNA, 1228 bp, Arabidopsis thaliana
ttaattaatgggttttgtctaaaaatataaaaatatatctttttacggatttgaagatgaatcagaattcctctgttgcggaggcgacgcttcagcttaattccggtgaaaaaccatcgccgggatcgattccgtttatctcctctggtcaacacggaaacataagcacttcagcgacgagttcgacaagcacaagctcaggtagtgctcttgccgtagttaaatccgccgtgaaaaaaccaactaaagatcggcatactaaagtcgatggtcgtggacggcgaattcgtatgccggcgatgtgcgccgctagagtttttcagttaacaagagagttaggtcataaatctgatggagaaaccatcgagtggcttctccaacaagctgagccagctatcatcgcttctactggtactggtacgatcccggcgaatttctcaacacttaacgcttctttacgcagtggtggtggctccaccttgttttctcaggcgtcgaaatcttcttcttcgccactctcgtttcatagcactggaatgtctctttatgaagacaataacggtactaacggatcatcggtagatccttctaggaagttactgaattcagccgcaaacgcggctgttttcggttttcatcatcagatgtatccaccaataatgtcgacggagagaaatccgaacactttagtgaaaccttatagagaagattactttaaggagccgagttctgcagcggaaccaagcgagagttctcagaaagcgagtcagtttcaggagcaagagttagctcagggtcgtgggacggctaatgtggtgcctcaacctatgtgggcggttgcgccagggactacgaatggaggtagtgcgttctggatgcttccgatgagcggttcgggtgggcgggagcagatgcagcagcagcctggtcaccaaatgtgggcgtttaatccagggaattatccagttgggacaggacgagtagtaactgcaccaatggggtcaatgatgttgggaggtcaacagctaggattaggagtggcagagggcaacatggcggctgcaatgcgtggcagtagaggcgatggtttggccatgactctagatcaacatcagcatcagctccaacatcaagagccaaaccagagtcaagctagtgaaaatggtggtgatgacaaaaagtgatcaatccttttctctagttccacctcaacattgtaaggcgcgcc

SEQ ID NO: 70 - DNA, 1017 bp, Arabidopsis thaliana
ttaattaacttctttcaaatgtcttctatgccaaataagttcaatcctcactgtgatgataacaatcgtggtttttcctccatccaaatgaatcaaaattctcaaatggttcattcgaggttcattacttcggatcacacaaaccatggtgatctgttttcatcatctccttctttttcttgttttcataattcacatgcctcttcatcttcatttggattccaaaattcacatgtggaaaatcatatgatgaagagaaacataatttctgatgacaattatttttctatcacaaacaatcctcattttactcgagtttctttcacacaaaccattacaaacaaatttacagccattgttcctactaatacacttgacgctgtacaatatgatgctcaacgtgtcaaacgtgccatgaatcccaaaaccaatatttggaatcctatattttctcctccaaatacttttgataaacaatgcgaatttttgaatcctaaacctcttaatgtcatttttccgagtcaaaattctgcatatcctcaacatttagacatgttttccttgtcatcaaagcacaatcatgatcaacgtgttctccaagatggtcgttctatgaagaaaatcttgaaaccaaccatattttttgaagcaactactgattacattgagtctcaagaaaacgagaaaagtaacaatgatcacaatgatggtaggacacatagtctaccatatgaaaaatatggtccatatacatgtcccaagtgcaatggcgtctttaatacttctcaaaaatttgctgcacatatgtcatctcactacaagaatgaaacaagcgaagaaagagaacagagaattcgtgcaaagaacaaaagaaaattttgtaaactaaatcgtgaaattaatggtgagcctcaaaagaccaaacaagaggatgtggccaacaacagtgaaaaaagtgacgataaaactttccaacatcttgtggtcgtaaaagaagagcttgtttaggggcgcgcc

SEQ ID NO: 71 - DNA, 1501 bp, Arabidopsis thaliana
ttaattaaatgtatgaggaaagttcatgttttgatcctaattcgatggtggacaacaacggcggcttctgtgcggcggaaacaacttttacggtaagccaccagtttcaaccaccgcttggaagcacaacaaacagctttgatgacgatcttaagctcccaacaatggatgagttctctgttttcccttctgttatctctctcccaaactcagaaactcagaaccaaaacatcagcaacaacaaccatttgatcaaccaaatgattcaagaatcgaattggggtgtttctgaagacaactctaatttcttcatgaacacttcacatccaaacacaacaacaactccaatccctgatcttctcagcctcttgcatttgcctagatgctctatgtcattaccaagctctgatataatggcgggttcttgcttcacgtatgacccgctctttcacttaaaccttcctccacaacctccattgatcccttctaatgactactcagggtacttgcttggtattgataccaatactactactcaaagagatgagtctaatgttggagatgaaaataacaatgctcagtttgatagcggaatcatcgagtttagcaaagagattaggcgtaaaggaagagggaagcgaaagaacaaaccttttactacagaacgtgagcgaagatgtcacttgaatgagcggtacgaggccttgaaattgctcattcctagcccgagtaaggttagttatttacttatgacaacaatctttcttggtttagcttcattcattatctccaatggcactttgcttaattcatattatatgttatttagggagatagagcatcaattcttcaagatggaatcgattacatcaacgagttacgcagaagagtaagtgagcttaagtatttggtagagaggaagagatgtggtgggagacacaagaacaatgaagtagacgacaacaataacaacaaaaacttggatgatcatggtaatgaagatgatgatgatgatgatgaaaacatggagaagaagccggagagcgatgtaatagaccaatgttcaagcaacaactcgctgagatgttcatggctgcagaggaaatcaaaagtaacagaagttgatgttaggattgttgatgatgaagtaacaatcaaagttgttcagaagaagaagatcaattgtttgttacttgtctccaaagtacttgatcagcttcagcttgatcttcaccatgttgccggaggacagattggtgagcattacagtttcttgttcaacaccaaggttagtgatcaatgaatatatatatatatataacaaatcttggtttatggattttgatatatactggatttagttttggtaataatgattgaataaattgcagatatatgaaggatcaacaatatatgcaagtgcaatagcaaacagagtgattgaagttgtggataaacactacatggcttctcttcccaacagtaactattaaggcgcgcc

SEQ ID NO: 72 - DNA, 1351 bp, Arabidopsis thaliana
gctttcaaactctttgtttcttgtttgttgattaacccttaattaaggctagagaccaagatgagatcaagcagccaaaattctgaaaactccaagacttgtctatctaacaacatcaaagcaaccaccaagaatgaagaagataaagatgaagaggatgatgaagaaggcgaagaggatgaagaagagagatctggagatcagagcccatctagcaatagctatgaggaagagagtgggagtcaccaccatgatcagaacaagaagaatggaggatccgtgaggccgtacaaccgctcaaagactccgaggctgcgatggacgccggagctccatatttgctttcttcaagctgtggagagattgggtggcccagatagagcaacaccgaagcttgttctccaattgatgaacgtcaaggggctaagtattgcccatgttaagagtcatcttcagatgtacagaagcaagaagaccgatgagcctaatgaaggagatcaaggattttcgtttgaacacggagctggttacacttacaaccttagccaacttccaatgctacaaagttttgatcaaaggccttcttctagtttaggatatggtggtggttcgtggactgaccacagacgacagatctaccgtagcccttggagaggattaacgacacgagaaaatacaagaacaagacaaacaatgtttagctcacagcctggtgagagatatcacggagttagcaatagtattcttaacgataagaacaaaactatttcatttcgaatcaattctcatgaaggggttcatgataacaatggagtagctggagctgttccaagaattcatagaagttttcttgaaggtatgaaaacgtttaacaaatcatggggacagagcctctcttccaatcttaagtcctccaccgcaacaataccacaagatcatattgctacaacgctaaattcttatcaatgggagaatgctggagtggcagaaggatcagagaatgttttgaagaggaagaggttattattttctgatgactgcaataagtcagaccaagatttggatctaagcttgtcccttaaggtacctcggacacacgacaatcttggagaatgcttgttagaagatgaagtaaaagaacatgatgatcatcaagatatcaagagtttgtctctttcgttatcatcttcaggttcatcaaaactcgaccgaaccattaggaaagaagatcaaactgatcacaaaaagagaaagatttcggtcttggcaagtccccttgatctcactctgtgaatatgtataacaacatttaaaaatacccagcaaattggagctctgcagagctttcgtt

SEQ ID NO: 73 - DNA, 805 bp, Arabidopsis thaliana
ttaattaaatgtgcggaggagctgtaatttccgattacatagcgccggagaagattgcgagatcatctggaaagtcttcctggagaagtaatggcgtctttgactgctcaatctacgatttcgatggaaatttcgatgaattagagtccgatgagccatttgtcttctcctctactcacaaacatcatgcttcaggctcagcatcagatgggaagaagaaacagagcagtcggtacaaaggaatcagaagaaggccttggggaagatgggcggctgagatacgtgatccaatcaaaggagttcgagtttggctcgggactttcaacacagctgaagaagctgcaagagcttatgatcttgaagctaagagaatccgtggagccaaagctaagctcaatttccctaacgaatcctctggaaagaggaaagccaaggctaagactgtgcaacaggtagaggagaatcatgaggctgatcttgatgtggcggtggtaagctcagcgcctagtagtagctgtcttgatttcttgtgggaggagaataatccggacacgcttctgattgatacacaatggctcgaagatatcatcatgggcgatgcgaataagaaacatgaacctaatgatagtgaagaagccaacaacgttgatgcttctctgctttctgaagagcttcttgcttttgagaaccagaccgaatatttctcgcagatgccttttacggagggaaactgtgattcctcaacgtctctgagtagtctctttgatggaggcaatgacatgggtctatggtcctgaggcgcgcc

SEQ ID NO: 74 - DNA, 880 bp, Arabidopsis thaliana
ttaattaaatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggcgcgcc

SEQ ID NO: 75 - DNA, 664 bp, Arabidopsis thaliana
ttaattaaatggaactaaacctctctacacccacatcatgttcctccagcagcatctcatcatcttcgcatgaggccatccctaggaccaagggtaaaacgaaagaggaggtcacggctgagccgtcgaaggagaatcagcagcggctagagttccgcttcctgttcaacgagagtagtacaagaaacgaggctaaagcgagggtgtttgcttgcaccttctgcaaaaaagagttctctacgtctcaagccttaggaggacatcagaacgctcacaagcaagagcgatcattggctaaaaggcgtaaagagatcgaaatcaactatcctgaactctccatctacagccagtacccgccaagtggactttccttcagcagcagctcctcgcagtatgatctcggggttcgttacaatcctaacattgctaaaactactaagccctatccgttcaacatcttcgcatgtcgatttggatacagagggggactaaatttccctcccatgtctcacctctcggttccaaagacagacgatttgtccataaacttgatttcaaatctagagggcagcattcacgaccaagccgtaaaaaaagatcaacctgaagctgatccttgcaaggattctgatatagacttgtcccttaagctatagggcgcgcc

SEQ ID NO: 76 - DNA, 798 bp, Arabidopsis thaliana
ttaattaaatggacatttctgcgcagagatttgccatgaacggaagaagcatgagactccctcccgggtttcggttcgatcccgatgatgaagatcttgtgttcgagtatctcgccaagaaggtcctccaccgtccaatggacttcgatctccctgagctccgttcttgcaatgttgatccatgggacttgctaggtttgctacaaactcttctctctaataattactataccatatcacgtcaaatgtattgaaaaatgtggtttagtgaatgttgtacgtacacttttgttgtaggagagaagaacaaggaagtgtattacttcgtgaagaaggaagagcgagagaggaagggaagagagacgttatccggttattgggaagagtgtgaagaagaggaagtaatggaggctggtggtcgtgattgtattcatttagaaggaaggagaaagacatttgctttctttattggaaaaaaacctcgagggacaataactccatggatcatgtacgagttccgacttctttcctctagagctacaaggtggtcatcgtcccctctacctcgggtgagtcactcattggacttttatctttttctataacatatatttttgttgtaagtaatagtttagagctaactatatcaatgttttgggttttaaagggtgaggtaggaaaatggagggcggtgaaagtcgtagtgaaggaagagaatgatgaagagatggtggaggatgagcacgagtctgacgagtctgatggcgaggaagttattcaaagccggtgaggcgcgcc

SEQ ID NO: 77 - DNA, 757 bp, Arabidopsis thaliana
ttaattaaatggctccagtcggattacctccaggctttagatttcatccgactgacgaagaactcgtaaactattatctgaaaagaaagatcaacggtcaagaaatcgagcttgatataattcccgaggttgatctctacaaatgcgagccatgggacctcgcagagaagtcgtttctaccaagtagagatccggagtggtatttttttgggccacgtgaccggaagtatccgaacgggtttaggacgaaccgagcaacgagaggtgggtactggaaatcgaccggcaaagatcggagagtgacaagtcaaagcagagcgattgggatgaaaaagactttggtttattataaaggaagagctcctcaagggatccgtacggattgggttatgcatgagtatcgtctcgatgataaggattgtgacgatccctcttcgctccaggactcgtatgcattgtgtcgggtattcaaaaagaacggaatatgttcggagttggaatcagaacggcaattgcaaacgggacaatgtagcttcacaacggcgtcaatggaggagatcaattcgaataacaacaacaattataataatgattatgagacaatgtcgccggaggtgggagtttcctccgcctgcgttgaagaagtagtcgatgataaagacgattcgtggatgcagtttataacagatgacgcatgggacacgtcatcaaatggtgcagctatgggacatggtcaaggggtttattgaggcgcgcc

SEQ ID NO: 78 - DNA, 1402 bp, Arabidopsis thaliana
ttaattaaatggcggttgaagacgatgtatctttgataagaacgacgacgttagtggcaccaacaagacccacgattacagttcctcatagacctccggcgatcgaaacggcggcgtatttctttggcggtggagatgggcttagtctaagcccagggccactttcttttgtctcttctttgtttgttgataacttccctgacgtcttgacgccggataaccaacggacgacgtcgtttactcagcttcttaacggaactatgtcggtgtctcctggtggcggaggacgttcaacggcggggatgttcgccggaggaggtccgatgtttacaatcccttctggtttcagcccttctagtcttctcacctcgcccatgttctttcccccgcagtcgtcagctcataccggctttattcaaccacggcagcagtcacaaccgcaaccacaacgaccagacacgtttcctcaccatatgccaccatcgacatccgtcgccgtccatggtcgtcaatctttagacgtttcacaagtagatcaaagagctcgaaaccattataataatccggggaataacaataataaccggtcgtataacgttgtgaacgttgataaaccggcggatgacggttataactggaggaagtacggacaaaagcctatcaaagggtgtgaatatccaaggagttattacaaatgtacacatgttaactgtccggtgaagaagaaagtcgaacggtcatcggatggacagatcactcagatcatttacaaaggtcaacatgatcacgagaggcctcagaatcgccgtggcggtggaggcagagattccactgaggttggtggtgcagggcaaatgatggaatctagtgatgatagtggttatcgtaaggatcatgatgatgatgatgatgatgatgaagatgatgaagatcttccggcttcaaagataagaagaatagacggtgtgtcgacgactcaccggacggtgaccgagcctaagattatcgttcagacaaaaagtgaagtcgatcttctcgacgatggctataggtggcgtaagtacggacaaaaagttgtcaaaggaaatccccatccaaggagctattataaatgtacaacgccaaattgtacggtccgtaaacatgtagagagagcttccacggatgctaaggctgtgattacaacttacgaaggtaaacacaatcacgatgtccctgccgctagaaacggtaccgcggcagcaaccgcagctgcggtggggccgtctgaccaccatcgtatgagatcaatgtcggggaacaatatgcaacaacatatgagtttcggtaacaataataacacaggccaatctccggttcttttgaggttgaaagaagagaaaatcacaatttgaggcgcgcc

SEQ ID NO: 79 - DNA, 1315 bp, Arabidopsis thaliana
ttaattaaatggcgtcctcatcagaactaagcttggattgcaagccacaaagctactctatgcttttgaaatcctttggagataactttcagagcgatccaaccacacataagcttgaagatcttctctctcgcctagaacaagaacgtctcaagatcgatgccttcaaacgcgagcttcccctttgcatgcaactccttaacaatgctgtggaagtttacaaacaacaactagaagcatatagagcaaatagtaataacaataaccaaagtgttggtacaagaccagttctcgaagagttcatacccttaaggaaccaacccgaaaagacaaacaacaaaggaagtaattggatgacgactgctcagctatggagccaatccgaaaccaaaccaaaaaacattgattcaactactgatcaatctcttcccaaagacgagattaatagtagtccgaaactcggacattttgatgcaaaacaaagaaatggcagcggtgcttttcttcccttctctaaggaacaatctttgcctgaattagctctatccacggaggtcaagagggtctctccgaccaacgaacatactaatggccaagacggtaatgatgagagcatgatcaacaatgataataactataataataataataataacaattcgaacagcaatggagtttcttctacaacgagtcaaagtaatagaaaggcacgacgttgctggtcgccggacttgcaccggagatttgtccaagctcttcaaatgcttggtggctcgcaagtggctacacctaaacaaataagggaactcatgaaagttgatggtttgaccaatgatgaagtcaaaagccatctccagaagtatcggcttcacactagaagaccaagcccaagcccacaaacgtcaggtgggccaggtccacatttggtggtcctaggtggcatatgggttccaccggagtacacctccgcacatggtggcactccgactctctaccaccaccaagtccaccaccaccataccaacacggcagggccgcctccaccacacttttgctcctctcaagaattctacacaactccaccgcctcctcagccgctccaccaccaccactttcaaacgtttaacggttcatccggtggcaccgcctctaccgattctactcatcatcaggtgacggacagtcccacagttgaagggaagtcaccggagagtggtggtggagagagaaaagggttggctgctcttagggaagaatgtgaagatcacagcaatattaatggaagtgaaataactctcaaattctaaggcgcgcc

SEQ ID NO: 80 - DNA, 782 bp, Glycine max
ttaattaagaagatgggaaggggtaaggtacagctgaagaggatagagaacaagatcaatcgccaggtaactttctccaaaaggagaagtgggttgctcaagaaagctcatgagatctctgtactctgtgatgctgaggtagctttgattgtcttctctcacaaaggaaagctctttgagtatgctactgattcatgcatggagaagatactggaacgccacgaaaggtatgcctatgcagagaggcagctagtagcaaatgattctgaaacacagggaaactggaccattgaatacactagactgaaggcaaagattgaccttttacagagaaaccacaggcactatatgggagaagatttggcttcaatgagcctcaaagagcttcagagtttggagcagcagttggatactgctatcaaaaacatccgcacaaggaggaatgatctcatgtacgcttccatttctgagcttcaaaaaaaggagaaaatgatacaagagcagaataacatccttgcaaagaagatcaaggagaaagagcaggcagtagcacagcaagctgcacaatgggagcagccaaactacagggttgatacatctttcatgccacagcagcaaccccttcgcaccagtttgaacataggcggcaataattacaatcaggaagctgcaccagaactaggaaggaatggtcttgacctgaccctggaaccactgtattcttgccaccttggatgcttctgaaaattgtttcctcgaggtggataatattatatttaaat

SEQ ID NO: 81 - DNA, 1091 bp, Glycine max
ttaattaaacacacaaacacaaacccttcgttcctctctcgttcccttcttcaattcgatcaaacacagaatagtacttttttattatgatggccgtggcccgaaaggaaatggaccggatcaagggcccgtggagcccggaggaggacgaggctcttcagaagctcgtggagcggcatgggcccagaaactggtccctcatcagcaggtccattccgggccggtctgggaaatcgtgcaggctccgatggtgcaaccagctgtcgccacaggtcgagcaccgggccttcacgccggaagaggacgagaccataattagggcccatgctcggttcggtaacaagtgggccaccatagcccgcctcctctcgggccgcaccgataacgccatcaagaatcactggaactcaacgcttaaacgcaagtgcgcgtccttcatgaccgccgatgaagccgccggcggcggcttcagcccgaggccgctcaagcgatcgttcagcgccggcacggcggtgcctcctccaggaagcccctccggatccgacgtgagcgagtccagcgctgctcccggcgtggtctctgtctctgtctctgtctctccttcacaagtgtttcgccccgtgccggttcggccggttgtcgaaacggcgtcgtcgcaagacgacgccgacgccgaggatgctggacctactacctcgctttcgctgtctcttcccggggtggagtcatcggaaatctctaatcgcacctcgacggttccggtgatgccggtgaacaccgtggctgtggcggctccggttccgttaccggcgccggaggttggattaggagcgttgaatttgaatgcggagtttatggcggtgatgcatgagatgataaggaaggaggtgaggagttacatggagcagcagaatgggatgatgtgttttcagggtatggaaatgatggaagggtttaggaacgtgtcggtgaagagaattgggattagcagggtggattcgtaattattattattattattattattatgacctaattagtgttttcacaaaatgaggtttatgaagaactatgatcaagggaatttaaat

SEQ ID NO: 82 - DNA, 1279 bp, Glycine max
ttaattaacctcatcccctaccttaaattgcttctaccctaagccccaagtaacgtttcactcattcacattcacacactcaatgaagggagttacagtgaaagttgaagaaacaatggcgtatgctaatgctgcttcaactagcccaacaacatcttcaaacctctccccgcaacccatggaagggttgcacgaggtgggtccccctccgtttctcaccaaaaccttcgacgtggtggaagacccatccaccaacgacatcgtttcgtggagcagatcccgcaacagtttcgtcgtttgggactctcacaagttctctaccaccatcctgcctcgctacttcaagcacaacaatttctccagcttcgtacgacaactcaacacctacggttttagaaaaattgatcctgacaagtgggagtttgcgaacgaagggtttttggcggggcagaggcaattgttgaagacgataaagaggaggaggcacgtgacagtgacacagacacagtcacacgagggaggaagtggggcttgtgttgaattgggggagtttgggttggaaggtgagatggagaggttgaggagagacaggacagtgttgatggctgaaattgtgaggttgagacaacaacagcacaactcgagggagcaattgttgtccatggagactaggttgcaagccactgagaagaaacatcaacagatgatgaattttctggctaaagcactcaacaaccaggcttttattcagcagtttcttcaaaggaatgctcagaacaaagagttgcaaggtgcgagaagaaagaggagactaactgctaccccaagtgtggagaatttgcagcaagatcatttcgctttgtcaattgaagaaggatcggctactattgagtcacagatggagtcttttttctcagctgcgtgtaatgatccgttagaatcaaacagtgaactcaaagacccaatattgagttcagttccagttgcaagtgggagtaatttgggggaggtgagtgattctgtttgggaggacttgctgaaccaagacttggttgctggggaccctgaagaggaagttgtgattggtgatttttcacaagttgatgttcctgtggaggatttgattgcggatgctgatgagtggagtgaggatttgcagaaccttgtggatcacatgggttatcttgggtccaaaccgtagtggaaaggaaggattttcattatctagggggttcagataaaactttcccctttgaaccgtggtggtattaatttaaat

SEQ ID NO: 83 - DNA, 1016 bp, Glycine max
ttaattaattctcaacttgtttttgtcatcttgtaaaacatgggaactgctatagacatgtacaacagcagcaacatcgtagcggatttcctagatccgtatagtgaagagctgatgaaagcacttaagccttttatgaaaagtgattatttctctgcctcttcttcttcttcactcgaatcacagccttgttctttttcatctaattctctccccacttcttacccctcttccaaccaaatcaagctcaaccaactcaccccagaccaaattgttcagattcaggcccaaatccacattcagcagcagcagcagcacgtggcccaaacccaaacccacctgggcccaaaacgcgtccccatgaagcacgctggcacggccgcgaaacccacgaagctctaccgcggggtgcggcaacggcattggggcaagtgggtcgctgaaatcagactcccaaagaaccgcacgcgcctctggctaggaacattcgacaccgcagaggaagcagcattagcgtacgacaacgcagcgtttaagctcagaggcgagttcgcgcgtctcaattttcctcatctaagacaccacggagccttcgttttcggcgagttcggagattacaagcctctaccttcttccgtggattccaaactgcaagctatttgcgaaagcttagcgaaacaagaggaaaagccgtgttgctccgtcgaagacgtgaagcccgtgatacacgctgctgagctggcagaggtcgagtctgacgtggcaaaatcgaacgctgaatatgtttatcccgagttcgaggattttaaggtcgagcacgagaacccaatgttttctggtgaatcttcttcgcctgaatccagtgttactttcttggatttctcggacttctcggattctaataatcagtgggatgaaatggagaattttgggttggagaagttcccttctgtggagattgattgggaagctatatgatgactcggtgaattttcgttatgtcaaatgatttaaat

SEQ ID NO: 84 - DNA, 905 bp, Glycine max
ttaattaatttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgtagactccgctggattaactatttgaggcctgatattaaaagagggaatttcacaattgaagaagaagaaactatcattaagctgcatgacatgctggggaacaggtggtcagcaattgcagccaaattgccaggaagaactgacaatgagattaaaaatgtttggcacaccaatttgaagaagaggctgctgaaatcagaccagtccaagtccaaaccaagttccaaaagagccattaagccaaaaatcgaacgttctgattcaaattccagcatcataactcaatcagaacctgacaattttaatttcagagaaatggacacaataacatcatcagcatgcactacttctagtagtgatttttcatcggtcacggttggtgacagcaaaaatatcaagagtgaagacacagagtctacggaaacaatgcctgtgattgatgagagcttttggtcagaagctgcaattgatgatgaaacccccaccatgtcatcatctcagtctttgacaatctcaaatgagatgcgacttcaatacccttttgctaactatgaggaaactttccagcagggtcatcatgcttatgattcaaactttgatgatggcatggatttctggtatgacatatttaccaggaccaatgattcaatagaattgctagagttctgaagttttcatgtgacacgttgaacgagggcaatttaaat

SEQ ID NO: 85 - DNA, 1318 bp, Glycine max
ttaattaatcttcttctgttctctagtttcctgctcttgtttcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggcttcgtacgtcggcgcggctccgccgccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgttagcgcgacggcgacggcggcgaagggcgttttgttgaacttcgaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagtttttttttttttgagttttgtgactgatgaaagaaagaaggtacaagaagaacggcgatttaaat

SEQ ID NO: 86 - DNA, 1169 bp, Glycine max
ttaattaacgacaaagattgcaattacaaaaggttcaattatcaaatctggtcagtggggatacggaacaccaggaagagtctgccatggctgacgccagtcctagaactgatatttctacagatgttgacactgatgataagaatccacggtttgatagaagtcagtcccttgttgctgtggtttctgactccagtgacagatcaaaggataaatcagatcagaagactctccgaaggcttgctcagaatcgtgaggcagcaagaaaaagtcggttgagaaagaaagcttatgttcaacagcttgaaagtagtcgcttaaagttaacccaactggagcaagagcttcagcgagctaggcagcagggaatcattatatcaaactcaggtgatcaagcacattcaatgagtggaaatggggctatggcatttgatgtagagtatgcaagatggctggaagagcagaatcgacaagttaatgagctaagagcagctgtaaattcccatgcaggtgatacagaacttcgcatgattatcgatggtataatggcacattatgatgagatatttaggctgaaggccgatgcagctaaggctgatgtcttccatttgttgtctggaatgtggaagacaccagcagagaggtgttttctatggcttggtggttttcggtcatctgaactcctcaagctcctggtaaatcagttggaacctctgacagagcaacagttagtgggtattaccaacttgcagcaatcttcccaacaggccgaagatgcattgtctcagggcatggaagcattgcaacagtccctttctgagacattatccactggatcacttggctcctctggttcatcaggcaatgtggcaaattacatgggtcaaatggctatggccatgggtaaactagggacacttgaggggttcattaagcaggctgacaatttgcgccagcagactttgcaacaaattcaccgcatattgacaactcggcaatcggctcgtgcactacttgcaatacatgactacttttctaggttgcgtgcccttagctctctttggcttgcccgcccaagagactgatgggtggtaaatagtgtcattaattttcatggatctggcaccagaatcatttgtcgtaggtttttcactcttgcaaatttaaat

SEQ ID NO: 87 - DNA, 1061 bp, Glycine max
ttaattaatgtgtttgccagagggagagagagagccatggcactagaggcagtggtatttccacaatcacaagacccttttggtggtagtggttacggatcagtgaataataaggacttctacaactgcaccttgttggctgctacttcacccaactcatggggggactatgagcaacacatcaacatcaacaaagaagaagaacaaggtggtgcttctatctccacttttcaaccagagagtaattacccttatggaaattggaccagctcctcctcatctatgttaccccacttcaacaatgaacttcaagaaaccactactactgaccccagtaacaccttagatagcttaaacactcgtcccaagaggcgcagagccaaaagcagaaagaacaaagaagaaattgagaaccaaagaatgactcacattgctgtggaacgcaatagaagaaagcagatgaatgagtatctttctgttcttcgctctcttatgccagactcttatatccaaaggggtgatcaagcttctataattggaggtgctattaactttgtcaaagagcttgagcagaggatgcattttcttggtgctcagaaagaaggagaggggaaatctgaggctggtggtgcaacaaacatgcccttttctgagttcttcacctttcctcagtattcaactagtggtggtggtggttgctctgataattctgcagccgtaggtgaagacgtgggtgaggttaagtgtggcattgctgacatagaagtgaccatggtggaaagccatgcaaatctcaaaataagatccaagaagcgccccaagcagctcttgaagttggtttctggtttgcataccatgcgcctcacaatcttgcacctaaatgttactaccaccggtgaagttgttctctactctcttagtgttaaggtagaagatgattgcaagttgggatcagttgatgatatagctgcagctgtgtaccagatgctagataaaattcagcaagaggcaatgttgaattaagatcaaaccttgaccaaatttgccttgcccatttaaat

SEQ ID NO: 88 - DNA, 950 bp, Glycine max
ttaattaatcatttcatttttccttttcacttcactttcccccaattttctttctcaacaatggccgcagcaacacaactccacttaccccctggattccgattccaccccaccgatgaagaactcgtcgttcactatctctgccgcaaatgcgcttcgcaagaaatcgcagttccaataatcgccgaaatcgatctctacaagtacgacccatgggaccttccaggaatggctttgtacggagagaaagagtggtattttttcacgccgagggaccgcaagtacccgaacggttcgcggccgaaccggtccgcggggaccggatactggaaggcaaccggagcggataaaccggttggcaaaccgaaacctgttgggatcaagaaagcattggttttttacgccggaaaagcgcccaagggagtgaaaactaactggatcatgcacgagtatcgtctcgccgacgtggatcgttcggttcgcaaaaagaacagcttaaggctggatgactgggtgctgtgtcgaatttacaacaagaaaggtgcaattgagaagcagcaaccagcaccgccaccaccgagtggtgtccacaaaattgaatgttacgaaatggaagacgtgaagccggagtatacggcggcggattgcctgtacttcgaggcttccgactcggtgccgcggctgcacacgacggagtcgagctgttcggagcaggtggtgtcggcggagtttgcgagcgaggtgcagagcgagcggaagaggcagggcaacagcgagttttcgtataattacatggatgccactctcgggaataatcagatgtcgccgctccaggatatcttcatgtacctctccaggcccttctgaaatcaacacgcacgagacggcacgacgtcgttctttgctttgtgtgtgcatgatgcatttttgacgtgcctgctgatttaaat

SEQ ID NO: 89 - DNA, 1088 bp, Glycine max
ttaattaattttacaaattaaatattgtttaaaagaaagatgtcaagtggagcaacacactggtgttatgcatgcagacagccaattgtgcttgatgggagagatcctgtttgcccttactgtgatggaggatttgtgcaagaacttgacgagttgcgaggaattgcacccaaccataaccataccttttcgtcacagtcaggagactttcatcaaatgcctgacattttcgatgctatacatgcttttatggggcagagaggttctgaccagagatttgggcttatggacgccgttgataatttcatgaggcatagaatggccggaagaaactcaaactttgatgttagagggaggtctggttctctcccagttcctgaacagagttggggcgtttatagttccggtccttatttaatatttcacggtcaagttcctggattcaccttgtctgctggcagcccaagaggtggtcctaggcgtgttgattttggtgactactttatgggtcctggactggaagaacttattgagcaactcaccatgaatgatcagcgtggtccagccccagctgcacgatcttcaattgatgcaatgcctactattaagataacacaggcgcatcttcgctcggattcacactgtccagtttgtaaggaaaaatttgaattgggcactgaagccagagagatgccatgcaaccatatttaccattctgactgtattgttccttggttggttcagcataactcatgtcctgtttgccgtgttgagctgccacctcaaggacaggctagttcccgtggtactcgaagttggggaggaaggaatgccagcaacagcagcagcagtggcagcaatgatagctccaggggcagagagaacagccatcagaaccatggaaggagaaatccattttcatttttgtggccattccgctcgtctaactcgaacaataatcattattctgagactgggggaagcagctcttcaaccactcctgaccagaataatggaacaagttatagcggttggccctttgatcgctaaaagtatcctttcttctcctggataagtacaatttaaat

SEQ ID NO: 90 - DNA, 935 bp, Glycine max
ttaattaaatagaaataagaaaagattagtgaggttgaaatgttgcaacaacgatcggtgccggcaccgttcttgacgaagacgtatcagttggtggaggatccggggacggacgaggtaatatcgtggggtgaaagtgggaacacttttgtggtgtggaagcatgcggattttgcaaaggatttgcttccaaaatatttcaagcacaacaacttctccagctttgttcgacagctcaacacctatggatttcgaaaaattgtgccagacaaatgggaattcgcgaacgaacacttcaagcgagggcagaaggagcttctctcggagatcaaacgccgcaagaccgtgcctcagtcgtcgacacattccccggatgccggaaaacccggcgccgaaggcaactctccgtcgaaccccggcggctgcgacgacgcgggctccacctcaacctcgtcctcgtcctccggttccaagaaccagggatcggtggaaacaaacacaacgccttctcaccagttatcgagcgagaacgagaaactgaagaaggataacgaaacgctgagttgcgagctggcacgtgcgaggaagcagtgcgatgagctcgtggcttttctcagggaccgtctgatggtgggtcccgatcagatcgatcgcatcatgcggcaaggaagttgcggatctgaaaacgcggtaggtgaaggcggtggtggaggacactgtttgaaactgtttggtgtttggttaaaaggggatacactaacagacaaaagaaacaaccacaagagaggccgcgaagaccaaatgggcttcggtgggcctcgcctcaaggagtcaaagcccgttgttgactttagtaggaataggatgatgatgattaatgaaaaaggaaaaggctaagcggtaatcatgtttgggtaaaaagaccaaatttaaat

SEQ ID NO: 91 - DNA, 1186 bp, Glycine max
ttaattaatgtagttaatttttctccaaaggaaggaaaaggaagcaattatcaaggaggggactacggaaatagaaatggaaggaactcgtgcaaaagagggaaccctaccaccgggatttcgatttcaccctactgatgaagaacttgtcacttgctatctcgtaaataagatatcagattctaattttacaggcagagcaataactgatgttgatctcaacaaatgtgagccatgggagcttccagggaaagcaaagatgggagaaaaagaatggtacttcttcagtctgagagaccgtaaatacccaacgggtgtgagaacaaatcgagcaactaacaccgggtattggaagaccacagggaaagacaaggagatcttcaacagtgaaacatcggagttgattggcatgaagaagactttagttttctacaaaggcagagctcccagaggagaaaaaagcaactgggtcatgcatgaataccgcattcactcaaaatccagctatagaactaacaggcaggatgaatgggtggtttgccgggtattcaagaagagcggtggtgcaaagaagtaccattcctccaaccatgcaagaacagtgaatccatacagcttggaaattggaccaagtatcatgccaccaccaatgatgcaactgggagatcctagtgctcatttcctttatggaagaaactacatgaacagtgctgagttagctgaacttgctagggttttaagagggggtggatcaaccagtagtgtcaacctcccaattcagtctcagttgagctaccctacatcatcatcagctggaggaggaggattcatcatttcagggctcaatttgaaccttggaggaggagcaacagccacaacacaacccattttaaggccaatgcaaccttctcctcctgtccatacaatggcccaagtacttgatgtgaattccagcatgatgacaaccagttctcttggtgctgagaataatgttggttatggaacagaagtgagtaacaatatgaattctcatgggaataggtatatgggcatggaccaccattgcatggatcttgacaactattggccttcctactaaattatgatgagagatttttatttagttaattaggcataatctattactatatatttagctttagttggatcagctaccaatttaaat

SEQ ID NO: 92 - DNA, 942 bp, Glycine max
ttaattaagaaaggaagaaatgcaagaaccaagcttgggattgatgggtgaggtctccggcgatcaccaccgtcagctgaaggcggagataacgactcatccgctgtacgagcagcttctggcagcacacgtggcatgcctccgtgtggccaccccgatcgaccagcttccactcatcgatgctcagttatctcagtctcaccaccttctacgctcttatgtctcacacaacactcattctctctcccctcatcaccgccaagaacttgacaacttcctggcacaatatttgatagttctgtgtactttcaaagaacagcttcagcaacatgtaagagtccacgccgtcgaggctgtcatggcctgccgtgatatcgaaaatgccttacaagctctaactggagtgagtttgggagaaggaactggtgcaacaatgtcagatgatgaagatgatttacaaatggatatttctttagatcaatctagcgcggaagggcatgacatgatgggatttggtccattacttcctacagaatctgaaaggtcattgatggaaagagttcgccaggaactaaagattgagctgagacagggtttcaagtcaagaattgaagatgtcagggaagaaatattaaggaaacgtagagctgggaaattaccaggtgacacaacttctgtgttaaagaactggtggcagcaacatgcaaagtggccttacccaactgaagatgacaaggcaaaacttgtggaggagacagggttgcagctgaagcaaattaataattggttcatcaaccaaaggaaacgcaactggcacagtaactctcaatcggttacctctttgaagtcgaagcgcaagaggtagacatattattttgtccctaactatgtggaacagctagcaagcaacacaactatatataaggacatgcttatttaaat

SEQ ID NO: 93 - DNA, 2379 bp, Arabidopsis thaliana
ttaattaaatggatatgataaaaccagattttcaacaaatccgaagagataagtttagagttgagcaaatgaatgattttcccaacacttggactcagcagcagcatcagaacatcagaattcccaacaaccttgatttgattggtatcttacagaaccagatttccgtaccggttcaaaccgatttgtatcaagattctgccgcaacctttatgaacatgcctcagtcgatacatagagacccacaaggccctagtaattggagaatcagtgatttgtcacaacctagtaccgtgaatcacggatatgatcaggctggtattaggccaaacaacgttgcagatttgttgtccgatcatttcagttctcgaaaccaaatattggaccgtcctctttatgtcggccgggactctattcctcagtctagcatgattaggagaagtgaagtttcttgtctagacgataatcaaaagggttgtgtaacggtggcttgttcgggtactggtaatgagattttaaggagcagttatgatcaaggttcttcttctggaagttaccgaggagaattttcgtttctcccaagtttggagaatcaatcagttgcgcacaatgcaagcaactggaaccacggaccagtgaatgttactgccacttctcatactaatagtaagaaaggctttccactctcacttttgtctgatatccctccatctagagacgttggaaatgcagctgttttgtcaacaatgaatattcacggcccactcgggcctttcacgggatatgcatcgatactgaagagttcgaggttcttggagccggctcagaaaatgttagaagagttttgtatctcttatgcttcaaagattattagtagaagtgaatctacttccatggaggatgatgatgatgatgatgataacttgtcagggtttagtagttcttctgagccattagaacccaagaatagactaaagaaagcaaaacttctctttctgcaagaagaggtttgtgaaactatattcttacacagtcatgttttaatctatagattcgttacaaaactaacatgttataacttgtgacattgaaaaggtttgcaagtggtacaaactatataatcatcagttgcaaacagttatgtcttccttcaatacagtggctggtctaaacaccgcaacaccgtatatctcgttggctctcaaacggacttcacgaagtttcaaggcccttagaaccgcaatagctgaacatgtgaagcaaatctcaagtcactcatcaaacggtaacaacaacaaccgattccaaaagaggcaaagatctttgattggtaacaatgtcgggtttgaatctcaacaacaacatatctggaggcctcaaaggggattgcccgaacgtgcagtggctgttcttagagcatggctctttgaccattttcttcatccgtaaagcctcacaatttttttgatgtaatttgattttatttgatatgatgttttgatgtgatttctcatatcctttattgctaatactgttattaggtaccccactgattctgataagcagatgctagccactcaaactggtctctctcgtaaccaggtagctcaattatgtaattctttgtttggtgaaacttttaaatatgcttgtctcttgaattattgctcttggccggtcctgttttcttctattggtttaaagcatgttgatgggacaataacctaatggttttagaatttcttactctcaaataacatcaatcttatatgttaaagtaaagcatgcatatatagaattagtctagattttatgaaagacaagtgcatgtgtaactaaaaactgaaattgttctacgtgtaaatagaagattaacttttttcaaacatttccaccatgaaccatgtcaggacaaagagcgtctcattatcctcacatgcaaaaactctttagtatagacttcacctaattttaggtttggtttttgacaagatttgctgacttggtttcgtgtttttttttaaaggtatcaaattggttcataaacgcccgtgtgcgattatggaaacctatggtggaagaaatacacacacttgagaccaaagcaattaaaaatgcagatactagtcacaacattgagccatcaaatagaccgaatactgttagcagtccgagccatgaacaaacgctaacgggcctctccgggacaaaacggtcgaggttagagtacatggacatggtggggttcaatagagggaacgtgtcactcacgttagagcttaggcgtggtgtggacaatgttatccaaacgcagactcaggatcatcagtttggaactggaagccaaatgtttcatgactttgtgggttgaggcgcgcc

SEQ ID NO: 94 - DNA, 1066 bp, Arabidopsis thaliana
ttaattaattttcgttacctatttctctcttgaatctaatgtttccttctctagataccaatggctatgacctctttgatcccttcattccccatcaaacaaccatgtttccttctttcattactcacattcaaagccctaattctcaccatcactactcttcgccttcttttcctttctcttccgattttcttgagagttttgatgaatccttcttgataaaccaattcttgttacagcagcaagatgtagcagcaaatgttgttgaatctccttggaaattttgcaagaagcttgagcttaagaagaagaatgagaagtgtgttgatggaagcacctcacaagaggttcaatggagaaggacggtcaaaaaaagggacaggcatagtaagatctgcacggctcaaggtcctagagaccggaggatgaggctgtctcttcagattgctcgcaagtttttcgatcttcaagacatgttgggtttcgacaaggcgagcaagacgattgaatggcttttctccaaatcaaagacttccatcaaacaacttaaagaaagagtggctgcatcggaaggaggaggaaaggatgaacatctccaggttgatgaaaaggaaaaggatgagacactgaagttgagagtctcaaagagaagaacaaagactatggagagctcttttaagactaaagagtcgagagagagagctagaaagcgagcaagagagagaacaatggcaaagatgaagatgagattatttgagacctcggaaacaatttcagatcctcatcaagaaactagagagatcaagataaccaatggtgtacaattactagaaaaggaaaataaagaacaagaatggagtaatactaatgatgttcacatggtagagtatcaaatggattctgtgagcatcatagagaagtttcttggactaaccagtgactctagctcctcttccatttttggtgactccgaggaatgttacacaagtcttagttcagtaagaggtacaatttcagcagcaggtaacagcaatgtgttaactaaaaaccctaattgaggcgcgcc

SEQ ID NO: 95 - DNA, 982 bp, Arabidopsis thaliana
ttaattaaatggaagataacgacgcagcttatgatcaagtcaaatccgaactgttaaactcagaagacgaagtaataatctcacgttatctgaagcctatggtcgttaacggagattcttggccagatcacttcatcgaagacgcaaacgtgttcaccaagaatccaaatgaggtgttcaattctgagagacctagattcgttatcgttaaaccacgaacagaggcttgtggtaagaccgatggatgtgaatctggttgctggaggaccatgggtcgtgataaactgataaagtcggaggagactgggaagattctagggttcaagaagattctcaagttttgcataaagtggaaacctatagaatacaagagaagttgggtaatggaagagtataggcttaccaataacttgaactggaagcaagatcatgtgatttgcaagattcggcttttgtttgaagcagaaattagtttcttgctagccaagcatttctacactacgtcagaatcacttcttcgacatgagctattgccatcttatggatatttatccaatacacaagaggaggatgaattttatctgaagacgataatgacttcggaaggaaacgattggcctagctacgttaccaacaacgtgtactgtcttcatccattggagcttgtggatcttcaagatgtgatgtttcaaagttacggaacctgcatcttcgctaacgggacttgtggtgaatctgataaatgcgatggtggttactggaagatcctgcacggtgataagctgatcaagtcaaatttcgggatggtcactggtttcaagaaggtatttgagttctatgaaacggtgatacatagatatttttgtgatggagaagaagtgaaggtaacttggactatagaagagtataggcttagcaaaaacgtgaagcagaataaattgttgtgcgttatcaagtttactgatgataaatagggcgcgcc

SEQ ID NO: 96 - DNA, 694 bp, Arabidopsis thaliana
ttaattaaatggtgagcttttgcgagctttgtggtgccgaagctgatctccattgtgccgcggactctgccttcctctgccgttcttgtgacgctaagttccatgcctcaaattttctcttcgctcgtcatttccggcgtgtcatctgcccaaattgcaaatctcttactcaaaatttcgtttctggtcctcttcttccttggcctccacgaacaacatgttgttcagaatcgtcgtcttcttcttgctgctcgtctcttgactgtgtctcaagctccgagctatcgtcaacgacgcgtgacgtaaacagagcgcgagggagggaaaacagagtgaatgccaaggccgttgcggttacggtggcggatggcatttttgtaaattggtgtggtaagttaggactaaacagggatttaacaaacgctgtcgtttcatatgcgtctttggctttggctgtggagacgaggccaagagcgacgaagagagtgttcttagcggcggcgttttggttcggcgttaagaacacgacgacgtggcagaatttaaagaaagtagaagatgtgactggagtttcagctgggatgattcgagcggttgaaagcaaattggcgcgtgcaatgacgcagcagcttagacggtggcgcgtggattcggaggaaggatgggctgaaaacgacaacgtttgaggcgcgcc

SEQ ID NO: 97 - DNA, 1191 bp, Arabidopsis thaliana
tgtttcttgtttgttgattaacccttaattaagatggtaggatcatttttaccacctggtttcagattttatccaacagatgaagaacttgtaggttattacctgcacagaagaaacgaagggcttgagatcgagctcgaaataatcccattaatggacttatacaagtttgatccttgggaacttccaggtatgttgcttcttgtaaaaaataatcagtttttactatctatattataacataccaagtttttgttcattacagagaaatccttcttgccaaatcgagatatggaatggtttttcttctgtcatcgcgacagaaaataccagaacggatctcgaataaacagagcaactaaatctggttattggaaagccactggcaaagatcgaaaaatcgtttgccactcttcttcttcttcatcatcttcctctatcaccggctgccgaaaaaccctagttttttatatgggtcgagctccttttggtggtagaaccgagtgggtaatgcatgagtatcgcctcttcgacaacgatacttcacaaggatcactaaacttcaaggtaacaacatcataaaccaaacagatgaaaaaataaaaaacttgattcatagtttaccatttaccaattgatcattttcatttggtattcttccgctctttagggagacttcgcgctgtgtcgtgtgataaagaggaatgagcatacgcttaagaaatgtgaaattatctcaccagaggtttcagatgagtcattaagcaataatgttaacaatttttgtcaagcaagtgacctagaaaagggttcttgtgatgcaagtaacacacgtttgtcttctcctgatttcatccttgaatcatcttttcaggtttagctacttaaatccaaactctgcgaaagtcccattcgtttatcaatatcactgtgtctcaaacttcattacattgttttttgtagggaaattcacattcaaaaacagaagaagattccggtttccaagtatttacattacccgaattcgaatatccgctagaggtttttgcagatttgaatttcgatttggaaatggaggatccattcatgttcgattatcatccagagcctcatatgaacaatgaagtcatgagccatcacattcgtgggtaaaatacccagcaaattggagctctgcagactttcgttcgt

SEQ ID NO: 98 - DNA, 1057 bp, Arabidopsis thaliana
ttaattaaatggagaagttagtacataaagaaattgagaaacgaaggagacaagaaatggcttctctctacgcgtctctccgctctcttctccctttagagttcatccaggtcaaaaccctaattactcttgcttttaatttcttcctcttcttcttcttttttttttgttaaggaaaaagtccacaagtatgctttgtcgcttagtttgttaaaaagattcactagaactctaacactctatcatcacaatatctcaagttgacctctacaccttaattacgtttgatttggttttgtagggaaaacgttcaacgtcagatcaggtgaaaggggcagtgaattacatagactatttgcaaaggaatatcaaagacataaattccaagagagatgacctcgtgttattgtctggacgaagctttaggagtagtaatgaacaagaatggaatgagatttcgaatcatgtcgtgattcgtccgtgtttggtcggcatagagatagtgttgagcattctccaaacgccattctcaagcgttctgcaagtgcttcgtgaacacggtctctatgttcttggctacatctgttccagtgtaaatgatagactcattcatactctacaggctgaggtacaatatctcgagcttactaactttacagcaatcgaagcattactaactttactaagaatatagagaaatacttaatcataacatatatttctaactaactttactaagaatatagagaaatacttaatcataacatatatttctaactttgttaatgttttcgatcttgtcggcttacaaacgcgtttatgtcctaatttggaatggaatatagaatatagcatacatcttcttcatagctttttggaatggcttattgtatcagagtaatgaatatatatgtttgagttaatatgtgaagttgatttgccttatgttgagttaatatgtgaagttgatttgccttatgttgcaggtcaacgatctggctttgatcgacttagcagaccttaaggatacacttaccctgatgaagtaaggcgcgcc

SEQ ID NO: 99 - DNA, 1381 bp, Arabidopsis thaliana
ttaattaaccctctcttctcttcttttgttctctagatttcttctctcttgtttcttagaatccgtacaatctaatcaacataacaaaaatggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggttttttttttctttttttttttcgggagtttttgtgactgatgaaagaaagaaggtacaagaacggatttaaat

SEQ ID NO: 100 - DNA, 1153 bp, Arabidopsis thaliana
ttaattaaatggatgggagagaagctatggcatttccaggctcgcattctcagttctatcttcagagaggagtttttaccaatcttacaccttcccaggtcgcgagtggtcttcacgcgccgccgccacctccgggaatgaggccaatgtcaaaccctaacattcaccaccctcaggctagcaatccaggacctcctttctccatggctgagcacaggcattctgatttcggacacagcattcacatggggatggcttctcctgctgcggtgcagcctactctgcagctgccgcctccaccgtcggagcaaccgatggttaagaagaaacgtggaaggccaagaaagtatgttcctgatggacaagtttcattggggctttctccaatgccttgtgttagtaaaaagtctaaggactcttcttcaatgtctgatcctaatgcacctaaaagagccagaggtcgacctcccggaactggaaggaagcaacgcttggctaatcttggtgagtggatgaatacatcagctggacttgcttttgcacctcatgtgatcagtgttggatcaggagaagatattgtttcgaaagttttgtctttttcacaaaaaagacctcgggctctttgtataatgtcaggcactggaacggtttcttcagtcactctgcgtgaacccgcttcaacaacgccttccttaacatttgagggacgttttgagattctaagtttaggtggatcttatctggtgaatgaagaaggtggatccaaaagtcgaacaggcggtttgagtgtctctctttctggtcctgaaggtcatgttatcggcggtggaattggaatgcttatcgcagccagcctcgttcaggtggtggcttgtagtttcgtgtacggagcaagtgcaaagtctaataataacaataacaagaccatcaaacaagaaataaaacctaagcaagagccgaccaatagcgaaatggagaccacacctggtagtgcaccagaagctgcagcatcgacgggtcagcatacgccacagaacttcccagctcagggaatgagcggatggcccgtttcaggctcaggctcaggcagatcacttgactctagcagaaacccactcactgatattgacttgactcgcgggtgaggcgcgcc

SEQ ID NO: 101 - DNA, 1141 bp, Glycine max
tcttgtttgttgattaacccttaattaagatgcaagcaatggagaacattcatcagagggaaatattggaagagcaaaggtttgaattgccaccaggattcaggtttcatccaacagatgaagaactcatcactcactacctctcacagaaggttcttgatagctgcttctgtgccagagccattggagaggctgatttgaacaagtgtgaaccatgggatttgccttggatggccaaaatgggtgaaaaggagtggtattttttctgtgtgagggacagaaaatacccaactggtcaaaggactaatagggccactggtgttggctactggaaggcaacaggcaaggacagagagatatataaggcaaaggcactgattggaatgaagaaaactcttgttttctacaaaggaagagctccaagtggtgaaaaaactagctgggtcatgcatgaatacagattagaagatgaacattctgtgcacaatccacccaaaaaggccatgaatgattgggccatctgcaggatttttcagaagagtaatggtgggaagaaaatgccaatttctgggttggtgagattcagcaattttgcaaaggacatgccttcattgatggattcttctccatacaacgacagtgaatcaaaacctgttttgggggagtcatcacagccaacatgcttctctgatccaaaccaaagtgaggaccaaaggacacaagatgaaaacatagcggatagctatgaaactctcatgttggcatcttcatattcttcaaacccctctgatatttcccctgcctcatggactttttctaaatctgcccctaccgtgtcccaccaatcactccaagttgggaattcacacagctcagattacttcatgcttcatcaggaacagtccatgttggggatgttgattgaaaaccatggagcaagtgctggccaaagaactcagaaagctcaggatagtaaaggctctgatgctgacatgtcctctgtgatgtacaacaactatgaaatgttccaaagatcatttgggaaccaggaatattcatcaccttccgtaggacatgtgtattctagtggcctatggggattttaaatttaaatacccggcaaattggagctctgcagagc

SEQ ID NO: 102 - DNA, 827 bp, Glycine max
aactctttgtttcttgtttgttgattaacccttaattaagaaaaatcacatccccaaaacacccttctcgctccgcatggcgaaaacgaggccaggcagaaaagacgtggactcatacaccataagaggaaccaacaagatcgtccgagctggagactgtgttctgatgcggccctcggacacgtcgaagcccccttacgtggcgcgcgtggagatgatcgagcaggataataggaacaacgtgaaggtgcgtgtggggtggtactacaggccggaagagtcgattggtggtcggagacagttccatggtgcgaaagaactgttcctctccgaccactacgatgtgcagagcgcgcacaccattgagggcaagtgcgtggtgcactctttcaagaactacactaagcttgagaatgtgggtgctgaggattactattgtagattcgagtacaaggccgcttctggggcttttacccctgaccgtgttgctgtgtattgcaaatgtgagatgccttataacccggatgatctcatggtacaatgtgaagggtgcaaggattggtaccatcctgcttgcatgggcatgactattgaagaagctaagaaactagatcattttgtatgttccgaatgttcatctgatgatgatatgaagaaaccccaagctacattttctgcatcaccgggagctgatggcaaggtggagccgaagcggcggaagagatgaccatgtgaggtgtgtgtggttcttgcttaatttggctggctctatggtagatttaaatacccagcaaattggagctctgcagagctttcgttcgtatcat

SEQ ID NO: 103 - DNA, 968 bp, Glycine max
tttcttgtttgttgattaacccttaattaagatgtctcgcacgtgctcacagtgcggcaacaacggccacaactcacggacatgcaccgacggtggcgccgccgggtctccgagggagaacggcatcatgctgttcggcgtaagagtcatgacggaagctaactcctccttcaggaagagcgccagcatgaacaacctctcacagtacgacgcggagttcaacgccgccgacgccggctacgcctccgacgacgtcgttcacgcctccggccgcacgcgcgagcgcaagcgaggtgttccttggacggaggaagagcatagattgttcctgttagggttacacaaagtcggaaaaggagattggagagggatttctagaaacttcgtgaaaactcgcacgcctactcaggtcgctagtcacgctcagaagtactttctccgccgccacaaccagaatcgccgccgccggagatctagcctcttcgacatcaccaccgatacggtgatggaatcttctactataatggaagaagaacaagttccgccagagacggtggcggcgcctctccccgccgcatatccgccgtcgcattacggggcttttgccggcgcgggttttccgatagctccggtggtgttgccggtgagtggcgagagactaaccaagccgatcaggccgacgccgattttgccagtgcctccgtcttcgaagatggctaatttgaacttgaaagagaaagcttctccgacaaatctcattgagcctttgccgttgtcgttgaatctgccatcgccgacgccgcggtctcaggatcagtcgtcggcgagtagtgggcactcgtcaccgtcgtcgtcgtcatcggcggcagcttttcaggctatgtctgcagcgaagttcggcagcggcggggatagtatcatcagcgttgcttgaatttaaatacccagaaattggagctctgcagagc

SEQ ID NO: 104 - DNA, 909 bp, Glycine max
actctttgtttcttgtttgttgattaacccttaattaagcttccttcttttgtcttcccttagcttagtttgaagatcatggggagaggaagggttcagctgaagcagatcgagaacaaaatcagccgccaagtgacgttttccaaaaggagaactgggctgcgaaagaaagctaatgaaatctctgtgctctgtgatgctcaagtggcactgattgtgttcaatgctaaagggaagctttttgagtattcttctgaatccagcatggaaaacgtcctggaacgatatgagagacatactcatatagggaaacttgttggagatggtgatgaatcacagggaaactggtccttacaatgcttcaagctcaccggcaaagttgaagtcttagagaggaacttgaggaactttgtgggagaagatctggatcccttaaacttgagagagcttcagagtctagagcatcagcttgagacagctataaagcgcatccgaactagaaagaaccaagttatgaatgaatccatctcagatctgcagaaaaaggcaaggcaattgcaagagcaaaatggcatccttacaaagaagattaaggagaaagggaaggaagtggttgaacgtccacactgcggaccagaaaccttaggtctaacttgtcctccagagctacaacgacagcaaagagtatttccttctttaacactctgtgagactttacaagcagggcatctggaggaagttgttgaagcacgaacggttcctactgccagcactcacatcccaccatggatgctgcatccatttacaagataaatctgcatgtgacacgttatgtttgtgacacatgtgatgaatgtatttaaatacccagcaaattggagctctgcagagctttcgttcgtatcatcg

SEQ ID NO: 105 - DNA, 1881 bp, Glycine max
tttatttgtcagctttcaaactctttgtttcttgtttgttgattaacccttaattaagcacttctctgcaagcataggattttgggttcttgtgtgaaggatatggctgaggtggtgaaatcagaggagtgttgtcaggagaataagcaatctactgctgcttcttgctcctctgtatccgaaggcagtggcagtgcaattcacaagtctccggggagatgtagccctgcatccacatcgccctcacatcggaggaccaccggccctataaggcgtgctaagggcggttggactgcacaagaagatgagacattaaggaatgctgttgcagtttttaagggaaagagttggaagaaaatagctgagttttttcctgatagatcagaagttcagtgtctgcacagatggcaaaaagttcttaatccagaacttgttaaaggaccttggacacaggaggaggatgataaaattgttgaactggtgtcaaaatatgggcctacaaaatggtctttgatagccaagtctttacctggtcgaataggcaaacaatgtcgagagcggtggcacaatcatcttaatcctgacataaagaaggatgcctggactttggaagaggaattggccctgatgaatgctcatcgtatacatgggaacaaatgggctgaaatagctaaggtccttcatggaaggactgataatgcaataaagaatcactggaatagttctttgaagaaaaagttggatttttatttagctacaggaagacttccaccaattcctaagaatagtccacaagttcctgtcaaagatacaattagacgttctgctagtaaatcaatgcttggttgttcaaataaagaattaaatgcagctgttgaaacatcatctgaaactacagccattagtaagctagatgacagtggcaggaatcagtttgagtcctcaggcacagttagagaagttggtgattcttcaagtgttcctgcaaatgactctgccgattctgactgcgtagaatgcaagcctggatcatccaatatcaaccccagctgtagcaactcagaacacgtgtcaagagctaattttggaacaacttttgggccaatatctgagaattctggactcaatggaaactcaacttttgagcattgtacaaacaatggtgacaggagcagtaccaggttaatcggaacatcttcacaagaaaatccaacctgtggttctttgtgttatgagccaccacagttagatggttcagttcccatagattctctttatttaaattatacttgccagcagaatgagtactgtccgagtccaacgatgtcacctactggtttcttcactccacctcgtgcgaagggtagtgaattatgcactgagacacctgaatcgatcttgagaaaggctgctaatacttttccaaatactccttccatattgaggaggagaagaactggggcccaaacactcaccagtcccactaaagttttgaaagtagataataatccacatacttctaataaaacagagagaaccaatgatgattctggttctgggcatttctccgggagtccagcaagccatggctatgggattggcattcccaacaataaggcattcaatgcatctcccccatacaggttaagatccaagcgaacagcaattgtcaagtcagtggagaaacaactggagtttgcatttgacaaagagaagaatgacgacaagaggagtaatgtgatgactgaagatcgtctgcatgaaaaaaaattggttgtgacatagtgcataaattggattatggctggacttgcttttgaaggtagctgattgtatttaaatacccagaaattggagctctgcagagctttcgttcgtatc

SEQ ID NO: 106 - DNA, 711 bp, Glycine max
tttcaaactctttgtttcttgtttgttgattaacccttaattaagagagaactgtgcaagctttggaacttcttcaaagtctggtacttcaatggctactgaagaggttaataaacttcaatcacttcctccttaccctgagatgatagtgaaagcacttgaagccctgaatgaggctgatggatcgagtaaatcagcgatatcaaagtacatagaaaccacctacggtgagttgccagatgaaactgttttggggagtcacctgaacaagatgaaagagagtggagagcttgcgttcaaacagaacaattacatgaaagctgatccaaatgccccaccaaagaggggacgtggaaggccaccaaagccaaaggttccattgccaccaggcactgttgtgtcccctccaaggccaaggggtcgtcccccaaaagaccctaatgcccctcctaagtcccctaaggctaaggccacccctgccactggcaggccaagaggaaggcctaagaaggttgctcgctcaccggccgtgccgtctcccaccgccgtctccactggaaggcctagaggcaggcctcccaaagtgaagcctcagttgacagaagtcagtgttgagtcatagaatggtttctttctttcttcctaattgatgtcaaatgatttaaatacccagaaattggagctctgcagagctttcgttcgtatcatcgg

SEQ ID NO: 107 - DNA, 997 bp, Glycine max
ttcttgtttgttgattaacccttaattaagttcttcttaagacaacaagctaaaagcgcttctaacttaagtgatggctaacgctgctgaagtttcagcgttgaaacgcatcaagttgcatcttttgggtgaactctctccactggccactccccaaaacaaatttgaccaaacaaaccctagcccctctgaatcttccaattccgaatcttcttctatttctcttaaccactacttcactgacctcctcgaacccgaaattgaatttcctctcttcgaattcgattccaaaccccaagtaatcgacctcgaaaccccgaaaaccctaatttcagctgagaagaagcctcaatttaatcggaaaccgtcgctgctaatcgctgttccgaagaagaccgagtggatccaattcggaaaccctgaggtggcggcgccggagaaccagcctgagaagaagcactacagaggtgtccgtcagcggccgtggggcaagttcgccgccgagatccgcgacccgaacaagcgcgggtctagggtttggctcggaaccttcgacaccgccatcgaagccgccaaggcctacgaccgagccgccttcaggctccgcggctccaaggccatcctcaacttccccctcgaagttaacaccgcggcggagaccgtctccgtcgccgccgtcgacgtcgagaggaagcgccgccgcgaggaggaggaggtggtggtggaggatgtaaaggcggtggtgaagaaggagaaaataacggagcatgatgtgagttgttttagggggatgccgttaacgccgtctatgtggaccgggttctgggacagtgacgtcaaggatattttcaacattccgccgttgtcgccgttatctccttttggattttcaccgctcgtggctgtgtgaaattccaatttaggactgcgttttttcgtgttttagtacttacagcgtccatttaaatacccagaaattggagctctgcagagcttt

SEQ ID NO: 108 - DNA, 1251 bp, Glycine max
tttcaaactctttgtttcttgtttgttgattaacccttaattaatgcactctatccttctttctcttgaacccataattccatgactcggcgttgctcccactgcagcaacaacggccacaattcccggacatgcccttcgcgtgggggcggaggtgtgaagcttttcggggtcaggctgacggatggatcaatcattaagaagagcgccagcatgggcaacctaaacctctcctccgccgccgcacatcaccaattccattcatctccttcttcttccaacctcgccgccgccccctcatcccccaatccaagctccccatgctccgaccctccccaaggttacttgtccgatgaccccgcccatgtctccaccttcgctaaccgccgcggtgatagaaaaaaaggtgttccatggactgaagaagaacatcggctgttcttaattggtctccagaagctaggcaaaggagactggcgtgggatagcacgcaattttgttgtatcaaggacccctactcaagtagcaagtcatgcccagaagtattttatccggcagagtcatgctaccaggagaaagagacgttccagtctttttgacatggttccagatatgtcttcagatcaaccttctgtgccagaagaacaagtgttgcttccaccttcccagaactcacaaccttgcaatggaaaatcacagccttcattaaatctctccctcaaatcagaatttgaacccatggagactacttctcaagaaaatgcgcaacagaccaatgaaactatgatgggatcaatcggactgacaccaatggctcctcatggattctttcctgcatatttacctgttccatttcccatgtggccatcaactgtggctcccccgtttgaagaagttaagggaggagagacatcccaccatcagatccacaagccaatcccagtcattcccaaggaacctgttaatgttgacgaacttgtgggaatgtctcatctaagcattggggaagcaaaggtacgtgatagagagccttcccctctttccttaaagttgttaggagagccctcaaggcagtcagcattccatgcaaatgctccagttggtacttcggatttaaacaatggcaaggacaacgcaattcaagctgtctgagcttgtaaggtccggtgaagacagcagcagaattaagccttcttttggtcatttttcatttgtactatcaatttaaattggagctctgcagagctttcg

SEQ ID NO: 109 - DNA, 1501 bp, Arabidopsis thaliana
ttaattaaatggatttgagactccaacaagctgctgagtctggaagcatcaatgagttgtatgctcttattgatgagaatccatacatacttgagaacattgatgcggtgccatttgtgagcactcccctacatgtagctgcagtttttggaaacatagaatttgccatggagatgctgaatcttaagccctcttttgccagaaagctgaacacaagcggttacagtccattgcatctcgctgtggaaaaggaacaaagcgactttgtctcccatatgctctggcatgatggtggcctgtcccgtgtcaaagggagaaatggcgtcacgccgttccatctcttagtgataaggggagacgatgatcttgtagcagagtgcctcataacttcccctgaatgtattgaagatgtgaacgtggatcgccaaaatgctttgcatctagctgtgatgaatgatagatttgaagttctccaggttctcacgggatggatccagagaatgagccaaaaagatgcttactatatcgagaaccgagttctgaataaaagggattttgacttcaacacggccttgcaccttgcagcatataagaatgatcagcaggcaagctttactttctttgaaattcgtttttcaatatcatgtatctgattagcttccatatcaatactaagtgataatgagtcaggtgaaatatgatcattattaactaagatctttttcagtatgagatgctctaatagaacgatcaatttcgtgcaggccttgaaactattactaaaatgccggttggtggagccgaacctagttaatattgatgatttaacattcgttgatatcttaaggacccagggagagaacgcaggtggtgggaacctagatttggaacaagctgttataaaaactgggtgtgtagaggcggcttctatgccaaaattcaaggaagagtctgatttgttgaaatcaccaatcaattttatgacatactattccacgtccatgaaacgcatgaagtcttccacttcagatcaagatcgcggagcatttctgattgtatgcactttgataataacagccacttatcagatggccctccagcctcccggaggtgtacaccaatctgagaatgcgaatgcgaatgcgggttctgtggtgatgaaacagacattcttcatccttctttggatttccaacaccgttggtttctgctgcgctgtattctacaccttttgtctcataccactcggtcagttgtttacgatatggtttttttatatagggacatgtctgtgcatttcttatgcactagcaatggcagtaatctcaccacaccctctagtgtttctctctgctacctttgctctcttccttgtttttgctctctatctcttgcttgaagctttcgtagatacttggcggaagcatcggacggtggtacctaagtcccgattcagctggttttggaaggttttacaatattattatatctgaggcgcgcc

SEQ ID NO: 110 - DNA, 2817 bp, Arabidopsis thaliana
ttaattaagtgttggaggtataaaaacgaatctttagacatggaagatgatggtggtagtgatggaggcgaaggaaatggtgggttttcacctaattctagctttggggcattcgctgacactgccatggatttggatttcatggatgaactcttgtttgatggatgttggctagagacaacagatagtaagagcttgaagcagacagaacaatctccttcagcttctaccgccatgaatgacaatagccctttcctctgctttggtgagaatccatctcaagataatttctctaatgaagaaacagagagaatgtttcctcaggctgaaaagtttctcctagaagaagctgaggtgggaaaaagttggtggattgctccaagtgcaagtgaaggcccgtcttcatctgtgaaggagaggctactacaagctattagtggtcttaacgaggcggtgcaagataaggacttcttggttcagatatgggtgccaattcagcaggaagggaagagctttcttactacttgggctcagccacatttattcaaccaagaatactccagccttgcagaatacagacatgtttcagagacttataatttcccggctgatgagggtatgaaagattttgtgggtcttcccggtcgtgttttcttgcagaagtttcctgagtggactcctgatgtgcgtttctttagaagagatgaatatccacgcatcaaagaagcacaaaagtgtgatgttcgtggttcacttgcccttcctgttttcgaaagaggtagtgggacttgtttgggtgttgttgagatcgtcacaacaactcagaagatgaattaccggcaagaacttgagaagatgtgtaaagctcttgaggccgtcgatctaaggagttcaagtaacttgaacactccaagctctgagtttctgcaggtctatagtgatttctactgtgctgcattacctgaaataaaagatttcctggccacaatctgcagatcatatgattttcctctagctttgtcatgggcgccgtgtgctcggcaagggaaagttggttcccgacattctgatgagaacttctctgagtgtgtttcaacaatcgattctgcttgttctgtccccgacgaacagagcaaaagtttttgggaggcatgctctgaacaccatctgctccagggggaaggcattgttgggaaagcatttgaagccaccaaactcttttttgtgcccgaagtggccacatttagcaagactaactacccccttgcacaccacgccaagatatctggactacatgctgctttagcagttccattaaagagcaaatctggtttggttgagtttgtgttggaatttttctttccgaaagcatgccttgacactgaagcgcaacaggaaatgctcaagtcactatgtgtgacactgcagcaagatttcaggagttcaaatcttttcatcaaagacctagagttagaagtcgtattacctgtaagagagacaatgctcttctcagaaaacctgctatgtggagcagaaaccgtagagtcgttgacagaaattcaaatgcaagaatcctcatggatcgcccacatgataaaggcaaacgagaagggtaaagatgtatcactttcttgggagtaccagaaagaagatcctaaagagctctcatctggccgggagaacagtcagcttgatccagtccccaataatgttcctttagaagctgagcaattacagcaagcatcaactccaggactcagagtcgacatcggtccaagcacagaatcagcttcgactggtgggggaaatatgttaagcagtaggagaccaggggagaaaaaaagagcaaaaacagaaaagaccattggcttggaggttcttcgacaatactttgctggaagcctcaaggatgcagccaagagcattggtgtttgtccaactaccttgaaaaggatatgcaggcaacatggaataatgcgatggccctcccgaaaaatcaagaaggttgggcattcgttgaagaaactccaactagttatggactctgtccaaggtgcgcagggctctatccaactcgattcattctatacaagcttcccagagttgaactccccaaatatgtctagcaatggcccttccttgaagagtaatgaacagccaagtcatttgaatgctcaaaccgataatggtattatggcagaggaaaaccccaggtcaccatcatcttcttgcagcaagagctctggttcaagcaacaataatgagaatactggaaacattctagttgctgaggatgctgatgcggtgttaaagagagctcatagcgaagcacaactgcataatgtgaatcaggaggaaacaaaatgtcttgcaagaacccagagccataaaacattcaaggagcctcttgttcttgataattcatctccattaacaggtagtagcaacacgagtttaagagctagaggtgccatcaaagtgaaagcgacatttggtgaggccagaatacggtttaccttactcccgagttggggcttcgcagagctgaagcaagagattgctaggcgtttcaacatagatgacatttcctggtttgaccttaagtacctggatgatgataaggagtgggttcttctgacatgtgaagcggatctcgtggaatgcattgacatatatagattaacacagacccacacaattaaaataagtctgaacgaagcttctcaagtcaagctaagtggttcttttggcaacactggtctttcctgaaaaacattaaacgaagttttgtaactgcaaagcaccaggaatttaaat

SEQ ID NO: 111 - DNA, 753 bp, Arabidopsis thaliana
atggaaggtggagctgctctctacaatcctcgaactgtcgaagaagttttcaaggatttcaaaggtcgtcgtactgccattgtcaaagctctcaccaccgatgttcaagagttttaccaacaatgtgaccctgagaaggagaatctttgcttgtatgggttaccgaatgaagaatgggaagtgaatttaccagctgaagaagtgcctcctgagttaccagagccagctcttggtattaactttgctagggatgggctctctgaaaaggaatggctttcgcttgttgctattcacagtgacgcttggttactgtctgtctcgttttactttggctcaaggttttctttccacaaggaagagaggaagcgtttgttcaacatgatcaatgatgttcctactatatttgaagtagtgactggaatggctaaagcaaaggacaagtcatctgctgcaaatcaaaacggaaacaaatccaagtctaactctaaagttagaacttcagagggaaaaagctcaaagaccaagcagccaaaagaggaggacgaagaaatagatgaagatgatgaggatgaccacggggaaaccctttgtggagcctgtggagacagtgatggtgctgatgaattctggatctgctgtgacctttgtgagaagtggttccatggcaagtgtgtgaagatcactccagctagagctgagcatatcaaacaatacaagtgcccttcatgcagcaacaaaagagctcgagcttaa

SEQ ID NO: 112 - DNA, 1273 bp, Glycine max
aactctttgtttcttgtttgttgattaacccttaattaatccgggcgcgcctgatttatcacaagtttgtacaaaaaagcaggctcctgcaggaccatggcggaagattgggatctacatgcggtggttagaggctgctccaccgttacatcatcctcagtgtcttcttcttcatctccttcttcctctggttttgcctcttcttacttccaccctgaagctgcagtttcttcttcttcttcttcctattctggcttcaacatcttcaagggtgaacaaggaataagccaagttttgtcgctctctgcgtacccctttgaggcaaggagctccattgaggaattgcatgagctttgcaaacctttcttctccaaatctcagcctctaacgttgcaagcctcttcacctttgtcctcactctcttcctattcctctgcgccacccaaatctgtttcaacgcaagagaaacaacaacagaggagcaagcaggcacatgctgtcaccaccccacgatctaaaagaagaaagaaccagcttaagaaagtttgtcaagtgccagttgagaatctctcctcagacatatgggcatggaggaaatatggccagaaacccataaaggggtctccatatccaagggggtactatagatgtagcagctcaaaggggtgtttggcaaggaaacaggttgaaagaaacagatcagacccaacaatgtttatagtgacttacactgccgagcacaaccaccctgctcctactcacagaaactctcttgctggctccacacgtcagaagccattggtacctcaaacagccaccaccactgaagaagactctgacaagagcaagagcctcacaaaacccacttcccctgccacctcaggggcagaagaagaggctccaacaccatcacaaggggaaaagtctgagagcagagaagagaaagaggatgtgatggatgatgaggaagaagatgaatttggcttgtctgatatggtgctttcagatgacttctttgaaagtttggatgaactgagccaacttacggctccttctgttgtcactggagactgtttcagtgaccccttttcagcaattgcaatcccttcttgggtggctagtggtgctgctactgctagtgggtgtagatgattctttcgggcaaatcatcacaatgcttttcattgatgacaatagggctcgacacccagctttcttgtacaaagtggtgataaattggagctctgcagagctttcgttcgtatcatcggtt

SEQ ID NO: 113 - DNA, 1308 bp, Glycine max
ttcttgtttgttgattaacccttaattaatccgggcgcgcctgatttatcacaagtttgtacaaaaaagcaggctcctgcaggaccatgtccaagccactgctaggcataggggaggaggaaggtcaaagcaatgtcactttgttggtttcttcctcagtcatcatggaaagtgtgtgcctgaatagctcaaaattgaaagagcgcaactacatggggttatctgattgttcatctgtggacagctccgcgccgtccttctcagatgagactaaaagcaatctgaaccttaaggctactgagctgagactggggcttccgggattgcagtctcccgaacgagattcagatctttgcttgagaagttcaattcagtttgatgaaaaaccactgtttcctttgcatcctgctactgatgatcaccattcctcatcaaagcctgctgttttgggtaacaaaagagggttctcagatgtcatgagtggattcgccgaggagaaattgcttgttagttctgaggtcaacacaatattgtcaccaaggccttcttctaatgtggcattgaaaccaagctctatgcttgagaatgttggggctcagcaatccaaagccaaagaactcgcaacagcgaaggttggtcttgagaggtctcatgttttcaatgatagcagaacaaatctgaatgattctgctaataacaatagcagtgcaccagctaccaaggcacaggttgttggttggcctcctataagatcatttaggaaaaattcactggccactactacaaagaatgttgaagaagtggatggaaaagcggggtctggtgcactgtttgtaaaggtcagtatggatggtgctccttatttaagaaaagtagacttgaagaattactctgcgtatgccgaactatcttctgcgctggagaacatgttcagctgttttaccataggttcttgtggatctcatggaaatctgggaggggaggtgctgaatgaaaccaagctgaaggatctgcttcatggatcagaatatgttcttacgtacaaggataaagatggcgactggatgctagtgggtgatgttccctgggagatgtttattgagacatgcaagaggctaaggatcatgaagagctccgaagccattggtctagcaccaagagctgttgaaaaaagtaagagaaggaactaggcagtatcaagcatctcatcacactctatccatctaactgcttatggggctcgagacccagctttcttgtacaaagtggtgataaattggagctctgcagagctttcgttcgtatcat

SEQ ID NO: 114 - DNA, 1109 bp, Glycine max
aactctttgtttcttgtttgttgattaacccttaattaatccgggcgcgcctgatttatcacaagtttgtacaaaaaagcaggctcctgcaggaccatggacacggctcagtgggcacagggtattggagtggttaaacaaccgatggaaggttcaaagcctcctcctcctcctcctcctcctatgttggagagaagggcaaggcctcaaaaggatcaagctttgaactgcccaaggtgcaattcaacaaacaccaaattctgctactacaacaactatagcctctctcagccaaggtacttttgcaagacatgtagaaggtattggactgagggtggttctctcagaaatgttcctgtgggtggtggctctagaaagaacaagagatcaaccccgccagcaccaccatcagcaccagcaccaacaaagaagctttctgatctcgcaacaccaaatttccctcaatctgcttctcaggaccctaagatccaccaaggccaagaccttaacctagcatatccaccagctgaggactacagcactgtctccaagttcattgaggttccttacagcactgaattagacaagggtactactggtcttcatcaaaaccctacttcctcatcaacaacaacatctgcatcttctcagttgtctgccatggagcttctcaagactgggattgcagctgcttcctcaaggggtttgaactccttcatgccaatgtataattcaacccatgggtttcccttgcaggactttaagccaccacatggccttaacttcagccttgaggggtttgaaaatggttatgggggtcttcaggggattcaagagggtcccactggtggtgcaaggatcttgtttcctactgtggaggatttgaagcagcaagttccaagcacaaatgagtttgatcagcagaatagaagtcaagagggttcagctcacgggtattggaatggcatgttaggtggaggatcatggtagatattattagtgaagaaaaaagagaacaaggggttgctgttttagctcgagacccagctttcttgtacaaagtggtgataaattggagctctgcagagctttcgttcgtatcatcggtt

SEQ ID NO: 115 - DNA, 1171 bp, Glycine max
aactctttgtttcttgtttgttgattaacccttaattaatccgggcgcgcctgatttatcacaagtttgtacaaaaaagcaggctcctgcaggaccatgatggaacacaacatcatcgtcaacaacaacgtgatcgcaccgtttgtcataaaaacctacaatatggtgaacgatcccaccaccgataaactcatcacgtggggcccagccaacaacagcttcatcgtcctcgatcccctcgacttctcccactccctcctccctactttcttcaagcacaacaacttctccagcttcgttcgccaactcaacacctatggtttcagaaaggtggatccggatcggtgggagttcgcgaacgagtggttcctgcgaggacaaaagcacttattgaggaacatcgtgcggaagaagcacggtggagctgggaggaccaattccaattcgcattattcgcatcccttgaagctggaggagttggacgacgaggctatggtgatggagatagcgaggttgaaggaggagcaaaaagcgttggaggaagagcttcatgaaatgaacaagaggttagagacaacagaaaaacgaccacaacaaatgatggcttttctgtgtaaggttgtcgaggacccgcagattctttctcggattctccgagaaagagaaaagaaacacctgggagagaaaaagcgacgcctcattccgcctccgccgccgacggcagcgacgtcgtcgtcgtcgtcctccggcatcaagacagagttcgaagaagacgaaggtaattataatatcaagtcttcgtcgccggagacagggttggaaatcgacaacaatagtaacaatatttgttcgccgccgccgctggggtgttggggtgaacagggttgttatgggtacaattgcgcctccgtgccggcacctttgacggtggtagcgccggcgtttccgacgatgggaggagggtatttgaggcgtggggggttttggggggaaatggcggcggaggggaatgcggtgccgccttatccgttttcgttgttggaagggggcttttagatttagttttaggttatgaaatgaatgaattattactgccactcgagacccagctttcttgtacaaagtggtgataaattggagctctgcagagctttcgttcgtatcatcggtt

SEQ ID NO: 116 - DNA, 1352 bp, Glycine max
aactctttgtttcttgtttgttgattaacccttaattaatccgggcgcgcctgatttatcacaagtttgtacaaaaaagcaggctcctgcaggaccatgaccgaagaagaccgctccgcccaggaaaccgtccacaatggcgtcgcctcgacggagctaggcggcgaggagatggacatcgctgaggtgacggccgccggaagagtgaagggaccgtggtctccagaggaggacgcgctgctgagccgattggtggcgcagttcggtgcaaggaactggagcatgatcgcgcggggagtgccgggacgctccggcaagtcgtgccggctccggtggtgtaatcagctggacccttgcgtgaaacgcaagcccttcactgaggaagaggatagcatcatagtttcagcccatgcaatccatggaaacaaatgggcagcaattgctaggcttcttccaggaagaacagataatgcaatcaagaatcactggaattctacactgaagcgcaggtgtatggaaatgggaagatatgtcccagcacatgctgatgtgatggaagatggtactggcagctttgataaaacaaaagcatcctctgaagaaaccatgtcaattggggatatcaattcaaagaatcctgctgaagtcagaaatgtcatgatggataatgaaaataaacctccaacaaaagatgatgctaaagtggaggaacatcctactcttcatcgaccagtagcacgtgttagtgcatttagtgtttataacactccaggaaggtcaacaatgggatcatgttcaaagatgttcccaaggcagagccctttgatccaatcccccaaaccagacgtaggatcctgcaagttatttgatgatattgattgtgagcccatggttccatcacaatgtggtcatggctgctgcacaggagactcgagggaaagccattcgcatggttcacttctaggtcctgagtttgttgactatttggagtcaccttcctctagtcatgcatttatttctatagctacagacttgaacaatatagcttggatcaagagtggccttgagaattgtagtactggagtaactgagaatactgcaaacttgacagcatctcgaggagttgccagtgctttgcaaacaaacttcttaggacaagatctaaagaatggctacgggcaatttgaggagggacatggcatgtttttgggtgcgatgcaagaagtgttgtcaacaaagatggctaggcaacattatgcaatgcctgcggaagtttaactcgagatccagctttcttgtacaaagtggtgataaattggagctctgcagagctttcgttcgtatcatcggtt

SEQ ID NO: 117 - DNA, 939 bp, Glycine max
aactctttgtttcttgtttgttgattaacccttaattaatccgggcgcgcctgatttatcacaagtttgtacaaaaaagcaggctcctgcaggaccatggatagcaagttcagaaaaaagaaccgcaacgttaactcatataccagtgaacaagatcaagacactgatatagctcaagaaaaccttgccgagtcccctccttcttccactgtgttcaacatcgatggcttagtcccctcccccacttcctcatcaaagagaaggagggcaatacagaaaagggtggtgcaaatcccaatgaaggagacagaagggtgtaggctaaaaggagagagcaacaccccaccctcggattcatgggcatggagaaagtacggccagaaacccatcaagggttccccttatcccagagggtactacaggtgtagcagttcgaaggggtgtccggcacggaaacaagtggaaaggagctgcgtggaccccacgatgctagtcgtcacttactcctccgaccacaaccatccctggccaccttctagaaaccacgccaggcccaccaaaaaacctgaaccggttccggacccggtcgaaccggaggagaagttcgcggacgagtccatgataacaaccgcggaagaattggggtggctgggggagatggaagcgacgtcgtccacggttctcgaaagcccgtttatggctacgacgtaccatgctgacgtggcgctgattccgatgagggaggaggacgagtcgctcttcgccgacctcggagagctgccggagtgctcggtagtgttccggcaggggctgctggcggagcggcggcggtacacggcgccgtggtgtgggaccacaagttgactcgagacccagctttcttgtacaaagtggtgataaattggagctctgcagagctttcgttcgtatcatcggttt

SEQ ID NO: 118 - DNA, 1154 bp, Glycine max
aactctttgtttcttgtttgttgattaacccttaattaatccgggcgcgcctgatttatcacaagtttgtacaaaaaagcaggctcctgcaggaccatgggtgtgaacgaagatttcaacaaggatattgatgatcatcatcatgagtatgtggatgatgatgatgttcctcttccggggtttcgtttccaccctacagatgaagaacttgttagtttctatcttcgaaggaagcttcacaagaaacccatcagcatcgagctcatcaaacagattgatatttacaaatacgatccttgggatcttccaaaaaccagtgccactgcagaagagaaagaagggtacttcttttgcagaagagggaggaagtataggaacagcataaggcctaacagagtcactggctctgggttctggaaagcaactggcatagacaagccagtgtactcacatggaggagaaggaaatgactgcattggcctaaaaaaaacactggtgtactaccgtggcagtgcaggcaaaggcatcaaaactgattggatgatgcacgagtttcgccttccttctaacaaagacaacaccaccaaccttcccagctccaagaattacgtagatgttccccaagaagctgaaatttggacattgtgtcgaatattcaagagaaatgtctcacagagaaagcacacgccagacttgaaacaattatctgctaagcgccactccattcatgacaagaactcaagaatgagcaacgtggagttcaacaatactaatcaagaatcatatataaactttggtggccactatcagaatgagcagaaacccgtgattaactacacaaacagtgatcaaaggaatcagtatcatgtgatgactcatcagttgtttgctgctccagtggcacagcatcatcagcaacctcaacaactaacttctccatcttctaacttttggcttaacagccctcctgggaacgacttcttcacgtttgataactgggatgagcttggatctgtagtgaagtttgtggttgattagcctagcttgtagataaaaaagatgtggttcatgttgagttgactcgagacccagctttcttgtacaaagtggtgataaattggagctctgcagagctttcgttcgtatcatcggtt

SEQ ID NO: 119 - DNA, 1144 bp, Glycine max
ttgtttcttgtttgttgattaacccttaattaatccgggcgcgcctgatttatcacaagtttgtacaaaaaagcaggctcctgcaggaccatggagaccagtggcggtgttagcggcggcgttacgctggtgggatcggatgctccgtcggactaccatgtagctccgaggaccgacaacccggctccggcaagcggatccacgacgcagattccggcgacggcgggaagtgttccgccgtcgccacatccgccacacacggcggcgatggaggcgtatccggcgaagatgccggcgaaaaagaagaggggccggccgagaaagtacgcaccggatgggtcggtgaccatggcgctgtctccgaagccgatatcttcctccgctccgttgccgccggtgatcgatttctcgtcggagaagcgcggaaaaataaaaccaactagctccgtgagcaaagccaaattcgagttggagaatttaggtgaatgggttgcatgctcagttggtgctaattttactccccatatcatcactgttaattctggggaggatgttactatgaaggtaatatcattttctcagcaagggccgcgagctatatgcattctttcagctaatggggtcatatcaagtgtcacacttcgtcagcccgattcttctgggggcacactgacatatgagggacggtttgaaattctgtctttatccggctcattcatgccaagtgaaagcggaggaacacgaagcagatccggtggcatgagtgtatctttggcaagccctgatggacgtgttgtaggtggtggagtagctggtctgttggtggctgcaagtcctgtgcaggtagtggtaggaagttttctggcaggaaaccagcatgagcagaagccaagaaaacagagacatgaggttataacaagtgtgataccagctgcagttgttccaatctctacccttgatccagtgccaattctatcagcagcgtcttccatccgaaacgataattggtctgctatgccagcagaggccaagaataagccagctgacattaacgtgtcgcttcctgcagggtaactcgagacccagctttcttgtacaaagtggtgataaattggagctctgcagagctttcgttcgtatcatc

SEQ ID NO: 120 - DNA, 868 bp, Glycine max
ttcttgtttgttgattaacccttaattaatccgggcgcgcctgatttatcacaagtttgtacaaaaaagcaggctcctgcaggaccatgaagatccagtgtgatgtgtgtgacaaagtggaagcctccgtcttctgtcctgcagatgaagctgctctttgccatagctgtgatcgcaccattcaccgcgccaacaagcttgcaaccaaacacgcccgtttctctctccactaccccacctccaaagacttccctctttgtgatatatgccaagagaggcgtgcatatctattttgccaagaagacagggcgttgttatgcagggaatgcgacgttcctatccacagagccaatgagcatacccaaaagcataacaggtttcttctcacgggtgtgaagctctctggtacttgtttagatcctgcttcgtcctccaccaattacaccaataataatagagtcactggctctgaaggaagaaacgacgctcgatctagaatgaacagacccagatcatcagtttccaatgaagaaaatgcaagtaattcttcttgcaaggttgaagacaacgtggctagtgacactggttcgatttcaactagcagcatttctgagtacttgattgaaacaatacccggttactgttttgaagacctccttgatgcttcgtttgcacctaatggtttctgtaagaagcagaactttgatcatccctgggcgtttcaggaccaaaagcgaacaagtggagacactatggccgtgccgttcctgaaactagtcatccattgatcaaaatatctaaaccctcgcggtcataaactgtttgtaaaaatctgttgctcgagacccgctttcttgtacaaagtggt

SEQ ID NO: 121 - DNA, 964 bp, Glycine max
ttcttgtttgttgattaacccttaattaatccgggcgcgcctgatttatcacaagtttgtacaaaaaagcaggctcctgcaggaccatggttcaacaggaagtgcgtaaaggtccttggacagaacaggaagacttcaaattggtgtcctttgttggcttgtttggggaccgtagatgggactttatagctaaggtatcaggtttgaatagaacaggtaagagttgcagattacggtgggttaattacctacatcctggcctcaaacgtggaaagatgaccccccaggaagaacgccttgtcttggagcttcactcaaaatggggaaataggtggtcaagaattgctcgaaagttaccagggcgcactgacaatgagatcaagaactactggaggactctgatgaggaaaaaggctcaggacaaaaagcgaggagaagctgcatcatcatcatcatctagtgttgattcctcaatatcctcaaacaaccatgcggtggatccacatgcttccaagaaagcaggagaagagagcttttatgacactggaggtcatggtgtgacagcctcaacccaagatcagggtcaaaaaggtgaacaagggttgttctctatggatgatatatggaaggatattgacaatatgtcagaagagaacaacactcttcagccagtttatgaagggaacagtgaagagggttgcaacttctcttgcccaccacaagtgccttctccatcatcatgggaatattcttctgaccctctatgggtgatggatgaggaaagtttgttttgccctttgagtgaaccatatttttcctgctatgcacaaggcagcgtttttttaaccggctaatattattctttttttccaaatcaatattttgttcatagcactcgagacccagctttcttgtacaaagtggtgataaattggagctctgcagagctttcgttcgtatcatc

SEQ ID NO: 122 - DNA, 1215 bp, Glycine max
ttcttgtttgttgattaacccttaattaatccgggcgcgcctgatttatcacaagtttgtacaaaaaagcaggctcctgcaggaccatgggagttccagagagagaccctcttgcacaattgagtttgcctcctgggtttaggttttaccccacagatgaggagcttttggttcagtacctttgccgcaaggttgctggccatcatttctctcttccaatcattgctgaagttgatttgtacaagtttgatccatgggttcttccaggtaaggcagtgtttggagagaaggagtggtacttttttagcccaagagacaggaagtacccgaatggttcacgaccaaacagagtcgcgggttctgggtattggaaagcaactggaacagacaagatcatcaccactgaaggtagaaaagttggcataaaaaaagcacttgttttctacattggcaaagcacccaaaggctccaaaaccaattggatcatgcacgagtatcgccttctcgattcttcccgcaaacacaacctcggaaccgcaaagcttgatgattgggttctatgtcgtatctataagaagaactcaagttcacaaaaggttgaggctaattttttggctatggaatgcagcaatgggtcatcaccttcttcatcgtcccacgtggatgacatgctgggatcgttgccggagataaatgaccggtgcttcaccctgccacgagtgaactcactcagaacaatgcaccagcaggatgagaaattcgggtctccgaacatgggatccgggtttttctcggattgggttaactcgaccgatctcgattcgatttccgaattcgagtcgggttgccaaacccaaagaatggtgaattatgattgcaatgacttttttgttccttctctgccgcccttgggccatgtggactacatggtggatgcacctttggaggaggaggttcaaagtggtgtgagaacccgacgggtcgacgggccggggcattttcaaccgaatccagatacccgattgttaccgggctcaggtgacccattcgggtttgggtttattatgggtcagcaagttgggttcggggttagggagtgaagtgaaggatcagaaagtgtaattgtgtaaataattggggattttctcgagacccagctttcttgtacaaagtggtgataaattggagctctgcagagctttcgttcgtatcatc

SEQ ID NO: 123 - DNA, 729 bp, Glycine max
ttcttgtttgttgattaacccttaattaatccgggcgcgcctgatttatcacaagtttgtacaaaaaagcaggctcctgcaggaccatgaggagccaacttgtgtgtaatgggtgtaggagcatcttggtttaccctagaggagcaaccaatttttgctgtgcgttgtgcaacaccattacctctgttcctcctcctggaatggacatgtcacaactctattgtggaggctgtacgacattgctaatgtacacacgtggtgctacaagtgtgagatgttcctgctgtcacactattaaccttgtaccagaatctaatcaagtcattcattgtgcgaactgccggacaacactcatgtatccttatggagcttcctcagtcaaatgtgcaatttgttgctatattactaatatcagtatgaccaatggaaggctttcaattcctgtacagagaccaaatggaacagccaactctggaacagtatcttcaacttcatcgtcaatgccttattctcagagccaaactgtcgtagtagaaaatcctatgtctgttgattcgagtgggaaattggtgaggaatgtcgttgtgggcgttacaacagataagaaatgatacttgccacatgaaaatgttacacaagtgtaaaggaacatcatttgactcgagacccagctttcttgtacaaagtggtgataaattggagctctgcagagctttcgttcgtatcatc

SEQ ID NO: 124 - DNA, 742 bp, Glycine max
ttcttgtttgttgattaacccttaattaatccgggcgcgcctgatttatcacaagtttgtacaaaaaagcaggctcctgcaggaccatggccaaagaaggtcttggacttgaaatcaccgagctaaggttgggtctacccgatgcggagcatgtaactgtggtcaataagaatgagaagaagagggccttctcgcaaattgatgatgaaaatagctcctccggcggcgaccggaaaatcaagaccaataagagtcaagtggtggggtggcctccggtgtgctcttaccggaagaagaacagcatgaacgaaggttcaaagatgtacgtgaaggttagcatggacggtgctcctttcttgcgcaaaattgatttgggtctccataaggggtactcagatttagccttggctttggacaagctctttggttcctatggaatggtggaggccttgaagaatgcggacaattctgaacacgttcccatttatgaggacaaagatggtgactggatgcttgttggagatgtcccttgggaaatgtttatggagtcatgcaagaggctgaggattatgaagaggtcagatgccaagggcttcggtttgcaaccaaaaggatctctgaagggattcatagaaagcgcggcaaagtgaaacattatgttaggcttctaattaatgtcgtgcacatttctcgagacccagctttcttgtacaaagtggtgataaattggagctctgcagag

SEQ ID NO: 125 - DNA, 1197 bp, Glycine max
ttcttgtttgttgattaacccttaattaatccgggcgcgcctgatttatcacaagtttgtacaaaaaagcaggctcctgcaggaccatgaagaacaatagagataaagaaaagggtaacgacgttgaccagagttacagacagcatcacacgttgtcaatgccaatgatgttttctggtttgaacagagagaaggagatgtcagccatgatctctgctttgacacatgttgtttgtggagaagatgagcatcatggtgctgattactctcttcttaatcacaatattaataatactaatagtgcagttgttggtgatgatgattttactgtaacatcaaatatggcttctggttctatgccaccttcttctacttgttcatctcaaggtggcaactctgttctcaagagaagacgggaatatgataatacaaatgatttctcacgtggaggttcattccctgctatttcaacaattgctgaaagttcaagcacggtaacaagaagaacggcgaatacagtatacgattacgaatacagaacagagaacgtgaaagtagtggaggaagaaccgaggagaaaatacagaggagtgagacagaggccatggggaaaatgggctgcggaaataagagaccctttcaaagctactagggtgtggttaggaacatttgaaaccgctgaggacgcagccagagcctacgatcaagcttcactgcgtttcagaggcaacaaagccaaactcaacttccctgaaaacgttagactcagacaacaacaagaacctccgttgaacttgaaccctccaccaccacctaatcatggggctattttgtcaattccttcaaccactgttcacactgaggctcttcagggttcacttggttcaagcaatttttatgagcattcttattcgcatcttcatgagtttcccgtgagtctctacgatcagattgcagagtcaacatctactactatggcttctcatcatcttcaatttttgccgcctgcttcttcctcaactatgactatgacatctccgcaggcaccaccttcgatttatcctacgcatccagcggcatggtcttctggttatagttataatagctcttcttctgcttcggggtgactcgagacccagctttcttgtacaaagtggtgataaattggagctctgcagagctttcgttcgtatcatc

SEQ ID NO: 126 - DNA, 2726 bp, Glycine max
ttcttgtttgttgattaacccttaattaatccgggcgcgcctgatttatcacaagtttgtacaaaaaagcaggctcctgcaggaccatggcatcatcggaggtgacgatgaagggaaattgcttgaaccacaacgacggcggagccacggagcctcattcgccgtccacggccaaagacgcagaagctgcacttttcagggaactatggcacgcatgtgccggtcctctagtcacggtaccgcgggaaaaagagcgcgtgttttatttccctcaaggacatattgagcaggtggaggcgtcgacgaatcaggtggcggaccagcacatgccggtttacgatctcccacccaagatcctttgtcgggtcatcaacgtgcagctgaaggccgagcccgacacggatgaggtgtttgctcaggtgactttgcttccggagccaaaccaagatgagaatgccgtggagaaagagccaccaccacctccgccaccacggtttcatgttcattctttctgtaagactctgacggcgtccgatacgagtacccatggtgggttttctgtgctgagacgacatgctgatgaatgtcttcctcctctggatatgtcgaagcagccacccacacaggaattggtggctaaggatcttcatgcaaatgaatggcgatttaaacatatctttcgaggtcaaccgcgtagacacttgcttcagagtggttggagtgtttttgtcagctccaaaaggcttgttgctggggatgcatttatatttcttagaggtgaaaatggggaacttcgtgttggtgtccgacgtgcaatgagacagcagggtaatgttccatcctcagttatctcaagccacagcatgcatctcggtgtccttgcaactgcttggcatgccatcttgaccgggaccatcttcactgtttattacaaacctaggaccagtcccgccgaatttattgttccgtatgatcaatatatggagtctttaaaaaatagttatagcatcgggatgcggttcaaaatgaggtttgaaggtgaagaggctccagagcagaggtttactggtaccgttgttggaatagaagattctgatcccaaaaggtggagagattccaaatggagatgcctcaaggtgagatgggatgaaacatccaacacccctcggccagagagagtttccccttggaaaatagagccggctcttgctcccccggctctaaatcctctttcaatgcccaggcctaaaaggcctcggtctaatgcagttccttcatccccagattcttctgttcttactcgagaagcatcatctaaagtaagcatagacccttcaccggcaaatgggtttccaagggtcttgcaaggtcaagaattctcgaccttgagaggcaattttacagaaagtaacgagtttgatactgccgagaagtctgttgtttggccacctactgcagtagatgatgaaaagatggatgtttctacttcaaggaggtatggttcagagagctggatgtcaatggggaggaatgagcctacatattcggatcttctttcaggctttgggaccagtggggatccttctcattcatccctgaaggatcaaatgagccctgcttattctgctagaaagcaatcattggatcatgaaggcaaacttcacatgcctcatccgtggcctgtaatgccctctagtctgtcactgaacatcttggactctaatgcaaaaggtcctacacatggtggtgatacatctttccaagctcgagggaatttgaggttcagtgcatttggtgaataccctgcactgcatggtcataaagttgaggattcacatggaaacttgatgccacccccacctgcaccccaaactcaatatcagagtccttgttcaagagagcttatgtcaaaacatgtatcagcaaaaacttgtgaggctgtgaaaccaaaagatggtgactgtaagctatttggcttctcacttatcagtggccctatcgtaccagagccttctttatcacaaagaaatgtgagtgagcctgctggtcagatgcatcttacagcacaccaacaaagaacatctgaaaatgatgagaagtcagatcactcaaagggatcaagacctgtagatgatctagttgttgatgaccatgacagaccattacagacttctcagtcgcatactaaagacgttcaagccaaacctctcagtggttctgctaggagttgcactaaagttcacaagaagggcattgcacttggtagatcagtggaccttacaaagtacagtggctatgatgaattagttgccgaattggatcagctgtttgaatttgggggtgaattattgtcaactaaaaaagattggcttatcgtctatactgataatgagggtgatatgatgcttgtaggcgatgatccatggcaggaattctgtgccatggtttgcaaaatttatatctaccctaaagaggagatccagaaaatgagcccaggtacactgagctcgaaaaatgaagagaaccagtcggtgatggctagtgatggtgcagatgcaaaagttgttaaatgtcagccacatcaaaagttcaattcagaaaatggccttgacgcctaatgattagtagattgatttccatagctttcagattctggctcgagacccagctttcttgtacaaagtggtgataaattggagctctgcagagctttcgttcgtatcatc

SEQ ID NO: 127 - DNA, 2079 bp, Glycine max
ttcttgtttgttgattaacccttaattaatccgggcgcgcctgatttatcacaagtttgtacaaaaaagcaggctcctgcaggaccatgacggacggtcatctcttcaacaacatcaccctcggaggccgtggaggcaccaatccagggcagataaaaatatatcctggaggaattatatggaagagacagggtggtggtaaattaattgaagttgataaatctgacataatgggggtgacatggatgaaggtgccaaggagtaaccaacttggtgttcaaatcaaagatgggttgtactataagttcacgggatttcgtgaccaggatgttgtaagtttgaccaattttttccaaaacacctgtggaatatcagtagaagagaagcagctttctgttagcggacggaattggggagaagttgatctaaatggaaatatgctggctttcacggttggttcaaagcaagcttttgaagtgtctttagcagatgtctctcaaacgcagcttcaagggaagaatgatgtgatcttggagtttcatgtggatgacacaactggagcaaatgagaaagattcactaatggagataagtttccatataccaaattccaacacccagtttgttggtgatgaaaatcgtccccctgctcaggttttccgtgacaaaattatgtctatggctgatgttggcgctggaggtgaagatgctattgttacatttgagggtattgcgatccttacaccaagaggacgatacagtgttgagttacacatgtcattcttgcggcttcaaggacaggctaatgatttcaaaatccaatatagcagtgtggttcgcctatttttacttcctaagtctaatcaaccacataccttcgtcattattagtcttgatccccctattcgaaagggacaaacattgtaccctcatattgtgatgcagtttgaaactgattatgttgttgaaagtgaattggcaataaatgaagatctttataacacaaagtacaaggacaagttggatctgtcttataaggggcttattcatgaagtgttcaccacaatattacgtggtttgtctggtgccaaagtgaccaagcctggaaaatttaggagttgtcaagatggctatgcagtgaaatcatctttgaaagctgaagatggaattctgtatccccttgagaagagcttcttctttctacctaaacctcccactcttattcttcatgaagagattgactatgtggaatttgagcgacatgctgctggtgggtccaatatgcattattttgaccttcttatcagactaaaatctgaacaagagcatctcttccgtaatattcagagaaatgagtaccacaatttgtatgaatttatcagttcaaagggcttgaaaattttgaacttaggagatgcacaacctactgttggtataaagaaggttcttgagaatgatgatgatgatgctgttgatccacatcttgaacgcataaaaaatgaagctggtggagatgaaagtgatgaggaggattccgattttgttgctgacaaggatgatgaaggttctcctactgatgattctggggcagatgattctgatgccactgatagtggtgatgagaaagagaagcctgccaaaaaggaatcaaagaaggatctgccttctaaggcatctacttctaaaaagaaatcaaaagatgatgaagatggaaagaagagaaaacagaagaagagaaaggacccaaatgcacccaagagggcaatgtctgggttcatgttcttttctaaattggaaagagagaatctaaagaaaactaatcctggaatttcatttacggatgtgtcaagagtacttggagagaaatggaaaaagttgtcagtggaagagaaggaaccatacgaggcaaaggcacgtgaagataaaaaacgttacaaggatgagattagtggctacaagaatccgcaacccatgaatattgattcaggaaatgaatccgacagtgcctaactcgagacccagctttcttgtacaaagtggtgataaattggagctctgcagagctttcgttcgtatcatc

SEQ ID NO: 128 - DNA, 759 bp, Glycine max
ttcttgtttgttgattaacccttaattaatccgggcgcgcctgatttatcacaagtttgtacaaaaaagcaggctcctgcaggaccatgagagtttcaacagagacagagccggagactaaaaagataaaacgcattcgcggcggcggggactcgagcaagcaccctttgtaccgcggcgtgcggatgcggaactgggggaagtgggtgtcggaaatccgcgagccgaggaagaaatcgcggatatggctaggcacattccccacgccggaaatggcggcgagagcgcacgacgtcgccgctctcagcatcaaaggccccgccgccattctcaacttccctcacttggccaactcgctcccccgcccggcttcgctggcgccgcgcgacgttcaagccgcggcggcgaaggcggcgcacatggacccttcctccctctcctccttggtctccgcaatggacttgtcctctgcctctgacgagttgagccaaatcatagagcttccttctttggaaagcaccgatgatggctctgttgacttaaagaaggagtttgtttttgttgattcccttgatgcttggatgtatcagccaccctttggttttgacaccgaacaagacactggtttcgagggtttgatgtggaattactaggttcgatccaagtttctattctatgtcttgtgtttgctcgagacccagctttcttgtacaaagtggtgataaattggagctctgcagagctttcgttcgtatcatc

SEQ ID NO: 129 - DNA, 989 bp, Glycine max
ttgttgattaacccttaattaatccgggcgcgcctgatttatcacaagtttgtacaaaaaagcaggctcctgcaggaccatgcgtgttggatcaacggctaattgttgttacctgcagctggaagctcctcaacagaataatgtaaccgagtcatcatcagatatgtcagatcggatgatcaagatccagatcgcaaatcaccctctttatccagatttactctctgcatatatagaatgccaaaaggttggagcaccgccggaactggcatgccttcttgaagaaataggccgagaaagccaccgcatgaatgctcgccgtgagattgtggagggtcctgaacttgaccacttcatggaaacattctgcgaagttcttcatagatacaaggaggagttgtccaggcccttcaatgaagcgacgttatttttgggtgacatggaatcacaactcagcaacctttgtaatggaacactaacaaagtcatcggataacaacaaccgctccgatgaggtagctagtggggcatcagaagaggaattaagttgtggggagatggaagcatttgaagatcatgtatcttcttctgtaacttgcccaagtgatcaaaggcttaaagaaatgctccttcgcaaatacagcggccattttagcggtttgagaaaggaatttctaaaacgaagaaaaaagggtaagctaccaaaggatgcaaggatagcactcatggactggtggaacacccattatagatggccttatcctacggaagaggagaaagtgaagttgtcagaaattactggactggatcaaaagcagatcaataattggttcatcaatcagagaaaacgtcattggaaaccaactgatgacatgcgatctgccgttatggacggcataagaggacctatgttgttttaactcgagacccagctttcttgtacaaagtggtgataaattggagctctgcagagctttcgttcgtatcatc

SEQ ID NO: 130 - DNA, 1428 bp, Glycine max
ttcttgtttgttgattaacccttaattaatccgggcgcgcctgatttatcacaagtttgtacaaaaaagcaggctcctgcaggaccatggatcctctatgtgagttttgtcgggtggtgagagctgtggtttactgtaagtcagattctgctcgtctctgcttgcattgcgatggctgtgtacactctgcaaattctttgtctcgcaggcattcgcgttccctcctatgcgataagtgcaattcccagccggcaatgatccgctgcatgaatcataagttgtcattatgtcaaggttgtgactggaatccaaatgactgttctgcattgggacataggcgccttgcattgaattgctacactggttgcccctctttggctgagttttctaggctctggtcttttgtgtttgatgctaattcctcacttggtggttgggaatcggttggtactttgccaaaaagtgagagctgcactagccagtgtttggagcaaactgatcataatggtggttattttggtttggtgagtgacaagttggatgaaattgaatcttgtgtcagatatcaacctcggatggatcagtctcaaatcattccatcaaatccaaattacacaccgtactgcaaagacgaagcatttttctttcctcaagactcaaaccagccaaagctgcaggaatgtcctaatctaggaattcatgatgggaatgaactttgtgaaggtttcaatgtggataacgttcaattaaactttgaaattgctgatgaaatattttactgttcacaagttgccacaagataccaccttgaagatggaggaatggactgtttattgatggataaaaacatagcagttacagaatctagttcacttattgagagtgccatggaggcatcatcatctatccaacaagattgtgtggcttttcaatcatcgagggctggtgggtcagctagtgtgatgcaggttatcaacagcaataccaattgtgcacttatgaatcctagctgcactaaaaacatcagtctgggatttcctcagggcctagttcattcaaacatgccacttcaatttcccaacatagttggtgaaaataattctactgaatatcaagactgcgggttatcgcgagtgggtgaatccccctgggaatcaaatttggagggtacatgcccacaagcaagggataaagctaaaatgagatacaatgagaaaaagaaaactcgaacctttggtaagcaaataagatatgcttctcgcaaagcaagggccgatacaagaaaacgtgtgaaaggtagatttgttaaagcaggtgaagcatatgattatgaccctcttgggacaagggacatctaactcgagacccagctttcttgtacaaagtggtgataaattggagctctgcagagctttcgttcgtatcatc

SEQ ID NO: 131 - DNA, 816 bp, Glycine max
ttcttgtttgttgattaacccttaattaatccgggcgcgcctgatttatcacaagtttgtacaaaaaagcaggctcctgcaggaccatggcgcccagggacaagactagtgccgttaagcctagcggtaacgccggggtgaaggacctgcattttcgtggagtcaggaagagaccgtgggggaggttcgccgccgagatcagagatcccgccaagaagacccgcgtctggctcggaaccttcgacaccgcggaggaggcggcccgtgcctacgacgccgccgcgcgggagtttcgcggccctaaggcgaagacaaacttccctctcccttcggaaaattttaagaacgcgagccctagccaaagcagcacggtggagtcctccagccgcgaccgcgacgtcgccgccgattcctctccgctcgacctcaacctcgcccccgtcgccgtctcctccgctcgattccccttccggaaccagttcccggttttccccggcgcggtgccggcggcgaaccaggttatgtacttcgacgccgtcctacgcgccggcatggccggtccacgtggcttcgcgtttggctacaatcctcatcccgtcgcggcgagtgagtaccacgcgacgacgagcgactcggactcgtcctccgttatcgatctgaatcataacgaaggcgttgttaaggggaacggttctagaatgttcgatctcgaccttaaccatcctcctccacatgagatcgcttgactcgagacccagctttcttgtacaaagtggtgataaattggagctctgcagagctttcgttcgtatcatc

SEQ ID NO: 132 - DNA, 2198 bp, Arabidopsis thaliana
cttgtttgttgattaacccttaattaatgctggagaatggacaaatcccagaagaatcctacttcccagatcggaacttcaactcccaaatccaaattcgaggattctccagtgttcaactacataagcaacctctctccaattgagtcggtcaaatctatctccactgctcaaacgtttagctctcttagtttcacatctcctcctcctgtgtttacttctcctcacgtcatttctcacagagaatccagattctttagatgtcataactctgttgatcgttcaaagcacttagaatctttagatggatctgctgttaaaggagaagttgtagtaccattagttgaagatctaaataaagaagcttctttggaagatgaagaagaaacttctgttgaaacgtcttctgagctgccacagatcatgaagttcgatagccaaacttctgagcatagtgattcaccttgcactgaagatgttgttattgaagcttcatctgatcctcctcgaggagacaatggttcgtcatccgaggatgtcacgatgggacttcagaatatgcttgttgttcgggaagggaatgacactcctggttgtggacgtttgatctcagatgcaactgagctgttagtatttcgatctccgaatgattctgaggcttttagatgcttggtcgataaaatatcaagctcagaaagacggttctgtgctggtgtcaagtctacaaagcggcctgatatcaacaaagatattccagccaatggatctagtaatgaaaatcagcctttggctgtgcttcctacaaacgagtctgtctttaacttgcatcgtggtggcatgcgaagacgctgccttgactttgagatgccagggaaacggaagaaggatattgttgatgatcagcaatctgtgtgtgacaataatgtggctggtgaatcttcctcgagctgtgttgtacctggtattggtcttcatctaaacgccgttgcaatgtctgcaaaggacagtaacatcagtgtcatacatggctattccatatctggagagattcaaaagagtttctcaggctctaccactccaattcagtcccaagacactgtgcaagaaacttcggaccaggcagaaaacgaacctgtagaagaagttcccaaagcattggtgttcccagagttgaatctaggcagccttaagaaaaagatgcgtaaatctgaacaagctggggagggtgagtcatgtaaacgatgcaactgcaaaaagtctaagtgtttgaagctttactgtgaatgctttgctgctggggtttattgcatagagccatgttcatgtatagattgcttcaacaaacctatccatgaagaaactgttttggctacccgcaaacagattgaatcccgaaatccactcgcatttgctcctaaagtcatcagaaatgcagattccatcatggaagctagtgatgatgccagtaaaaccccggcttctgcacgacacaaacgtggctgcaactgcaagaaatcaaactgtatgaagaaatactgtgaatgctatcagggtggagtcggctgttccatgaactgtagatgcgaaggatgcacaaatgtattcggcagaaaagatgggtctttacttgttatcatggaaagcaaactagaggagaatcaggagacatatgagaaaagaatagcaaaaatccaacacaacgtcgaggtgtcgaaagaagtggagcagaacccaagttctgatcaaccttcgacaccactgccaccgtacagacatttggtggttcatcagccattcttgtctaagaacagactgcctccgacacagttttttcttggcacaggttcttcctctttcagaaaaccaaacagtgatttggcgcaatcacagaatgagaagaagcctcttgaaactgtgactgaggacaaaacagagattatgcctgagattctcctcaattcccctatagctaacatcaaggccatctctcccaacagcaagagagtctctccccctcaacccggctccttggagtcaggctcaatcctaaggagaagaggtaatggccggaagctgatactacggtctattccagcatttccttctctcaacccaaatcagtgaatcaaggcgcgccaaaaattggagctctgcagagctttcgttcgtatcatcggtttcgacaacgttcgtcaagt

SEQ ID NO: 133 - DNA, 1710 bp, Arabidopsis thaliana
ccttcccacataaaccccaatcccaaattctcttcatttttccttattcttgcgactaatcgattcaatcccaaatttcagaattcaaaatttcatctaaagtttagagatttctcgattatggtgaaatcgacggacggtggtggtgggtcttcttcttcttcttcagtggcgccgttcttgagaaaatgttacgatatggttgatgattctactactgactctataatctcatggagtccaagtgcagataatagcttcgttatcttggacaccaccgtcttctctgttcaactcttgcctaaatactttaaacacagcaatttctctagcttcattcgtcagctcaatatctacgttagtcctctcttctcctctctcttttcaattttgtacaattggatcttctttgttatgtctcttactcttacatggtgtgattgtatttagcaaagtttcattttttctctgcttttacaacgtgtggataggttttagagaagattgattatgaatttggtttatgaagcatgaagaaagatgttttgttcaacttctattatctggaacagtgtttagaactagtactagtcacaatcttgaagactctatgatagtataagttggttgatctagggtaaatctggctcattggatctttgagtagacttgtgcctgattcgtggatgtgtttgtttacagggttttagaaaagttgatgcagatcgatgggagtttgcgaatgacgggtttgtgagaggtcaaaaggatttgctgaagaatgttatcaggaggaagaatgttcaaagtagtgagcagagcaaacatgagagtacaagtacaacatatgctcaggaaaagagtggattgtggaaggaagttgatattttgaaaggtgataagcaggtattggcgcaggagttgatcaaagttaggcagtatcaggaggtgacggatactaagatgttacatttagaagacagagttcaaggaatggaagagagtcagcaggagatgctttcgtttttggttatggttatgaagaatccaagtcttttagttcagttacttcagccaaaggagaaaaacacttggcgaaaagcgggggaaggagcgaagattgtggaagaagtgactgatgaaggagaatcaaactcatatggtcttcctttagtaacataccagccaccatcggacaacaatggaactgcaaagtcaaactcgaacgacgtaaatgatttcttgagaaacgccgatatgttgaagttctgcttagatgaaaaccatgtgccattgatcatacctgatctatacgatgatggagcatgggaaaagcttttgttgttgagcccttcaaggaagaagacgaagaagcaggagaacattgtgaagaaaggaaaggatgatttgacattggaggaggaggaggaggatggaacaatggaattagacaagagctatatgcttaagctgatatcagaagagatggagaaaccagatgactttgaatttggacagcttactcctgagaggtctaggaaccttgagattttgacagagcagatggaattgctggcttcaaatgaatagttgattttttgaacatatcagcctcaaaacttttgttatgtaactctataacaaacaacgaagtatgcaccggatatattactttcaccggtgcaattctcaatgatgtgttatagcagc

SEQ ID NO: 134 - DNA, 2525 bp, Arabidopsis thaliana
  misc_feature (1)..(44): n is a, c, g, or t
  misc_feature (2453)..(2518): n is a, c, g, or t
nnnnnnnnnnnnnnnnnnnnnnnnnnnnnnnnnnnnnnnnnnnnccacgcgtccggaaacgcaaataaacaaaagtcgctttctagccacgtgatctttcgtcgacttttcttcttcttcttcttcttcctcttcctcatctcgtatctctaacttttgtcgaagttcttttgatgaaactagggtttattatcttctccttctttttcccatcaccatagaaaaggcagagacctttttcttcatcatttttattctccttcttcttctgctgttcatttctccaggttacaatgatgtttaatgagatgggaatgtgtggaaacatggatttcttctcttctggatcacttggtgaagttgatttctgtcctgttccacaagctgagcctgattccattgttgaagatgactatactgatgatgagattgatgttgatgaattggagaggaggatgtggagagacaaaatgcggcttaaacgtctcaaggagcaggataagggtaaagaaggtgttgatgctgctaaacagaggcagtctcaagagcaagctaggaggaagaaaatgtctagagctcaagatgggatcttgaagtatatgttgaagatgatggaagtttgtaaagctcaaggctttgtttatgggattattccggagaatgggaagcctgtgactggtgcttctgataatttaagggagtggtggaaagataaggttaggtttgatcgtaatggtcctgcggctattaccaagtatcaagcggagaataatatcccggggattcatgaaggtaataacccgattggaccgactcctcataccttgcaagagcttcaagacacgactcttggatcgcttttgtctgcgttgatgcaacactgtgatcctcctcagagacgttttcctttggagaaaggagttcctcctccgtggtggcctaatgggaaagaggattggtggcctcaacttggtttgcctaaagatcaaggtcctgcaccttacaagaagcctcatgatttgaagaaggcgtggaaagtcggcgttttgactgcggttatcaagcatatgtttcctgatattgctaagatccgtaagctcgtgaggcaatctaaatgtttgcaggataagatgactgctaaagagagtgctacctggcttgctattattaaccaagaagagtccttggctagagagctttatcccgagtcatgtccacctctttctctgtctggtggaagttgctcgcttctgatgaatgattgcagtcaatacgatgttgaaggtttcgagaaggagtctcactatgaagtggaagagctcaagccagaaaaagttatgaattcttcaaactttgggatggttgctaaaatgcatgactttcctgtcaaagaagaagtcccagcaggaaactcggaattcatgagaaagagaaagccaaacagagatctgaacactattatggacagaaccgttttcacctgcgagaatcttgggtgtgcgcacagcgaaatcagccggggatttctggataggaattcgagagacaaccatcaactggcatgtccacatcgagacagtcgcttaccgtatggagcagcaccatccaggtttcatgtcaatgaagttaagcctgtagttggatttcctcagccaaggccagtgaactcagtagcccaaccaattgacttaacgggtatagttcctgaagatggacagaagatgatctcagagctcatgtccatgtacgacagaaatgtccagagcaaccaaacctctatggtcatggaaaatcaaagcgtgtcactgcttcaacccacagtccataaccatcaagaacatctccagttcccaggaaacatggtggaaggaagtttctttgaagacttgaacatcccaaacagagcaaacaacaacaacagcagcaacaatcaaacgttttttcaagggaacaacaacaacaacaatgtgtttaagttcgacactgcagatcacaacaactttgaagctgcacataacaacaacaataacagtagcggcaacaggttccagcttgtgtttgattccacaccgttcgacatggcgtcattcgattacagagatgatatgtcgatgccaggagtagtaggaacgatggatggaatgcagcagaagcagcaagatgtatccatatggttctaaagtcttggtagtagatttcatcttctcttatttttatcttttgtgttcttacattcactcaaccatgtaatattttttcctgggtctctctgtctctatcgcttgttatgatgtgtctgtaagagtctctaaaaactctctgttactgtgtgtctttgtctcggcttggtgaatctctctgtcatcatcagcttttagttacacacccgacttggggatgaacgaacactaaatgtaagttttcataatataaatataaaaaaaaacaaagcnnnnnnnnnnnnnnnnnnnnnnnnnnnnnnnnnnnnnnnnnnnnnnnnnnnnnnnnnnnnnnnnnngtcccaa

SEQ ID NO: 135 - DNA, 1170 bp, Arabidopsis thaliana
tacttacacagaaaaccagtttcagattctgcaaaaaaaaaaaaaaaaaacttataacttctttttaaaatacaaaaaataaaacttattaagcaattctttattaggtttctcgtggcgatggagaattcttacgactcaagcaagtggtctgattctacaactccatatatggtctcgtggtcactacaatctgagtcctctgattctgattggaaccggtttaatcttggcttctcttcttcctccttcggtggtaatttcccggctgatgattgtgtcggtgggatcgaaaaagctgagtcactttcaagaagccaccgtctagcggagaaaagacgccgtgaccggataaattctcacctcactgctctccggaaacttgtccccaattccgacaaggtatgtatgactctcacaactgaaatactctcggttcagtcatgaaacttcaatttgagcaaaccggtttatatctgatttcggttaaagaatttttaattcgagttgaccggtttattttctagctgggttatgtaaaccgattttgacttgactctactgcagttagacaaagcagctctattagcaacagtgattgaacaagtgaaagaactcaaacaaaaagcagcagaatcaccaatcttccaagatcttccaacagaagcagatgaagtaactgtacagcctgaaactatctctgactttgaatcaaacacaaacacaatcatcttcaaagcttctttttgctgcgaagatcaacccgaagcaatctcagagattattagagttctcacaaagcttcaactcgaaacaatccaagcagagataatctctgttgggggaagaatgagaatcaatttcatcttaaaagatagcaactgcaatgagactacaaacatagctgcttcagcaaaagctttgaagcaatctctctgctctgcgttaaatcgaatcacatcttcttctacgactacttcttcagtttgcagaatcagaagtaaaagacagagatggttcctctcttctcattattctcacaatgaataaatttcacaatatacatatacatagtataacacaaacctcattattactaaaggttttttccgcattttggtttagatttgttcctactaaaccaatcacgatttgtatatttcaagattt

SEQ ID NO: 136 - DNA, 759 bp, Arabidopsis thaliana
ccggaaacatcggcggcggcggatgataattcgtcttggaacgagactgatgtcaccgccatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataatctaattattattgttggtcgaatcagttttataaatagctatcatagtttcatttttgg

SEQ ID NO: 137 - DNA, 2698 bp, Arabidopsis thaliana
gagaagaaaaagagtgatttttgttttctgatgcatggtgaagaagaagaagaagaatagtgagtgagagaaaaagagtgattttttcatttttcagacagagagtgagtacttgaagaaatgggttgttgtcagtcaagaatagatagcaaagagatagtgtctcgttgtaaagcaaggaagagatacttgaaacatcttgttaaagctagacaaactctctctgtttctcacgcgctttatctccgttctctacgcgccgttggctcttcccttgttcacttctcttccaaagagactcctcttcacctccaccacaaccctccgtctccttctcctcctcctccaccgccgccgcgccctcctcctcctcctctaagccctggctctgaaaccaccacatggaccaccaccactacttcctctgttcttcctcctcctccgccgccaccacctcctcctcctccgccttcttctacatgggacttctgggatccgtttataccgccgcctccttcttcctctgaggaagaatgggaggaagagacaaccaccgcgacaagaaccgcaacaggaactggctctgatgctgctgtgacgacggctccgacgacagctactcctcaagcttcgtctgttgtgagtggattctctaaagatacaatgacgacgacgacgactggaagtgagctagcagttgtggtgtcgaggaatggtaaagatctaatggagattattaaagaagtcgatgaatatttccttaaagctgcagattctggtgcacctctctcttctctccttgaaatctcaacctctatcactgacttttctggtcattccaaatcaggtaacaacaatcaagctcttgtcttctcttctttgattgattttgattagtgttttgtgtttgtttcttcagggaaaatgtacagtagtagtaactacgaatgtaatctgaatccgacgtcgttttggacaaggggatttgctccttctaagttgagtgaatacagaaacgcaggaggagtaattggaggaaattgcattgttggtagccattcatctacagtggacagactctatgcttgggagaagaaactttatcaagaggtcaaggtattcactttttgacttcatttcattcataaagttgcaatctttgaacaaaacaattaatctttgatgtatcttcatatgttaagttttgtggaaagagtttgaaaatgttgtttatattcagtttgaagtttgaatattgaaattgcttgcttagatttcatccaaatatggataaatgttttgtttttgggaatttggttgattcatgtgggcattaaaggcttgtggtgggtccaagcgtgagcagatagtgtaagagacccacgtgtgtacttaattctgatgaataatgtgttatgtacactggcacaaatatcttgccaagtagtgagtgagtgtttgttgttttttgaatgtgggttttgttgcagtatgcagagagcataaagatggatcatgagaagaaagtggagcaagtgaggaggcttgagatgaagagagctgagtatgtcaagactgagaaggctaagaaagacgtcgagaagttagaatctcagctctcagtatcttcacaagccatccaaagcgcctctaacgagatcatcaagctcagagagaccgagctttaccctcagcttgtcgagcttgttaaagggtttgttttgtgcattcccattgcttcattaacctaaagtatcttatgttggtcaatgtgaacaaggttcttgtatgaatgtaatgtaggctaatgtgtatgtggaggagtatgtacgagagccaccaggttcaaacccatattgtgcagcagcttaagtaccttaacaccatcccctccactgaaccaacatctgagcttcaccgacaatcaactcttcagcttgagctcgaggtccaacaatggcatcactctttctgcaacttggtcaaggcccaacgtgactacatacaatctctcacgggctggctcaggttaagtctgttccagttcagcaagaatccacttgttaggagtagctacgagtcaaagatctacagcttctgcgaggaatggcatttagctattgacaggatccctgataaagtagcatctgaagggatcaaaagctttctgacagcagtccatggaattgtggctcaacaagccgacgagcataagcaaaagaagagaacagaatccatgttaaaagatttcgagaagaaatcggcttcgctgagagcgcttgagagcaagtatagtccatactcggtacctgagagtaggaaaaagaacccggtgatagagaagagagtaaaggttgagatgctaaaaggaaaagcagaagaagagaaaagtaagcatgagaagtcagtgagtgtgactagagccatgactctaaataacttgcagatgggtttccctcatgtctttcaggcaatggttgggttttcaagtgtgtgtatgcaagcctttgagtctgtgtacaaccaagctaagagcatcggtgaggatcaagaggaggttaagaggttgcttccttaaagagagaaagacaaattgttttaccatttgctctctgtttttgcttgatccaagctaatcttttggttgaatgttaggttgagtttatgctgttttcgaaatgaaattggttaaatgact

SEQ ID NO: 138 - DNA, 1131 bp, Arabidopsis thaliana
actcttaaacccaactgttgttctgttcttcaccttcttcccatctagggttattacgtaacttctctgttctctctcactctctctgttcttcatcacaccgagaattcgaaaattccgatgaacaagaaacttctcaaccctcttgaagatccaccaaccgcttcttcaagcgaagacgtcgacgaagagatttcatcaggagaagatgaaaaagaacatatctccaattcttcttcttctgaagaagaaaacgaactcaaagatctctccactcaaaccctaaattctccttccaccgaggctccaactctcgattctggatctgagacaaattccgactcagataagccaatcgtcttaaccagtcagaagaagaaagaaggtactgattcatcagggacgaagcgagctagtgaaggaactagctcaaaggacatcaaaagagctaagaaagtttcaggagatgacgataacaaaaaatttcagagtttatggactaaagaagatgagatctctctgttacaaggtatgattgatttcaaagctgagacaggtacaagtgctcatgatgatatgaatgggttttttgatattgctaagagatacataagctttgatgttagtaagatccaattcggtgacaagattagaggtttaaagaagaagtattttggtgtaaggaagaagaaaggtttagacttggatcatgataagaaatgtttgggattggctaagtctatttggggacttgatggtaaggaagtggtggttcttggaggagattcggagacgtcgaattggtttgagaagtcgtttttggttcgggttgttgcgaggcttggtgtggatgagtgtattgtgaagtggaaatggagtaaggtgtctaaggagactaagaagaggattgaagagaagatgaagatggtggaggctaaggaacttgagttgttgtcgcagaagatagatgttttgaaggaggtggcttctgtgattgctgaaactatctaagaagaaggacttggattgtttaggtttaatggagatgtaatgcctcttttgttatttatcgtaggatatatgtttctcatctatgtttctggttcttattagtcttctttttttgtttct

SEQ ID NO: 139 - DNA, 1365 bp, Arabidopsis thaliana
aaaatgtgaacgttgatacaataagaaagtcggtgaacaaaaaaaagataatataaaagcataatatagacaatataaaaattggttcgaccatcccaaacactacggaggacccaaaatatgagccaagagacagcgatagcaagcttcaagaaattccaacagtcatggatcgagcagctacgaaaccacctgaaccacctccgctccgcccaaaaccatcaccggaactctgctaccggtgatgaggaacggttaagggaggctgtggacagagtgatggaacactttagagaatatcacagggccaagtgggctgcgacggataaagacgtcatcgaagttatggcttctccttgggcttcagctcttgaacggtcgcttcagtgggtcggtggttggcgaccaaccaccttgttccatctggtttacactgagtcgagtattttatttgagtctcgtatcgttgatatacttcgtggctttcgcaccggtgatctcagtgatctctccccttctcagttcaggttctacacgaacccctaattagctactttgtttactaatcacaactactagtaaagatttttttatctaatttaataaaatatccttaagttacgttgtaatttgattgaagtaatatcgtgatttgcgcgtgttattgtttaccaaaactaatacaggttcactcctacacctagagatatcaaatatgtagattagtttagaacatacgatgtttatttgtttacttttcttaccaaaaatgttttagaaagtgaaaaacacatttgagggataacaataaatttgagagattaaaacacttattttactttcttttttttcaatgtgtaaacaataacatatggactaactaaacatattttgattacttaatatttaatatttagggttccatttgtcaaaggcaggacggtaagtgagctacaatgtgagaccgtgaaggaagagaatgcgataacggaagagttgtcggagtggcaagacgatgcgagtgaccttgtcatggggacatcgtcagatcccgaccagaggatccgacggctagcagaaatcgtccaccgaactgatgatctgcgactgagaacgatcacacgtgtggtggaggtcttgagtccgctccaacaagcggagtttcttgtcgctgcggctgagcttcgtacaggcgttgctggttgggggactagccacgaccgtcgtcgaagttccgaagtttaaagctaactaaaaccggtctaaaggtaatgagaatcgaggaagaaaaatagtttttggatattaattatatgtttttaccatgtttttggttatccagactgagtttggttttacatggtt

SEQ ID NO: 140 - protein, 555 aa, Arabidopsis thaliana
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 141 - protein, 376 aa, Arabidopsis thaliana
MTKKLNPLEDPPTATSSDEDDVETSEAGEASDDSSSSEEDVPIKIRIKSPSATTAAAPPAKSTAVSTAADSDSGSETETDSDSESTNPPNSGSGKTIALNTVNLKKKEDPTSSSATLALPAMKSGTKRPASEAAATTSTKRVKKDEESVKKPGGFQRLWSEEDEILVLQGMIDFKADTGKSPYVDTNAFYDFLKKSISFEVSKNQFMDKIRSLRKKYIGKEGRNEPSFVKAHDKKAFELSKFIWGPKGIALDSNVKSNGVSKKSVAKKKIDSVKQELVFAGGSSTNGKKVEEDGGDDGCDWFDNSSLVRMIASLGVDEYYVKQQWSLVSVESKKIVEEKYKLLQAKELEFVLEKTKFLNEVASMFVEASKNKPLDT

SEQ ID NO: 142 - protein, 256 aa, Arabidopsis thaliana
MSSSKHSSVFNYSALFLSLFLQQMDQNSLHHLDSPKIENEYEPDSLYDMLDKLPPLDSLLDMEDLKPNAGLHFQFHYNSFEDFFENIEVDNTIPSDIHLLTQEPYFSSDSSSSSPLAIQNDGLISNVKVEKVTVKKKRNLKKKRQDKLEMSEIKQFFDRPIMKAAKELNVGLTVLKKRCRELGIYRWPHRKLKSLNSLIKNLKNVGMEEEVKNLEEHRFLIEQEPDAELSDGTKKLRQACFKANYKRRKSLGDDYY

SEQ ID NO: 143 - protein, 279 aa, Arabidopsis thaliana
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERVLHRFVYIIYNI

SEQ ID NO: 144 - protein, 470 aa, Arabidopsis thaliana
LIKEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 145 - protein, 211 aa, Arabidopsis thaliana
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 146 - protein, 249 aa, Arabidopsis thaliana
MMSCGGKKPVSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDANNIHKPEEEVSGGQKYPLEPISSSHTDDTTVNGGDGDSKNSINVFGGEHGYEDFGFCYDDKFSSFLNSLINDVGDPFGNIIPISQPLQMDDCKDGIVGASSSSLGHD

SEQ ID NO: 147 - protein, 210 aa, Arabidopsis thaliana
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQVCVLPSLLITNPFLLSTINVHTPKFNPQLSTTHMFDHTVR

SEQ ID NO: 148 - protein, 261 aa, Arabidopsis thaliana
MANLSSDFQTFTMDDPIRQLAELSNTLHHFQTFPPPFSSSLDSLFFHNQFPDHFPGKSLENNFHQGIFFPSNIQNNEESSSQFDTKKRKSLMEAVSTSENSVSDQTLSTSSAQVSINGNISTKNNSSRRGKRSKNREEEKEREVVHVRARRGQATDSHSIAERVRRGKINERLKCLQDIVPGCYKTMGMATMLDEIINYVQSLQNQVEFLSMKLTAASSYYDFNSETDAVESMQKAKAREAVEMGQGRDGSSVFHSSSWTL

SEQ ID NO: 149 - protein, 320 aa, Arabidopsis thaliana
MYPSIEDDDDLLAALCFDQSNGVEDPYGYMQTNEDNIFQDFGSCGVNLMQPQQEQFDSFNGNLEQVCSSFRGGNNGVVYSSSIGSAQLDLAASFSGVLQQETHQVCGFRGQNDDSAVPHLQQQQGQVFSGVVEINSSSSVGAVKEEFEEECSGKRRRTGSCSKPGTKACREKLRREKLNDKFMDLSSVLEPGRTPKTDKSAILDDAIRVVNQLRGEAHELQETNQKLLEEIKSLKADKNELREEKLVLKAEKEKMEQQLKSMVVPSPGFMPSQHPAAFHSHKMAVAYPYGYYPPNMPMWSPLPPADRDTSRDLKNLPPVA

SEQ ID NO: 150 - protein, 529 aa, Arabidopsis thaliana
MELPQPRPFKTQGRKPTHDFLSLCSHSTVHPDPKPTPPPSSQGSHLKTHDFLQPLECVGAKEDVSRINSTTTASEKPPPPAPPPPLQHVLPGGIGTYTISPIPYFHHHHQRIPKPELSPPMMFNANERNVLDENSNSNCSSYAAASSGFTLWDESASGKKGQTRKENSVGERVNMRADVAATVGQWPVAERRSQSLTNNHMSGFSSLSSSQGSVLKSQSFMDMIRSAKGSSQEDDLDDEEDFIMKKESSSTSQSHRVDLRVKADVRGSPNDQKLNTPRSKHSATEQRRRSKINDRFQMLRQLIPNSDQKRDKASFLLEVIEYIQFLQEKADKYVTSYQGWNHEPAKLLNWQSNNNQQLVPEGVAFAPKLEEEKNNIPVSVLATAQGVVIDHPTTATTSPFPLSIQSNSFFSPVIAGNPVPQFHARVASSEAVEPSPSSRSQKEEEDEEVLEGNIRISSVYSQGLVKTLREALENSGVDLTKASISVEIELAKQSSSSSFKDHEVREPVSRTRNDNVKQTRKPKRLKTGQ

SEQ ID NO: 151 - protein, 256 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 152 - protein, 263 aa, Arabidopsis thaliana
METLHPFSHLPISDHRFVVQEMVSLHSSSSGSWTKEENKMFERALAIYAEDSPDRWFKVASMIPGKTVFDVMKQYSKLEEDVFDIEAGRVPIPGYPAASSPLGFDTDMCRKRPSGARGSDQDRKKGVPWTEEEHRRFLLGLLKYGKGDWRNISRNFVVSKTPTQVASHAQKYYQRQLSGAKDKRRPSIHDITTGNLLNANLNRSFSDHRDILPDLGFIDKDDTEEGVIFMGQNLSSENLFSPSPTSFEAAINFAGENVFSAGA

SEQ ID NO: 153 - protein, 324 aa, Arabidopsis thaliana
MDNIMQSSMPPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFRKPIPNQRPLGYEPWQNQLYHVESSNNYSSSVTMNTSHHIGASSSSHNLNQMLMSNNHYNPNNTSSSMHQYGNIELPQLDSPSLSPSLGTNKDQNESFEQEEEKSFNCVDWRTLDTLLETQVIHPHNPNILMFETQSYNPAPSFPSMHQSYNEVEANIHHSLGCFPDS

SEQ ID NO: 154 - protein, 315 aa, Arabidopsis thaliana
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 155 - protein, 344 aa, Arabidopsis thaliana
MYAMKEEDCLQTFHNLQDYQDQFHLHHHPQILPWSSTSLPSFDPLHFPSNPTRYSDPVHYFNRRASSSSSSFDYNDGFVSPPPSMDHPQNHLRILSEALGPIMRRGSSFGFDGEIMGKLSAQEVMDAKALAASKSHSEAERRRRERINTHLAKLRSILPNTTKTDKASLLAEVIQHMKELKRQTSQITDTYQVPTECDDLTVDSSYNDEEGNLVIRASFCCQDRTDLMHDVINALKSLRLRTLKAEIATVGGRVKNILFLSREYDDEEDHDSYRRNFDGDDVEDYDEERMMNNRVSSIEEALKAVIEKCVHNNDESNDNNNLEKSSSGGIKRQRTSKMVNRCYN

SEQ ID NO: 156 - protein, 244 aa, Arabidopsis thaliana
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 157 - protein, 121 aa, Arabidopsis thaliana
MCRGLNNEESRRSDGGGCRSLCTRPSVPVRCELCDGDASVFCEADSAFLCRKCDRWVHGANFLAWRHVRRVLCTSCQKLTRRCLVGDHDFHVVLPSVTTVGETTVENRSEQDNHEVPFVFL

SEQ ID NO: 158 - protein, 204 aa, Arabidopsis thaliana
MATEQEAEVGTETSSVSGRFLRNRDLYLFLPFLLGFSDQESSNGDDDDVASSRERIILVNPFTQGMIVLEGSSGMNPLLRSLLESREEGRPPASKASIDAMPIVEIDGCEGECVICLEEWKSEETVKEMPCKHRFHGGCIEKWLGFHGSCPVCRYEMPVDGDEIGKKRNDGNEIWVRFSFNDGRRIRDFSAQDGGNSDGVESEN

SEQ ID NO: 159 - protein, 788 aa, Arabidopsis thaliana
MEFDLNTEIAEVEEEENDDVGVGVGGGTRIDKGRLGISPSSSSSCSSGSSSSSSSTGSASSIYSELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDPSVSLPHLSIQSSPRPKRPWAGLLDTTPPGNPITKRGGFLDFEESVRPSKVLQGQENIGSASPSQGFDVMNRRILDFAMQSHANPVLVSSRVKDRFGEFVDATGVNPACSGVMDLDRFPRVLQGQEICSLKSFPQFAGFSPAAAPNPFAYQANKSSYYPLALHGIRSTHVPYQNPYNAGNQSSGPPSRAINFGEETRKFDAQNEGGLPNNVTADLPFKIDMMGKQKGSELNMNASSGCKLFGFSLPVETPASKPQSSSKRICTKVHKQGSQVGRAIDLSRLNGYDDLLMELERLFNMEGLLRDPEKGWRILYTDSENDMMVVGDDPWHDFCNVVWKIHLYTKEEVENANDDNKSCLEQAALMMEASKSSSVSQPDSSPTITRV

SEQ ID NO: 160 - protein, 553 aa, Arabidopsis thaliana
MVSHKVLEFGDDGYKLPAQARAPRSLRKKRIYEKKIPGDDKMCAIDLLATVAGSLLLESKSPVNACLVVQNTVKNEYPADENPVKAVPYSESPSLFDNGKCGFSSVITNPNHLLVGDKVGKEVEGFSSLGVSGDVKPDVVASIGSNSSTEVGACGNGSPNESRDDVNLFSRNDDDENFSGYIRTRMTRPVPRIGDRRIRKILASRHWKGGSKNNTDAKPWYCSKRSYYLHHHQRSYPIKKRKYFDSVYDSNSDDYRLQGKTHKGSRTISSMKSRNASFVSRDHHVKLRIKSFRVPELFVEIPETATVGSLKRMVMEAVTTILGDGLRVGLMVQGKKVRDDGKTLLQTGISEENNHLDSLGFSLEPSLETTPQPLLSSYLSDHACDDVTLCHDNALDSSHEPEPSPADSFGKLGTSDHSRALIPVASAAMLAPRPPNRKFKRTEQQLAAQRRIRRPFSVTEVEALVQAVEKLGTGRWRDVKVRAFEDADHRTYVDLKDKWKTLVHTARISPQQRRGEPVPQELLDRVLKAHAYWSQHLMHQLQTEPPSTQVEAL

SEQ ID NO: 161 - protein, 354 aa, Arabidopsis thaliana
MELLMCSGQAESGGSSSTESSSLSGGLRFGQKIYFEDGSGSRSKNRVNTVRKSSTTARCQVEGCRMDLSNVKAYYSRHKVCCIHSKSSKVIVSGLHQRFCQQCSRFHQLSEFDLEKRSCRRRLACHNERRRKPQPTTALFTSHYSRIAPSLYGNPNAAMIKSVLGDPTAWSTARSVMQRPGPWQINPVRETHPHMNVLSHGSSSFTTCPEMINNNSTDSSCALSLLSNSYPIHQQQLQTPTNTWRPSSGFDSMISFSDKVTMAQPPPISTHQPPISTHQQYLSQTWEVIAGEKSNSHYMSPVSQISEPADFQISNGTTMGGFELYLHQQVLKQYMEPENTRAYDSSPQHFNWSL

SEQ ID NO: 162 - protein, 175 aa, Arabidopsis thaliana
MEPTHRALPVGFRFRSTNCEISNYFLKKKALGQPMKARTIPEECHDIFSRHPHDLPGYPSEEHWYYFCRKRDNQVTSNSHNLWTPIGEETNVLDPKNNDALVGIKRRFTLIAQEEEESDNICLSDDEEALKYNWFMDEISLPQTVANTDWVLCHIFGKKTKPETTDLSTIDSESE

SEQ ID NO: 163 - protein, 303 aa, Arabidopsis thaliana
MNWLPEAEAEDDFKGLLSGDFFDDLINHLDVPLDDIDTTNGEGDWVDRFQDLEPPPMDMFPTLPSDLTSCGSGMAKAPRVDIQRNIPALKQSYSSEALSSTLHQSSAPPEIKVSKLFQSLSPVSVLENSYGSLSTHNNGSQRLAFPVKGMRSKRKRPTTLRLSYLFPSEPRKPEKSTPGKPESECYFSSEQHAKKKRKIHLTTRTVSSTLEASNSDGIVRKCTHCETTKTPQWREGPSGPKTLCNACGVRFRSGRLVPEYRPASSPTFIPAVHSNSHRKIIEMRRKDDEQFDSSMIRAVISRG

SEQ ID NO: 164 - protein, 429 aa, Arabidopsis thaliana
MEDQVGFGFRPNDEELVGHYLRNKIEGNTSRDVEVAISEVNICSYDPWNLRFQSKYKSRDAMWYFFSRRENNKGNRQSRTTVSGKWKLTGESVEVKDQWGFCSEGFRGKIGHKRVLVFLDGRYPDKTKSDWVIHEFHYDLLPEHQRTYVICRLEYKGDDADILSAYAIDPTPAFVPNMTSSAGSVVNQSRQRNSGSYNTYSEYDSANHGQQFNENSNIMQQQPLQGSFNPLLEYDFANHGGQWLSDYIDLQQQVPYLAPYENESEMIWKHVIEENFEFLVDERTSMQQHYSDHRPKKPVSGVLPDDSSDTETGSMIFEDTSSSTDSVGSSDEPGHTRIDDIPSLNIIEPLHNYKAQEQPKQQSKEKVISSQKSECEWKMAEDSIKIPPSTNTVKQSWIVLENAQWNYLKNMIIGVLLFISVISWIILVG

SEQ ID NO: 165 - protein, 419 aa, Arabidopsis thaliana
MDLKTLNQFSPLTKLTVPNHRDVQVRTDQLITYERSKRKSSLHDDEDLISKRRCLDFQRKIEDNECANDGVFVAPPRFKSGQVSIRQRSDAPLSSQAVKHDEFANDAFYKPWLDSFRLKRQRLGDDEDPSSSSSPSEVDIAALTLLQFSCDRRHPQTQTLTRPQPQTHKTQLQRPPPQLQSQTQTAPPKSDLFKCSICEKVFTSYQALGGHKASHSIKAAQLENAGADAGEKTRSKMLSPSGKIHKCDICHVLFPTGQALGGHKRRHYEGLLGGHKRGNDEAVLKLSPNSNKSVVTKVLDAEQSLRASDNIHKRNQDEVVPSRDKWSLSNVSVVKNVLDLKLSLGESDGGHKDSQDEVVVHEDKCSPSSNGSIVTNVSDPEQSVRRLIDLNNPPSLEFDQSRGGDVEEVESAMILAKQP

SEQ ID NO: 166 - protein, 493 aa, Arabidopsis thaliana
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTVEGILARAADELSALQEERKKVDPKTAEAIDQFLSKLRACAKAETSFTFILDDPAGNSFIENPHAPSPDPSLTIKFYERTPEQQATLGYVANPSQAGQSEGSLGAPSTKTAYVPNGTIGATAGHRAIAQSNSTDISDNLFRYSAPEEVMTFPSTCGACTEPCETRMFVTKIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 167 - protein, 461 aa, Arabidopsis thaliana
  misc_feature (139)..(139): Xaa can be any naturally occurring amino acid
METEDDLCNTNWGSSSSKSREPGSSDCGNSTFAGFTSQQKWEDASILDYEMGVEPGLQESIQANVDFLQGVRAQAWDPRTMLSNLSFMEQKIHQLQDLVHLLVGRGGQLQGRQDELAAQQQQLITTDLTSIIIQLISTXQSQNNNNCGAREFDLPKPVLVDEREGHVVEEHEMKDEDDVEEGENLPPGSYEILQLEKEEILAPHTHFCTICGKGFKRDANLRMHMRGHGDEYKTAAALAKPNKESVPGSEPMLIKRYSCPFLGCKRNKEHKKFQPLKTILCVKNHYKRTHCDKSFTCSRCHTKKFSVIADLKTHEKHCGKNKWLCSCGTTFSRKDKLFGHIALFQGHTPAIPLEETKPSASTSTQRGSSEGGNNNQGMVGFNLGSASNANQETTQPGMTDGRICFEESFSPMNFDTCNFGGFHEFPRLMFDDSESSFQMLIANACGFSPRNVGESVSDTSL

SEQ ID NO: 168 - protein, 283 aa, Arabidopsis thaliana
MSNITKKKCNGNEEGAEQRKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQKQARQLNIDSNSHKFIEVVRSFWFPRLINEIKDNSYTNNIKANAPDLLGPILRDSKDLGFNNMDCSTSMSEDLKKTSQFMDFSDLETTMSLEGSRGGSSQCVSEVYSSFPCLEEEYMVAVMGSSDISALHDCHVADSKYEDDVTQDLMWNMDDIWQFNEYAHFN

SEQ ID NO: 169 - protein, 414 aa, Arabidopsis thaliana
  misc_feature (91)..(91): Xaa can be any naturally occurring amino acid
  misc_feature (125)..(125): Xaa can be any naturally occurring amino acid
MSAVSESAAISSLFLISFAIQSSSSSSSSVLFFGLSLTAVLNALRFCSEQRLILEVPSISMGLRLKRTCSGVEVFGGFHEKQKIPFFIVRXNREIFFLKKTSSDLAVFDQRFLSGVFLVCSWCVXEDMKSFVKPERDSLLRTVRIVFTDPDATDDSSSSSDEWLPKPRKVKRFVHEITFLPQVSESSQDRSNAVKTPRRKSTRQFKYPVGVRPRPSGKFAAEILNPFTKTKKWLGTYETPAEAEKAYVDKKVEYDALASSGSAVSSSVVTVTSQCLRSPTSASVSCVSADDLSKEKTSLNKDVAASGDSTTKEVFTTFDFSDVKIPDLRFLAAEEDSMVSNANGAELDFDCFLTDSNILLDDYSLLENDINFSRFENSLPSELPDCDFTEMEFQLDDFKFAYTDHLTTPPLGLV

SEQ ID NO: 170 - protein, 419 aa, Arabidopsis thaliana
MAPLPFIPEQTRSQTRLSSDTKKKNRNKKTSQPPPQTQKIKQKTVPSTSSSSSWSQIKNLLSCKQIEGPRVHEPSKITSSSCGSSLCKFSDVIYGNARVIHRSDHSPESSNLGQDTRLLTRKPISTRGSSSSVRSNGCGAYTSYSTSKAMHFRNLSGCYECHMIVDPSRYPIAPRICACPQCGEVFPKLESLEHHQAVRHAVSELGPEDSGRNIVDIIFKSSWLRKDSPIYKIERILKVHNTQRTIQRFEDCRDAVKSHAHASTRKEARSAADGNELLRFHCTTVSCSLGSRGSTSICSAIPGCRVCTIIRHGFHAKTVRVGNGEGKEEIKGVRTTASSGRAHDALRCFDQRRAMLVCRVIAGRVRRVQSDVPEDESGSGSYDSVAGAAGVYTNLDDLVVYNPKAILPCFVVIYKVSEP

SEQ ID NO: 171 - protein, 106 aa, Arabidopsis thaliana
MDNTDRRRRRKQHKIALHDSEEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 172 - protein, 361 aa, Arabidopsis thaliana
MEVAIPMKELILKPAVIGLKTLSRYYMFCHNFGEETNFRFCQWILPLLCVLFFKVRKPYTVTKQREKWSEEEHDRFLEAIKLYGRGWRQIQEHIGTKTAVQIRSHAQKFFSKMAQEADSRSEGSVKAIVIPPPRPKRKPAHPYPRKSPVPYTQSPPPNLSAMEKGTKSPTSVLSSFGSEDQVNRCSSPNSCTSDIQSIGATSIDKKNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRARIC

SEQ ID NO: 173 - protein, 306 aa, Arabidopsis thaliana
MPSSDSTMMKKGTKRKIEIKKRETKEQRAVTCSKRRQTVFSKAADLCLISGANIAVFVTSPSDSSDVVYSFSGYSSAYEIADCYLNRKPPPKIVNPAGSKLGFWWEDPDLYHSCDDLSELSIIEDRLQRMKKHVMACLEKEEKSQLVSSFDQNPNSTCSLDVEDCDGSSYSQIASTFTPNSVNEYCSDQTFSSFHGDQNPNLSSPSFDQDCYSSLYQICGESSSQVASFDQNPSSEIQGFETEEEINQINLLLQETQTEANVNLDDEICFWNDLSNDDVFGLNSYFGLDNTNAMINFGDSDFRRHV

SEQ ID NO: 174 - protein, 332 aa, Arabidopsis thaliana
MAERKKRSSIQTNKPNKKPMKKKPFQLNHLPGLSEDLKTMRKLRFVVNDPYATDYSSSEEEERSQRRKRYVCEIDLPFAQAATQAESESSYCQESNNNGVSKTKISACSKKVLRSKASPVVGRSSTTVSKPVGVRQRKWGKWAAEIRHPITKVRTWLGTYETLEQAADAYATKKLEFDALAAATSAASSVLSNESGSMISASGSSIDLDKKLVDSTLDQQAGESKKASFDFDFADLQIPEMGCFIDDSFIPNACELDFLLTEENNNQMLDDYCGIDDLDIIGLECDGPSELPDYDFSDVEIDLGLIGTTIDKYAFVDHIATTTPTPLNIACP

SEQ ID NO: 175 - protein, 197 aa, Arabidopsis thaliana
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSGMS

SEQ ID NO: 176 - protein, 299 aa, Arabidopsis thaliana
MGAPKQKWTPEEEAALKAGVLKHGTGKWRTILSDTEFSLILKSRSNVDLKDKWRNISVTALWGSRKKAKLALKRTPPGTKQDDNNTALTIVALTNDDERAKPTSPGGSGGGSPRTCASKRSITSLDKIIFEAITNLRELRGSDRTSIFLYIEENFKTPPNMKRHVAVRLKHLSSNGTLVKIKHKYRFSSNFIPAGARQKAPQLFLEGNNKKDPTKPEENGANSLTKFRVDGELYMIKGMTAQEAAEAAARAVAEAEFAITEAEQAAKEAERAEAEAEAAQIFAKAAMKALKFRIRNHPW

SEQ ID NO: 177 - protein, 449 aa, Arabidopsis thaliana
MYIKAIMNRHRLLSAATDECNKKLGQACSSSLSPVHNFLNVQPEHRKTPFIRSQSPDSPGQLWPKNSSQSTFSRSSTFCTNLYLSSSSTSETQKHLGNSLPFLPDPSSYTHSASGVESARSPSIFTEDLGNQCDGGNSGSLLKDFLNLSGDACSDGDFHDFGCSNDSYCLSDQMELQFLSDELELAITDRAETPRLDEIYETPLASNPVTRLSPSQSCVPGAMSVDVVSSHPSPGSAANQKSRMRWTPELHESFVKAVIKLEGPEKATPKAVKKLMNVEGLTIYHVKSHLQKYRLAKYMPEKKEEKRTDNSEEKKLALSKSEADEKKKGAIQLTEALRMQMEVQKQLHEQLEVQRVLQLRIEEHAKYLEKMLEEQRKTGRWISSSSQTVLSPSDDSIPDSQNMSKTKASSPQPPLPAENKASETEDDKCESPQKRRRLENIAESEDPKR

SEQ ID NO: 178 - protein, 203 aa, Arabidopsis thaliana
MRKKVSSSGDEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFIDGHCF

SEQ ID NO: 179 - protein, 235 aa, Arabidopsis thaliana
MDASIVSSSTAFPYQDSLNQSIEDEERDVHNSSHELNLIDCIDDTTSIVNESTTSTEQKLFSCNYCQRTFYSSQALGGHQNAHKRERTLAKRGQRMAASASAFGHPYGFSPLPFHGQYNNHRSLGIQAHSISHKLSSYNGFGGHYGQINWSRLPFDQQPAIGKFPSMDNFHHHHHQMMMMAPSVNSRSNNIDSPSNTGRVLEGSPTLEQWHGDKGLLLSTSHHEEQQKLDLSLKL

SEQ ID NO: 180 - protein, 258 aa, Arabidopsis thaliana
MTEGGEYSPAMMSAEPFLTMKKMKKSNHNKNNQRRFSDEQIKSLEMMFESETRLEPRKKVQLARELGLQPRQVAIWFQNKRARWKSKQLETEYNILRQNYDNLASQFESLKKEKQALVSELQRLKEATQKKTQEEERQCSGDQAVVALSSTHHESENEENRRRKPEEVRPEMEMKDDKGHHGVMCDHHDYEDDDNGYSNNIKREYFGGFEEEPDHLMNIVEPADSCLTSSDDWRGFKSDTTTLLDQSSNNYPWRDFWS

SEQ ID NO: 181 - protein, 373 aa, Arabidopsis thaliana
MQKVFLAMDTCALVIHQSLSRIKLSPPKSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 182 - protein, 149 aa, Arabidopsis thaliana
MLDPTEKVIDSESMESKLTSVDAIEEHSSSSSNEAISNEKKSCAICGTSKTPLWRGGPAGPKSLCNACGIRNRKKRRTLISNRSEDKKKKSHNRNPKFGDSLKQRLMELGREVMMQRSTAENQRRNKLGEEEQAAVLLMALSYASSVYA

SEQ ID NO: 183 - protein, 430 aa, Arabidopsis thaliana
MCSVSELLDMENFQGDLTDVVRGIGGHVLSPETPPSNIWPLPLSHPTPSPSDLNINPFGDPFVSMDDPLLQELNSITNSGYFSTVGDNNNNIHNNNGFLVPKVFEEDHIKSQCSIFPRIRISHSNIIHDSSPCNSPAMSAHVVAAAAAASPRGIINVDTNSPRNCLLVDGTTFSSQIQISSPRNLGLKRRKSQAKKVVCIPAPAAMNSRSSGEVVPSDLWAWRKYGQKPIKGSPFPRGYYRCSSSKGCSARKQVERSRTDPNMLVITYTSEHNHPWPIQRNALAGSTRSSTSSSSNPNPSKPSTANVNSSSIGSQNTIYLPSSTTPPPTLSSSAIKDERGDDMELENVDDDDDNQIAPYRPELHDHQHQPDDFFADLEELEGDSLSMLLSHGCGGDGKDKTTASDGISNFFGWSGDNNYNNYDDQDSRSL

SEQ ID NO: 184 - protein, 341 aa, Arabidopsis thaliana
MEGGGRGPNQTILSEIEHMPEAPRQRISHHRRARSETFFSGESIDDLLLFDPSDIDFSSLDFLNAPPPPQQSQQQPQASPMSVDSEETSSNGVVPPNSLPPKPEARFGRHVRSFSVDSDFFDDLGVTEEKFIATSSGEKKKGNHHHSRSNSMDGEMSSASFNIESILASVSGKDSGKKNMGMGGDRLAELALLDPKRAKRILANRQSAARSKERKIRYTGELERKVQTLQNEATTLSAQVTMLQRGTSELNTENKHLKMRLQALEQQAELRDALNEALRDELNRLKVVAGEIPQGNGNSYNRAQFSSQQSAMNQFGNKTNQQMSTNGQPSLPSYMDFTKRG

SEQ ID NO: 185 - protein, 228 aa, Arabidopsis thaliana
MEPSIKGDQEMLKIKKQGHQDLELGLTLLSRGTATSSELNLIDSFKTSSSSTSHHQHQQEQLADPRVFSCNYCQRKFYSSQALGGHQNAHKRERTLAKRGQYYKMTLSSLPSSAFAFGHGSVSRFASMASLPLHGSVNNRSTLGIQAHSTIHKPSFLGRQTTSLSHVFKQSIHQKPTIGKMLPEKFHLEVAGNNNSNMVAAKLERIGHFKSNQEDHNQFKKIDLTLKL

SEQ ID NO: 186 - protein, 367 aa, Arabidopsis thaliana
MEDPSNPQPNQSNLSQCPPLATAPTPAPVRGPYHRRAHSEVQFRLPEDLDLSEPFGGFDELGSEDDLFCSYMDIEKLGSGSGSASDSAGPSAPRSDNPFSAENGGAEAGNSRPRHRHSLSVDGSSTLESIEAKKAMAPDKLAELWVVDPKRAKRIIANRQSAARSKERKARYILELERKVQTLQTEATTLSAQLSLFQRDTTGLSSENTELKLRLQVMEQQAKLRDALNEQLKKEVERLKFATGEVSPADAYNLGMAHMQYQQQPQQSFFQHHHQQQTDAQNLQQMTHQFHLFQPNNNQNQSSRTNPPTAHQLMHHATSNAPAQSHSYSEAMHEDHLGRLQGLDISSCGRGSNFGRSDTVSESSSTM

SEQ ID NO: 187 - protein, 179 aa, Arabidopsis thaliana
MSSENDFVEFSSMFERIIQGRGDGLSRFLPVIVALAAREDDDDQGSTDQTTRRGDPLSPRFVMIGSRSGLDDFFSDGGKQGRSPALKSEVENMPRVVIGEDKEKYGGSCAICLDEWSKGDVAAEMPCKHKFHSKCVEEWLGRHATCPMCRYEMPVEEVEEEKKIGIWIGFSINAGDRRN

SEQ ID NO: 188 - protein, 432 aa, Arabidopsis thaliana
MWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAIKFRGVEADINFNIDDYDDDLKQMTNLTKEEFVHVLRRQSTGFPRGSSKYRGVTLHKCGRWEARMGQFLGKKYVYLGLFDTEVEAARAYDKAAIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHHNQIFNSTSTPHQNWLQTNGFQPPLMRPS

SEQ ID NO: 189 - protein, 230 aa, Arabidopsis thaliana
MESISPVSNQLLQPTTTSSNSDRSRRKRKKKSSPSSVEKSPSPSISLEKWRSEKQQQIYSTKLVHALRELRISQQPSSSSSSSIPRGGRAVREVADRALAVAARGKTLWSRAILSKAVKLKFRKHKRQRISNPTTTTLTTGSIRSKKQRATVLRLKAKGLPAVQRKVKVLSRLVPGCRKQSLPVVLEETTDYIAAMEMQIRTMTAILSAVSSSPPPPTPGHEGGQTHMLG

SEQ ID NO: 190 - protein, 526 aa, Arabidopsis thaliana
MEATQKHMIQEGSSMFYHQPSSVKQMDLSVQTFDSYCTLESSSGTKSHPCLNNKNNSSSTTSFSSNESPISQANNNNLSRFNNHSPEENNNSPLSGSSATNTNETELSLMLKDLETAMMEPDVDNSYNNQGGFGQQHGVVSSAMYRSMEMISRGDLKGVLYECAKAVENYDLEMTDWLISQLQQMVSVSGEPVQRLGAYMLEGLVARLASSGSSIYKALRCKDPTGPELLTYMHILYEACPYFKFGYESANGAIAEAVKNESFVHIIDFQISQGGQWVSLIRALGARPGGPPNVRITGIDDPRSSFARQGGLELVGQRLGKLAEMCGVPFEFHGAALCCTEVEIEKLGVRNGEALAVNFPLVLHHMPDESVTVENHRDRLLRLVKHLSPNVVTLVEQEANTNTAPFLPRFVETMNHYLAVFESIDVKLARDHKERINVEQHCLAREVVNLIACEGVEREERHEPLGKWRSRFHMAGFKPYPLSSYVNATIKGLLESYSEKYTLEERDGALYLGWKNQPLITSCAWR

SEQ ID NO: 191 - protein, 405 aa, Arabidopsis thaliana
MPLPWKKSKSSRISRFVSDFQQSPKHGGSLVVETGFPTSLIDLFVKNRDRLKKQSSKRNNKNNKAQTETRVLSPPPPHMSLQRRMSLPSKLDPALVTEDSPLVRKIEETSVPEIIHEDDGGHRGGGGGGCVLIVVVFKVFMVAVLALSTKKLAVGITLSAFALLFLELAVARVFTYLNLCPDAQIRIDSLIDKLIGKRHKEKLEEEEESTSTHDRRNNVYFEIIEEPREEIRVTPQSDSSSLEKAKLVVDEKKEMQTIRDVMFKTEKSKSAKLKSKIVKKIVPKKLRSYKKKKKMKNKEKEEEEVELETEEEGSMTEVSSLYSDERIGSEISERDDLSSNPPFLESCTEVEEEEETGPKEDLTKVIGLIVIVLVGLLCGKVFAIGLTLSWCLILRVFCCKSQTSF

SEQ ID NO: 192 - protein, 221 aa, Arabidopsis thaliana
MDPYKNLNPKGYQRQRPFSSAGESGGSGGSGTAHETDDNKKKKKLLHRDIERQRRQEMATLFATLRTHLPLKYIKGKRAVSDHVNGAVNFIKDTEARIKELSARRDELSRETGQGYKSNPDPGKTGSDVGKSEPATVMVQPHVSGLEVVVSSNSSGPEALPLSKVLETIQEKGLEVMSSFTTRVNDRLMHTIQVEVNSFGCIDLLWLQQKLVEDLILSTGY

SEQ ID NO: 193 - protein, 392 aa, Arabidopsis thaliana
MATNRFFCEICNKGFQREQNLQLHKRGHNLPWKLKQKTNKNQVKKKVYICPEKSCVHHDPARALGDLTGIKKHFSRKHGEKKWKCDKCSKKYAVISDWKAHNKICGSREFRCDCGTLFSRKDSFISHRSFCDVLAEESSKFFSVPSPLAANSTIATVTDTNNPILIQSQLDQSSTGTADLNVNNNHTTLFGQKFTNSNPTQQQPNALALSSPPSPRSTSDSVHNLWKLQEEECAHQWLLNEYMNNNKNIFHKGIFKNQEDEIKKGNIYSGSNPTDGNIASLFSYNQEAVNMASFSATTLLQKVAQTGTPSSSETSTTMFGQMTSSIFNNTMLNSYCLTAKNNEEELTRDFLGVGSSEDQQRLHRHRFPSSVPLTANHDIPKLAATIVGRKQP

SEQ ID NO: 194 - protein, 313 aa, Arabidopsis thaliana
MISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 195 - protein, 244 aa, Arabidopsis thaliana
MVKQELKIQVTTSSSSLSHSSSSSSSSTSALRHQSCKNKIKKYKGVRMRSWGSWVTEIRAPNQKTRIWLGSYSTAEAAARAYDAALLCLKGPKANLNFPNITTTSPFLMNIDEKTLLSPKSIQKVAAQAANSSSDHFTPPSDENDHDHDDGLDHHPSASSSAASSPPDDDHHNDDDGDLVSLMESFVDYNEHVSLMDPSLYEFGHNEIFFTNGDPFDYSPQLHSSEATMDDFYDDVDIPLWSFS

SEQ ID NO: 196 - protein, 394 aa, Arabidopsis thaliana
MYYQNQHQGKNILSSSRMHITSERHPFLRGNSPGDSGLILSTDAKPRLKWTPDLHERFIEAVNQLGGADKATPKTIMKVMGIPGLTLYHLKSHLQKYRLSKNLNGQANNSFNKIGIMTMMEEKTPDADEIQSENLSIGPQPNKNSPIGEALQMQIEVQRRLHEQLEVQRHLQLRIEAQGKYLQSVLEKAQETLGRQNLGAAGIEAAKVQLSELVSKVSAEYPNSSFLEPKELQNLCSQQMQTNYPPDCSLESCLTSSEGTQKNSKMLENNRLGLRTYIGDSTSEQKEIMEEPLFQRMELTWTEGLRGNPYLSTMVSEAEQRISYSERSPGRLSIGVGLHGHKSQHQQGNNEDHKLETRNRKGMDSTTELDLNTHVENYCTTRTKQFDLNGFSWN

SEQ ID NO: 197 - protein, 166 aa, Arabidopsis thaliana
MGFPVGYSELLLPKIFFYLLSFLGLIRKLISTMFKIIGLPDFLEPEPVSTSWPDPPPTLTKPDSAAILAGEMLPVVRFSDINRPESECCAVCLYDFENDDEIRRLTNCRHIFHRGCLDRWMMGYNQMTCPLCRTQFIPDHLQLEFNQRLWSQSSAVSSQLLDESSS

SEQ ID NO: 198 - protein, 271 aa, Arabidopsis thaliana
MGRTTWFDVDGLRKGEWTAEEDRKLVVYINEHGLGEWGSLPKRAGLQRCGKSCRLRWLNYLRPGIKRGKFTPQEEEEIIKYHALLGNRWAAIAKQMPNRTDNDIKNHWNSCLKKRLAKKGIDPMTHEPTTTTSLTVDVTSSSTTSSPTPSPTSSSFSSCSSTGSARFLNKLAAGISSRKHGLESIKTVILAEQPREAVDEEKMMTINMKEKELISCYMEIDETMSIDELPCDDSTSGFVAFDDYSLIDPYRDGVYVSDFYDETEHLDLFLL

SEQ ID NO: 199 - protein, 342 aa, Arabidopsis thaliana
MNSFSHVPPGFRFHPTDEELVDYYLRKKVASKRIEIDFIKDIDLYKIEPWDLQELCKIGHEEQSDWYFFSHKDKKYPTGTRTNRATKAGFWKATGRDKAIYLRHSLIGMRKTLVFYKGRAPNGQKSDWIMHEYRLETDENGTPQEEGWVVCRVFKKRLAAVRRMGDYDSSPSHWYDDQLSFMASELETNGQRRILPNHHQQQQHEHQQHMPYGLNASAYALNNPNLQCKQELELHYNHLQSNIAHEEQLNQGNQNFSSLYMNSGNEQVMDQVTDWRVLDKFVASQLSNEEAATASASIQNNAKDTSNAEYQVDEEKDPKRASDMGEEYTASTSSSCQIDLWK

SEQ ID NO: 200 - protein, 410 aa, Arabidopsis thaliana
MTKTRILNPTRFPSPKPLRGCGDANFMEQLLLHCATAIDSNDAALTHQILWVLNNIAPPDGDSTQRLTSAFLRALLSRAVSKTPTLSSTISFLPQADELHRFSVVELAAFVDLTPWHRFGFIAANAAILTAVEGYSTVHIVDLSLTHCMQIPTLIDAMASRLNKPPPLLKLTVVSSSDHFPPFINISYEELGSKLVNFATTRNITMEFTIVPSTYSDGFSSLLQQLRIYPSSFNEALVVNCHMMLRYIPEEPLTSSSSSLRTVFLKQLRSLNPRIVTLIEEDVDLTSENLVNRLKSAFNYFWIPFDTTDTFMSEQRRWYEAEISWKIENVVAKEGAERVERTETKRRWIERMREAEFGGVRVKEDAVADVKAMLEEHAVGWGMKKEDDDESLVLTWKGHSVVFATVWVPI

SEQ ID NO: 201 - protein, 300 aa, Arabidopsis thaliana
MSSIPNRFNIYGGDTTNHRESLPIEMNHNSRMVRSMFITSDRMNHRDLFSSPPSFSSYQNSHISSSSVGFNNSHMTYHMLKRNYDSVSRADYFSTKDHSHFTQVSFTQTITNKYTTIVPSNIFDTVHYDIGRVKRAIDFRNIWNPKSHLPKKFNRQCEILNPTPLNIVFPHQDSADRQHLDIIFSSSKHNHVFQDGRSLKKISEPTNLFEKSNSYDSQEDEKIDAYQYDGRTHSLPYTKYGPYTCPRCNGVFDTSQKFAAHMLSHYNNETDKERDQRFRARNKKRYRKFMDSLKISKQKI

SEQ ID NO: 202 - protein, 390 aa, Arabidopsis thaliana
MSDKDEFAAKKKDLVNTPVDLYPPENPMLGPSPMMDSFRETLWHDGGFNVHTDADTSFRGNNNIDIPLEMGWNMAQFPADSGFIERAAKFSFFGCGEMMMNQQQSSLGVPDSTGLFLQDTQIPSGSKLDNGPLTDASKLVKERSINNVSEDSQSSGGNGHDDAKCGQTSSKGFSSKKRKRIGKDCEEEEDKKQKDEQSPTSNANKTNSEKQPSDSLKDGYIHMRARRGQATNSHSLAERVRREKISERMKFLQDLVPGCDKVTGKAVMLDEIINYVQSLQCQIEFLSMKLSAVNPVLDFNLESLLAKDALQSSAPTFPHNMSMLYPPVSYLSQTGFMQPNISSMSLLSGGLKRQETHGYESDHHNLVHMNHETGTAPDHEDTTADMKVEP

SEQ ID NO: 203 - protein, 282 aa, Arabidopsis thaliana
MDDHVEHNYNTSLEEVHFKSLSDCLQSSLVMDYNSLEKVFKFSPYSSPFQSVSPSVNNPYLNLTSNSPVVSSSSNEGEPKENTNDKSDQMEDNEGDLHGVGESSKQLTKQGKKKGEKKEREVRVAFMTKSEIDHLEDGYRWRKYGQKAVKNSPYPRSYYRCTTQKCNVKKRVERSFQDPSIVITTYEGKHNHPIPSTLRGTVAAEHLLVHRGGGGSLLHSFPRHHQDFLMMKHSPANYQSVGSLSYEHGHGTSSYNFNNNQPVVDYGLLQDIVPSMFSKNES

SEQ ID NO: 204 - protein, 389 aa, Arabidopsis thaliana
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQVSDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 205 - protein, 358 aa, Arabidopsis thaliana
MADNKVNLSINGQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQKIDDCPKITLSSLPDDTEEEKGPTFHNTQNVTGLDHVLLYMDRTGSNICMPESQTTTQHQDDVLFMQLPSLETPKSESPVDQSFLTPSKLDFSPVQEKITERPVCSNWASLDRLVAWQLNNGHHNPCHRKSFDEEEENGDTMMQRWDLHWNNDDNVDLWSSFTESSSSLDPLLHLSV

SEQ ID NO: 206 - protein, 406 aa, Arabidopsis thaliana
  misc_feature (39)..(39): Xaa can be any naturally occurring amino acid
MKSLASAVGGKTARACDSCVKRRARWYCAADDAFLCHAXCDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 207 - protein, 249 aa, Arabidopsis thaliana
MFSNIDQTAVAALLRGQGCANSLKRLLENHKLSSDSTEPLIYTILNSFSLALSFVDPPSLLPHNESSLQNMTSHVLQRSSKKKYYGAEDLEYYRDESPTPRPDDGFTWRKYGQKTIKTSPYQRCYYRCTYAKDQNCNARKRVQMIQDNPPVYRTTYLGKHVCKAVAVHDDTYGSEMIKFDQVVSESVMPQLATIDEQAITMEDEAIDHIMNQECDINDFSVDDDPFWASQFPPFSSEDIMFFDNIANLD

SEQ ID NO: 208 - protein, 375 aa, Arabidopsis thaliana
MNQNSSVAEATLQLNSGEKPSPGSIPFISSGQHGNISTSATSSTSTSSGSALAVVKSAVKKPTKDRHTKVDGRGRRIRMPAMCAARVFQLTRELGHKSDGETIEWLLQQAEPAIIASTGTGTIPANFSTLNASLRSGGGSTLFSQASKSSSSPLSFHSTGMSLYEDNNGTNGSSVDPSRKLLNSAANAAVFGFHHQMYPPIMSTERNPNTLVKPYREDYFKEPSSAAEPSESSQKASQFQEQELAQGRGTANVVPQPMWAVAPGTTNGGSAFWMLPMSGSGGREQMQQQPGHQMWAFNPGNYPVGTGRVVTAPMGSMMLGGQQLGLGVAEGNMAAAMRGSRGDGLAMTLDQHQHQLQHQEPNQSQASENGGDDKK

SEQ ID NO: 209 - protein, 329 aa, Arabidopsis thaliana
MSSMPNKFNPHCDDNNRGFSSIQMNQNSQMVHSRFITSDHTNHGDLFSSSPSFSCFHNSHASSSSFGFQNSHVENHMMKRNIISDDNYFSITNNPHFTRVSFTQTITNKFTAIVPTNTLDAVQYDAQRVKRAMNPKTNIWNPIFSPPNTFDKQCEFLNPKPLNVIFPSQNSAYPQHLDMFSLSSKHNHDQRVLQDGRSMKKILKPTIFFEATTDYIESQENEKSNNDHNDGRTHSLPYEKYGPYTCPKCNGVFNTSQKFAAHMSSHYKNETSEEREQRIRAKNKRKFCKLNREINGEPQKTKQEDVANNSEKSDDKTFQHLVVVKEELV

SEQ ID NO: 210 - protein, 428 aa, Arabidopsis thaliana
MYEESSCFDPNSMVDNNGGFCAAETTFTVSHQFQPPLGSTTNSFDDDLKLPTMDEFSVFPSVISLPNSETQNQNISNNNHLINQMIQESNWGVSEDNSNFFMNTSHPNTTTTPIPDLLSLLHLPRCSMSLPSSDIMAGSCFTYDPLFHLNLPPQPPLIPSNDYSGYLLGIDTNTTTQRDESNVGDENNNAQFDSGIIEFSKEIRRKGRGKRKNKPFTTERERRCHLNERYEALKLLIPSPSKGDRASILQDGIDYINELRRRVSELKYLVERKRCGGRHKNNEVDDNNNNKNLDDHGNEDDDDDDENMEKKPESDVIDQCSSNNSLRCSWLQRKSKVTEVDVRIVDDEVTIKVVQKKKINCLLLVSKVLDQLQLDLHHVAGGQIGEHYSFLFNTKIYEGSTIYASAIANRVIEVVDKHYMASLPNSNY

SEQ ID NO: 211 - protein, 410 aa, Arabidopsis thaliana
MRSSSQNSENSKTCLSNNIKATTKNEEDKDEEDDEEGEEDEEERSGDQSPSSNSYEEESGSHHHDQNKKNGGSVRPYNRSKTPRLRWTPELHICFLQAVERLGGPDRATPKLVLQLMNVKGLSIAHVKSHLQMYRSKKTDEPNEGDQGFSFEHGAGYTYNLSQLPMLQSFDQRPSSSLGYGGGSWTDHRRQIYRSPWRGLTTRENTRTRQTMFSSQPGERYHGVSNSILNDKNKTISFRINSHEGVHDNNGVAGAVPRIHRSFLEGMKTFNKSWGQSLSSNLKSSTATIPQDHIATTLNSYQWENAGVAEGSENVLKRKRLLFSDDCNKSDQDLDLSLSLKVPRTHDNLGECLLEDEVKEHDDHQDIKSLSLSLSSSGSSKLDRTIRKEDQTDHKKRKISVLASPLDLTL

SEQ ID NO: 212 - protein, 262 aa, Arabidopsis thaliana
MCGGAVISDYIAPEKIARSSGKSSWRSNGVFDCSIYDFDGNFDELESDEPFVFSSTHKHHASGSASDGKKKQSSRYKGIRRRPWGRWAAEIRDPIKGVRVWLGTFNTAEEAARAYDLEAKRIRGAKAKLNFPNESSGKRKAKAKTVQQVEENHEADLDVAVVSSAPSSSCLDFLWEENNPDTLLIDTQWLEDIIMGDANKKHEPNDSEEANNVDASLLSEELLAFENQTEYFSQMPFTEGNCDSSTSLSSLFDGGNDMGLWS

SEQ ID NO: 213 - protein, 287 aa, Arabidopsis thaliana
MNDPDNPDLSNDDSAWRELTLTAQDSDFFDRDTSNILSDFGWNLHHSSDHPHSLRFDSDLTQTTGVKPTTVTSSCSSSAAVSVAVTSTNNNPSATSSSSEDPAENSTASAEKTPPPETPVKEKKKAQKRIRQPRFAFMTKSDVDNLEDGYRWRKYGQKAVKNSPFPRSYYRCTNSRCTVKKRVERSSDDPSIVITTYEGQHCHQTIGFPRGGILTAHDPHSFTSHHHLPPPLPNPYYYQELLHQLHRDNNAPSPRLPRPTTEDTPAVSTPSEEGLLGDIVPQTMRNP

SEQ ID NO: 214 - protein, 215 aa, Arabidopsis thaliana
MELNLSTPTSCSSSSISSSSHEAIPRTKGKTKEEVTAEPSKENQQRLEFRFLFNESSTRNEAKARVFACTFCKKEFSTSQALGGHQNAHKQERSLAKRRKEIEINYPELSIYSQYPPSGLSFSSSSSQYDLGVRYNPNIAKTTKPYPFNIFACRFGYRGGLNFPPMSHLSVPKTDDLSINLISNLEGSIHDQAVKKDQPEADPCKDSDIDLSLKL

SEQ ID NO: 215 - protein, 193 aa, Arabidopsis thaliana
MDISAQRFAMNGRSMRLPPGFRFDPDDEDLVFEYLAKKVLHRPMDFDLPELRSCNVDPWDLLGEKNKEVYYFVKKEERERKGRETLSGYWEECEEEEVMEAGGRDCIHLEGRRKTFAFFIGKKPRGTITPWIMYEFRLLSSRATRWSSSPLPRGEVGKWRAVKVVVKEENDEEMVEDEHESDESDGEEVIQSR

SEQ ID NO: 216 - protein, 246 aa, Arabidopsis thaliana
MAPVGLPPGFRFHPTDEELVNYYLKRKINGQEIELDIIPEVDLYKCEPWDLAEKSFLPSRDPEWYFFGPRDRKYPNGFRTNRATRGGYWKSTGKDRRVTSQSRAIGMKKTLVYYKGRAPQGIRTDWVMHEYRLDDKDCDDPSSLQDSYALCRVFKKNGICSELESERQLQTGQCSFTTASMEEINSNNNNNYNNDYETMSPEVGVSSACVEEVVDDKDDSWMQFITDDAWDTSSNGAAMGHGQGVY

SEQ ID NO: 217 - protein, 461 aa, Arabidopsis thaliana
MAVEDDVSLIRTTTLVAPTRPTITVPHRPPAIETAAYFFGGGDGLSLSPGPLSFVSSLFVDNFPDVLTPDNQRTTSFTQLLNGTMSVSPGGGGRSTAGMFAGGGPMFTIPSGFSPSSLLTSPMFFPPQSSAHTGFIQPRQQSQPQPQRPDTFPHHMPPSTSVAVHGRQSLDVSQVDQRARNHYNNPGNNNNNRSYNVVNVDKPADDGYNWRKYGQKPIKGCEYPRSYYKCTHVNCPVKKKVERSSDGQITQIIYKGQHDHERPQNRRGGGGRDSTEVGGAGQMMESSDDSGYRKDHDDDDDDDEDDEDLPASKIRRIDGVSTTHRTVTEPKIIVQTKSEVDLLDDGYRWRKYGQKVVKGNPHPRSYYKCTTPNCTVRKHVERASTDAKAVITTYEGKHNHDVPAARNGTAAATAAAVGPSDHHRMRSMSGNNMQQHMSFGNNNNTGQSPVLLRLKEEKITI

SEQ ID NO: 218 - protein, 432 aa, Arabidopsis thaliana
MASSSELSLDCKPQSYSMLLKSFGDNFQSDPTTHKLEDLLSRLEQERLKIDAFKRELPLCMQLLNNAVEVYKQQLEAYRANSNNNNQSVGTRPVLEEFIPLRNQPEKTNNKGSNWMTTAQLWSQSETKPKNIDSTTDQSLPKDEINSSPKLGHFDAKQRNGSGAFLPFSKEQSLPELALSTEVKRVSPTNEHTNGQDGNDESMINNDNNYNNNNNNNSNSNGVSSTTSQSNRKARRCWSPDLHRRFVQALQMLGGSQVATPKQIRELMKVDGLTNDEVKSHLQKYRLHTRRPSPSPQTSGGPGPHLVVLGGIWVPPEYTSAHGGTPTLYHHQVHHHHTNTAGPPPPHFCSSQEFYTTPPPPQPLHHHHFQTFNGSSGGTASTDSTHHQVTDSPTVEGKSPESGGGERKGLAALREECEDHSNINGSEITLKF

SEQ ID NO: 219 - protein, 243 aa, Glycine max
MGRGKVQLKRIENKINRQVTFSKRRSGLLKKAHEISVLCDAEVALIVFSHKGKLFEYATDSCMEKILERHERYAYAERQLVANDSETQGNWTIEYTRLKAKIDLLQRNHRHYMGEDLASMSLKELQSLEQQLDTAIKNIRTRRNDLMYASISELQKKEKMIQEQNNILAKKIKEKEQAVAQQAAQWEQPNYRVDTSFMPQQQPLRTSLNIGGNNYNQEAAPELGRNGLDLTLEPLYSCHLGCF

SEQ ID NO: 220 - protein, 305 aa, Glycine max
MMAVARKEMDRIKGPWSPEEDEALQKLVERHGPRNWSLISRSIPGRSGKSCRLRWCNQLSPQVEHRAFTPEEDETIIRAHARFGNKWATIARLLSGRTDNAIKNHWNSTLKRKCASFMTADEAAGGGFSPRPLKRSFSAGTAVPPPGSPSGSDVSESSAAPGVVSVSVSVSPSQVFRPVPVRPVVETASSQDDADAEDAGPTTSLSLSLPGVESSEISNRTSTVPVMPVNTVAVAAPVPLPAPEVGLGALNLNAEFMAVMHEMIRKEVRSYMEQQNGMMCFQGMEMMEGFRNVSVKRIGISRVDS

SEQ ID NO: 221 - protein, 372 aa, Glycine max
MKGVTVKVEETMAYANAASTSPTTSSNLSPQPMEGLHEVGPPPFLTKTFDVVEDPSTNDIVSWSRSRNSFVVWDSHKFSTTILPRYFKHNNFSSFVRQLNTYGFRKIDPDKWEFANEGFLAGQRQLLKTIKRRRHVTVTQTQSHEGGSGACVELGEFGLEGEMERLRRDRTVLMAEIVRLRQQQHNSREQLLSMETRLQATEKKHQQMMNFLAKALNNQAFIQQFLQRNAQNKELQGARRKRRLTATPSVENLQQDHFALSIEEGSATIESQMESFFSAACNDPLESNSELKDPILSSVPVASGSNLGEVSDSVWEDLLNQDLVAGDPEEEVVIGDFSQVDVPVEDLIADADEWSEDLQNLVDHMGYLGSKP

SEQ ID NO: 222 - protein, 312 aa, Glycine max
MGTAIDMYNSSNIVADFLDPYSEELMKALKPFMKSDYFSASSSSSLESQPCSFSSNSLPTSYPSSNQIKLNQLTPDQIVQIQAQIHIQQQQQHVAQTQTHLGPKRVPMKHAGTAAKPTKLYRGVRQRHWGKWVAEIRLPKNRTRLWLGTFDTAEEAALAYDNAAFKLRGEFARLNFPHLRHHGAFVFGEFGDYKPLPSSVDSKLQAICESLAKQEEKPCCSVEDVKPVIHAAELAEVESDVAKSNAEYVYPEFEDFKVEHENPMFSGESSSPESSVTFLDFSDFSDSNNQWDEMENFGLEKFPSVEIDWEAI

SEQ ID NO: 223 - protein, 275 aa, Glycine max
MVRAPCCEKMGLKKGPWAPEEDQILTSYIDKHGHGNWRALPKQAGLLRCGKSCRLRWINYLRPDIKRGNFTIEEEETIIKLHDMLGNRWSAIAAKLPGRTDNEIKNVWHTNLKKRLLKSDQSKSKPSSKRAIKPKIERSDSNSSIITQSEPDNFNFREMDTITSSACTTSSSDFSSVTVGDSKNIKSEDTESTETMPVIDESFWSEAAIDDETPTMSSSQSLTISNEMRLQYPFANYEETFQQGHHAYDSNFDDGMDFWYDIFTRTNDSIELLEF

SEQ ID NO: 224 - protein, 384 aa, Glycine max
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATATAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 225 - protein, 358 aa, Glycine max
RQRLQLQKVQLSNLVSGDTEHQEESAMADASPRTDISTDVDTDDKNPRFDRSQSLVAVVSDSSDRSKDKSDQKTLRRLAQNREAARKSRLRKKAYVQQLESSRLKLTQLEQELQRARQQGIIISNSGDQAHSMSGNGAMAFDVEYARWLEEQNRQVNELRAAVNSHAGDTELRMIIDGIMAHYDEIFRLKADAAKADVFHLLSGMWKTPAERCFLWLGGFRSSELLKLLVNQLEPLTEQQLVGITNLQQSSQQAEDALSQGMEALQQSLSETLSTGSLGSSGSSGNVANYMGQMAMAMGKLGTLEGFIKQADNLRQQTLQQIHRILTTRQSARALLAIHDYFSRLRALSSLWLARPRD

SEQ ID NO: 226 - protein, 328 aa, Glycine max
MALEAVVFPQSQDPFGGSGYGSVNNKDFYNCTLLAATSPNSWGDYEQHININKEEEQGGASISTFQPESNYPYGNWTSSSSSMLPHFNNELQETTTTDPSNTLDSLNTRPKRRRAKSRKNKEEIENQRMTHIAVERNRRKQMNEYLSVLRSLMPDSYIQRGDQASIIGGAINFVKELEQRMHFLGAQKEGEGKSEAGGATNMPFSEFFTFPQYSTSGGGGCSDNSAAVGEDVGEVKCGIADIEVTMVESHANLKIRSKKRPKQLLKLVSGLHTMRLTILHLNVTTTGEVVLYSLSVKVEDDCKLGSVDDIAAAVYQMLDKIQQEAMLN

SEQ ID NO: 227 - protein, 268 aa, Glycine max
MAAATQLHLPPGFRFHPTDEELVVHYLCRKCASQEIAVPIIAEIDLYKYDPWDLPGMALYGEKEWYFFTPRDRKYPNGSRPNRSAGTGYWKATGADKPVGKPKPVGIKKALVFYAGKAPKGVKTNWIMHEYRLADVDRSVRKKNSLRLDDWVLCRIYNKKGAIEKQQPAPPPPSGVHKIECYEMEDVKPEYTAADCLYFEASDSVPRLHTTESSCSEQVVSAEFASEVQSERKRQGNSEFSYNYMDATLGNNQMSPLQDIFMYLSRPF

SEQ ID NO: 228 - protein, 336 aa, Glycine max
MSSGATHWCYACRQPIVLDGRDPVCPYCDGGFVQELDELRGIAPNHNHTFSSQSGDFHQMPDIFDAIHAFMGQRGSDQRFGLMDAVDNFMRHRMAGRNSNFDVRGRSGSLPVPEQSWGVYSSGPYLIFHGQVPGFTLSAGSPRGGPRRVDFGDYFMGPGLEELIEQLTMNDQRGPAPAARSSIDAMPTIKITQAHLRSDSHCPVCKEKFELGTEAREMPCNHIYHSDCIVPWLVQHNSCPVCRVELPPQGQASSRGTRSWGGRNASNSSSSGSNDSSRGRENSHQNHGRRNPFSFLWPFRSSNSNNNHYSETGGSSSSTTPDQNNGTSYSGWPFDR

SEQ ID NO: 229 - protein, 285 aa, Glycine max
MLQQRSVPAPFLTKTYQLVEDPGTDEVISWGESGNTFVVWKHADFAKDLLPKYFKHNNFSSFVRQLNTYGFRKIVPDKWEFANEHFKRGQKELLSEIKRRKTVPQSSTHSPDAGKPGAEGNSPSNPGGCDDAGSTSTSSSSSGSKNQGSVETNTTPSHQLSSENEKLKKDNETLSCELARARKQCDELVAFLRDRLMVGPDQIDRIMRQGSCGSENAVGEGGGGGHCLKLFGVWLKGDTLTDKRNNHKRGREDQMGFGGPRLKESKPVVDFSRNRMMMINEKGKG

SEQ ID NO: 230 - protein, 340 aa, Glycine max
MEGTRAKEGTLPPGFRFHPTDEELVTCYLVNKISDSNFTGRAITDVDLNKCEPWELPGKAKMGEKEWYFFSLRDRKYPTGVRTNRATNTGYWKTTGKDKEIFNSETSELIGMKKTLVFYKGRAPRGEKSNWVMHEYRIHSKSSYRTNRQDEWVVCRVFKKSGGAKKYHSSNHARTVNPYSLEIGPSIMPPPMMQLGDPSAHFLYGRNYMNSAELAELARVLRGGGSTSSVNLPIQSQLSYPTSSSAGGGGFIISGLNLNLGGGATATTQPILRPMQPSPPVHTMAQVLDVNSSMMTTSSLGAENNVGYGTEVSNNMNSHGNRYMGMDHHCMDLDNYWPSY

SEQ ID NO: 231 - protein, 281 aa, Glycine max
MQEPSLGLMGEVSGDHHRQLKAEITTHPLYEQLLAAHVACLRVATPIDQLPLIDAQLSQSHHLLRSYVSHNTHSLSPHHRQELDNFLAQYLIVLCTFKEQLQQHVRVHAVEAVMACRDIENALQALTGVSLGEGTGATMSDDEDDLQMDISLDQSSAEGHDMMGFGPLLPTESERSLMERVRQELKIELRQGFKSRIEDVREEILRKRRAGKLPGDTTSVLKNWWQQHAKWPYPTEDDKAKLVEETGLQLKQINNWFINQRKRNWHSNSQSVTSLKSKRKR

SEQ ID NO: 232 - protein, 584 aa, Arabidopsis thaliana
MDMIKPDFQQIRRDKFRVEQMNDFPNTWTQQQHQNIRIPNNLDLIGILQNQISVPVQTDLYQDSAATFMNMPQSIHRDPQGPSNWRISDLSQPSTVNHGYDQAGIRPNNVADLLSDHFSSRNQILDRPLYVGRDSIPQSSMIRRSEVSCLDDNQKGCVTVACSGTGNEILRSSYDQGSSSGSYRGEFSFLPSLENQSVAHNASNWNHGPVNVTATSHTNSKKGFPLSLLSDIPPSRDVGNAAVLSTMNIHGPLGPFTGYASILKSSRFLEPAQKMLEEFCISYASKIISRSESTSMEDDDDDDDNLSGFSSSSEPLEPKNRLKKAKLLFLQEEVCKWYKLYNHQLQTVMSSFNTVAGLNTATPYISLALKRTSRSFKALRTAIAEHVKQISSHSSNGNNNNRFQKRQRSLIGNNVGFESQQQHIWRPQRGLPERAVAVLRAWLFDHFLHPYPTDSDKQMLATQTGLSRNQVSNWFINARVRLWKPMVEEIHTLETKAIKNADTSHNIEPSNRPNTVSSPSHEQTLTGLSGTKRSRLEYMDMVGFNRGNVSLTLELRRGVDNVIQTQTQDHQFGTGSQMFHDFVG

SEQ ID NO: 233 - protein, 339 aa, Arabidopsis thaliana
MFPSLDTNGYDLFDPFIPHQTTMFPSFITHIQSPNSHHHYSSPSFPFSSDFLESFDESFLINQFLLQQQDVAANVVESPWKFCKKLELKKKNEKCVDGSTSQEVQWRRTVKKRDRHSKICTAQGPRDRRMRLSLQIARKFFDLQDMLGFDKASKTIEWLFSKSKTSIKQLKERVAASEGGGKDEHLQVDEKEKDETLKLRVSKRRTKTMESSFKTKESRERARKRARERTMAKMKMRLFETSETISDPHQETREIKITNGVQLLEKENKEQEWSNTNDVHMVEYQMDSVSIIEKFLGLTSDSSSSSIFGDSEECYTSLSSVRGTISAAGNSNVLTKNPN

SEQ ID NO: 234 - protein, 321 aa, Arabidopsis thaliana
MEDNDAAYDQVKSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAKHFYTTSESLLRHELLPSYGYLSNTQEEDEFYLKTIMTSEGNDWPSYVTNNVYCLHPLELVDLQDVMFQSYGTCIFANGTCGESDKCDGGYWKILHGDKLIKSNFGMVTGFKKVFEFYETVIHRYFCDGEEVKVTWTIEEYRLSKNVKQNKLLCVIKFTDDK

SEQ ID NO: 235 - protein, 225 aa, Arabidopsis thaliana
MVSFCELCGAEADLHCAADSAFLCRSCDAKFHASNFLFARHFRRVICPNCKSLTQNFVSGPLLPWPPRTTCCSESSSSSCCSSLDCVSSSELSSTTRDVNRARGRENRVNAKAVAVTVADGIFVNWCGKLGLNRDLTNAVVSYASLALAVETRPRATKRVFLAAAFWFGVKNTTTWQNLKKVEDVTGVSAGMIRAVESKLARAMTQQLRRWRVDSEEGWAENDNV

SEQ ID NO: 236 - protein, 283 aa, Arabidopsis thaliana
MVGSFLPPGFRFYPTDEELVGYYLHRRNEGLEIELEIIPLMDLYKFDPWELPEKSFLPNRDMEWFFFCHRDRKYQNGSRINRATKSGYWKATGKDRKIVCHSSSSSSSSSITGCRKTLVFYMGRAPFGGRTEWVMHEYRLFDNDTSQGSLNFKGDFALCRVIKRNEHTLKKCEIISPEVSDESLSNNVNNFCQASDLEKGSCDASNTRLSSPDFILESSFQGNSHSKTEEDSGFQVFTLPEFEYPLEVFADLNFDLEMEDPFMFDYHPEPHMNNEVMSHHIRG

SEQ ID NO: 237 - protein, 130 aa, Arabidopsis thaliana
GKRSTSDQVKGAVNYIDYLQRNIKDINSKRDDLVLLSGRSFRSSNEQEWNEISNHVVIRPCLVGIEIVLSILQTPFSSVLQVLREHGLYVLGYICSSVNDRLIHTLQAEVQYLELTNFTAIEALLTLLRI

SEQ ID NO: 238 - protein, 401 aa, Arabidopsis thaliana
MDAISCMDESTTTESLSISLSPTSSSEKAKPSSMITSSEKVSLSPPPSNRLCRVGSGASAVVDPDGGGSGAEVESRKLPSSKYKGVVPQPNGRWGAQIYEKHQRVWLGTFNEEDEAARAYDIAAQRFRGKDAVTNFKPLAGADDDDGESEFLNSHSKPEIVDMLRKHTYNDELEQSKRSRGVVRRRGSAAAGTANSISGACFTKAREQLFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 239 - protein, 378 aa, Arabidopsis thaliana
MDGREAMAFPGSHSQFYLQRGVFTNLTPSQVASGLHAPPPPPGMRPMSNPNIHHPQASNPGPPFSMAEHRHSDFGHSIHMGMASPAAVQPTLQLPPPPSEQPMVKKKRGRPRKYVPDGQVSLGLSPMPCVSKKSKDSSSMSDPNAPKRARGRPPGTGRKQRLANLGEWMNTSAGLAFAPHVISVGSGEDIVSKVLSFSQKRPRALCIMSGTGTVSSVTLREPASTTPSLTFEGRFEILSLGGSYLVNEEGGSKSRTGGLSVSLSGPEGHVIGGGIGMLIAASLVQVVACSFVYGASAKSNNNNNKTIKQEIKPKQEPTNSEMETTPGSAPEAAASTGQHTPQNFPAQGMSGWPVSGSGSGRSLDSSRNPLTDIDLTRG

SEQ ID NO: 240 - protein, 358 aa, Glycine max
MQAMENIHQREILEEQRFELPPGFRFHPTDEELITHYLSQKVLDSCFCARAIGEADLNKCEPWDLPWMAKMGEKEWYFFCVRDRKYPTGQRTNRATGVGYWKATGKDREIYKAKALIGMKKTLVFYKGRAPSGEKTSWVMHEYRLEDEHSVHNPPKKAMNDWAICRIFQKSNGGKKMPISGLVRFSNFAKDMPSLMDSSPYNDSESKPVLGESSQPTCFSDPNQSEDQRTQDENIADSYETLMLASSYSSNPSDISPASWTFSKSAPTVSHQSLQVGNSHSSDYFMLHQEQSMLGMLIENHGASAGQRTQKAQDSKGSDADMSSVMYNNYEMFQRSFGNQEYSSPSVGHVYSSGLWGF

SEQ ID NO: 241 - protein, 216 aa, Glycine max
MAKTRPGRKDVDSYTIRGTNKIVRAGDCVLMRPSDTSKPPYVARVEMIEQDNRNNVKVRVGWYYRPEESIGGRRQFHGAKELFLSDHYDVQSAHTIEGKCVVHSFKNYTKLENVGAEDYYCRFEYKAASGAFTPDRVAVYCKCEMPYNPDDLMVQCEGCKDWYHPACMGMTIEEAKKLDHFVCSECSSDDDMKKPQATFSASPGADGKVEPKRRKR

SEQ ID NO: 242 - protein, 300 aa, Glycine max
MSRTCSQCGNNGHNSRTCTDGGAAGSPRENGIMLFGVRVMTEANSSFRKSASMNNLSQYDAEFNAADAGYASDDVVHASGRTRERKRGVPWTEEEHRLFLLGLHKVGKGDWRGISRNFVKTRTPTQVASHAQKYFLRRHNQNRRRRRSSLFDITTDTVMESSTIMEEEQVPPETVAAPLPAAYPPSHYGAFAGAGFPIAPVVLPVSGERLTKPIRPTPILPVPPSSKMANLNLKEKASPTNLIEPLPLSLNLPSPTPRSQDQSSASSGHSSPSSSSSAAAFQAMSAAKFGSGGDSIISVA

SEQ ID NO: 243 - protein, 244 aa, Glycine max
MGRGRVQLKQIENKISRQVTFSKRRTGLRKKANEISVLCDAQVALIVFNAKGKLFEYSSESSMENVLERYERHTHIGKLVGDGDESQGNWSLQCFKLTGKVEVLERNLRNFVGEDLDPLNLRELQSLEHQLETAIKRIRTRKNQVMNESISDLQKKARQLQEQNGILTKKIKEKGKEVVERPHCGPETLGLTCPPELQRQQRVFPSLTLCETLQAGHLEEVVEARTVPTASTHIPPWMLHPFTR

SEQ ID NO: 244 - protein, 560 aa, Glycine max
MAEVVKSEECCQENKQSTAASCSSVSEGSGSAIHKSPGRCSPASTSPSHRRTTGPIRRAKGGWTAQEDETLRNAVAVFKGKSWKKIAEFFPDRSEVQCLHRWQKVLNPELVKGPWTQEEDDKIVELVSKYGPTKWSLIAKSLPGRIGKQCRERWHNHLNPDIKKDAWTLEEELALMNAHRIHGNKWAEIAKVLHGRTDNAIKNHWNSSLKKKLDFYLATGRLPPIPKNSPQVPVKDTIRRSASKSMLGCSNKELNAAVETSSETTAISKLDDSGRNQFESSGTVREVGDSSSVPANDSADSDCVECKPGSSNINPSCSNSEHVSRANFGTTFGPISENSGLNGNSTFEHCTNNGDRSSTRLIGTSSQENPTCGSLCYEPPQLDGSVPIDSLYLNYTCQQNEYCPSPTMSPTGFFTPPRAKGSELCTETPESILRKAANTFPNTPSILRRRRTGAQTLTSPTKVLKVDNNPHTSNKTERTNDDSGSGHFSGSPASHGYGIGIPNNKAFNASPPYRLRSKRTAIVKSVEKQLEFAFDKEKNDDKRSNVMTEDRLHEKKLVVT

SEQ ID NO: 245 - protein, 176 aa, Glycine max
MATEEVNKLQSLPPYPEMIVKALEALNEADGSSKSAISKYIETTYGELPDETVLGSHLNKMKESGELAFKQNNYMKADPNAPPKRGRGRPPKPKVPLPPGTVVSPPRPRGRPPKDPNAPPKSPKAKATPATGRPRGRPKKVARSPAVPSPTAVSTGRPRGRPPKVKPQLTEVSVES

SEQ ID NO: 246 - protein, 278 aa, Glycine max
MANAAEVSALKRIKLHLLGELSPLATPQNKFDQTNPSPSESSNSESSSISLNHYFTDLLEPEIEFPLFEFDSKPQVIDLETPKTLISAEKKPQFNRKPSLLIAVPKKTEWIQFGNPEVAAPENQPEKKHYRGVRQRPWGKFAAEIRDPNKRGSRVWLGTFDTAIEAAKAYDRAAFRLRGSKAILNFPLEVNTAAETVSVAAVDVERKRRREEEEVVVEDVKAVVKKEKITEHDVSCFRGMPLTPSMWTGFWDSDVKDIFNIPPLSPLSPFGFSPLVAV

SEQ ID NO: 247 - protein, 356 aa, Glycine max
MTRRCSHCSNNGHNSRTCPSRGGGGVKLFGVRLTDGSIIKKSASMGNLNLSSAAAHHQFHSSPSSSNLAAAPSSPNPSSPCSDPPQGYLSDDPAHVSTFANRRGDRKKGVPWTEEEHRLFLIGLQKLGKGDWRGIARNFVVSRTPTQVASHAQKYFIRQSHATRRKRRSSLFDMVPDMSSDQPSVPEEQVLLPPSQNSQPCNGKSQPSLNLSLKSEFEPMETTSQENAQQTNETMMGSIGLTPMAPHGFFPAYLPVPFPMWPSTVAPPFEEVKGGETSHHQIHKPIPVIPKEPVNVDELVGMSHLSIGEAKVRDREPSPLSLKLLGEPSRQSAFHANAPVGTSDLNNGKDNAIQAV

SEQ ID NO: 248 - protein, 450 aa, Arabidopsis thaliana
  misc_feature (208)..(208): Xaa can be any naturally occurring amino acid
MDLRLQQAAESGSINELYALIDENPYILENIDAVPFVSTPLHVAAVFGNIEFAMEMLNLKPSFARKLNTSGYSPLHLAVEKEQSDFVSHMLWHDGGLSRVKGRNGVTPFHLLVIRGDDDLVAECLITSPECIEDVNVDRQNALHLAVMNDRFEVLQVLTGWIQRMSQKDAYYIENRVLNKRDFDFNTALHLAAYKNDQQASFTFFEIXALKLLLKCRLVEPNLVNIDDLTFVDILRTQGENAGGGNLDLEQAVIKTGCVEAASMPKFKEESDLLKSPINFMTYYSTSMKRMKSSTSDQDRGAFLIVCTLIITATYQMALQPPGGVHQSENANANAGSVVMKQTFFILLWISNTVGFCCAVFYTFCLIPLGQLFTIWFFYIGTCLCISYALAMAVISPHPLVFLSATFALFLVFALYLLLEAFVDTWRKHRTVVPKSRFSWFWKVLQYYYI

SEQ ID NO: 249 - protein, 909 aa, Arabidopsis thaliana
MEDDGGSDGGEGNGGFSPNSSFGAFADTAMDLDFMDELLFDGCWLETTDSKSLKQTEQSPSASTAMNDNSPFLCFGENPSQDNFSNEETERMFPQAEKFLLEEAEVGKSWWIAPSASEGPSSSVKERLLQAISGLNEAVQDKDFLVQIWVPIQQEGKSFLTTWAQPHLFNQEYSSLAEYRHVSETYNFPADEGMKDFVGLPGRVFLQKFPEWTPDVRFFRRDEYPRIKEAQKCDVRGSLALPVFERGSGTCLGVVEIVTTTQKMNYRQELEKMCKALEAVDLRSSSNLNTPSSEFLQVYSDFYCAALPEIKDFLATICRSYDFPLALSWAPCARQGKVGSRHSDENFSECVSTIDSACSVPDEQSKSFWEACSEHHLLQGEGIVGKAFEATKLFFVPEVATFSKTNYPLAHHAKISGLHAALAVPLKSKSGLVEFVLEFFFPKACLDTEAQQEMLKSLCVTLQQDFRSSNLFIKDLELEVVLPVRETMLFSENLLCGAETVESLTEIQMQESSWIAHMIKANEKGKDVSLSWEYQKEDPKELSSGRENSQLDPVPNNVPLEAEQLQQASTPGLRVDIGPSTESASTGGGNMLSSRRPGEKKRAKTEKTIGLEVLRQYFAGSLKDAAKSIGVCPTTLKRICRQHGIMRWPSRKIKKVGHSLKKLQLVMDSVQGAQGSIQLDSFYTSFPELNSPNMSSNGPSLKSNEQPSHLNAQTDNGIMAEENPRSPSSSCSKSSGSSNNNENTGNILVAEDADAVLKRAHSEAQLHNVNQEETKCLARTQSHKTFKEPLVLDNSSPLTGSSNTSLRARGAIKVKATFGEARIRFTLLPSWGFAELKQEIARRFNIDDISWFDLKYLDDDKEWVLLTCEADLVECIDIYRLTQTHTIKISLNEASQVKLSGSFGNTGLS

SEQ ID NO: 250 - protein, 250 aa, Arabidopsis thaliana
MEGGAALYNPRTVEEVFKDFKGRRTAIVKALTTDVQEFYQQCDPEKENLCLYGLPNEEWEVNLPAEEVPPELPEPALGINFARDGLSEKEWLSLVAIHSDAWLLSVSFYFGSRFSFHKEERKRLFNMINDVPTIFEVVTGMAKAKDKSSAANQNGNKSKSNSKVRTSEGKSSKTKQPKEEDEEIDEDDEDDHGETLCGACGDSDGADEFWICCDLCEKWFHGKCVKITPARAEHIKQYKCPSCSNKRARA

SEQ ID NO: 251 - protein, 351 aa, Glycine max
MAEDWDLHAVVRGCSTVTSSSVSSSSSPSSSGFASSYFHPEAAVSSSSSSYSGFNIFKGEQGISQVLSLSAYPFEARSSIEELHELCKPFFSKSQPLTLQASSPLSSLSSYSSAPPKSVSTQEKQQQRSKQAHAVTTPRSKRRKNQLKKVCQVPVENLSSDIWAWRKYGQKPIKGSPYPRGYYRCSSSKGCLARKQVERNRSDPTMFIVTYTAEHNHPAPTHRNSLAGSTRQKPLVPQTATTTEEDSDKSKSLTKPTSPATSGAEEEAPTPSQGEKSESREEKEDVMDDEEEDEFGLSDMVLSDDFFESLDELSQLTAPSVVTGDCFSDPFSAIAIPSWVASGAATASGCR

SEQ ID NO: 252 - protein, 367 aa, Glycine max
MSKPLLGIGEEEGQSNVTLLVSSSVIMESVCLNSSKLKERNYMGLSDCSSVDSSAPSFSDETKSNLNLKATELRLGLPGLQSPERDSDLCLRSSIQFDEKPLFPLHPATDDHHSSSKPAVLGNKRGFSDVMSGFAEEKLLVSSEVNTILSPRPSSNVALKPSSMLENVGAQQSKAKELATAKVGLERSHVFNDSRTNLNDSANNNSSAPATKAQVVGWPPIRSFRKNSLATTTKNVEEVDGKAGSGALFVKVSMDGAPYLRKVDLKNYSAYAELSSALENMFSCFTIGSCGSHGNLGGEVLNETKLKDLLHGSEYVLTYKDKDGDWMLVGDVPWEMFIETCKRLRIMKSSEAIGLAPRAVEKSKRRN

SEQ ID NO: 253 - protein, 297 aa, Glycine max
MDTAQWAQGIGVVKQPMEGSKPPPPPPPPMLERRARPQKDQALNCPRCNSTNTKFCYYNNYSLSQPRYFCKTCRRYWTEGGSLRNVPVGGGSRKNKRSTPPAPPSAPAPTKKLSDLATPNFPQSASQDPKIHQGQDLNLAYPPAEDYSTVSKFIEVPYSTELDKGTTGLHQNPTSSSTTTSASSQLSAMELLKTGIAAASSRGLNSFMPMYNSTHGFPLQDFKPPHGLNFSLEGFENGYGGLQGIQEGPTGGARILFPTVEDLKQQVPSTNEFDQQNRSQEGSAHGYWNGMLGGGSW

SEQ ID NO: 254 - protein, 319 aa, Glycine max
MMEHNIIVNNNVIAPFVIKTYNMVNDPTTDKLITWGPANNSFIVLDPLDFSHSLLPTFFKHNNFSSFVRQLNTYGFRKVDPDRWEFANEWFLRGQKHLLRNIVRKKHGGAGRTNSNSHYSHPLKLEELDDEAMVMEIARLKEEQKALEEELHEMNKRLETTEKRPQQMMAFLCKVVEDPQILSRILREREKKHLGEKKRRLIPPPPPTAATSSSSSSGIKTEFEEDEGNYNIKSSSPETGLEIDNNSNNICSPPPLGCWGEQGCYGYNCASVPAPLTVVAPAFPTMGGGYLRRGGFWGEMAAEGNAVPPYPFSLLEGGF

SEQ ID NO: 255 - protein, 393 aa, Glycine max
MTEEDRSAQETVHNGVASTELGGEEMDIAEVTAAGRVKGPWSPEEDALLSRLVAQFGARNWSMIARGVPGRSGKSCRLRWCNQLDPCVKRKPFTEEEDSIIVSAHAIHGNKWAAIARLLPGRTDNAIKNHWNSTLKRRCMEMGRYVPAHADVMEDGTGSFDKTKASSEETMSIGDINSKNPAEVRNVMMDNENKPPTKDDAKVEEHPTLHRPVARVSAFSVYNTPGRSTMGSCSKMFPRQSPLIQSPKPDVGSCKLFDDIDCEPMVPSQCGHGCCTGDSRESHSHGSLLGPEFVDYLESPSSSHAFISIATDLNNIAWIKSGLENCSTGVTENTANLTASRGVASALQTNFLGQDLKNGYGQFEEGHGMFLGAMQEVLSTKMARQHYAMPAEV

SEQ ID NO: 256 - protein, 255 aa, Glycine max
MDSKFRKKNRNVNSYTSEQDQDTDIAQENLAESPPSSTVFNIDGLVPSPTSSSKRRRAIQKRVVQIPMKETEGCRLKGESNTPPSDSWAWRKYGQKPIKGSPYPRGYYRCSSSKGCPARKQVERSCVDPTMLVVTYSSDHNHPWPPSRNHARPTKKPEPVPDPVEPEEKFADESMITTAEELGWLGEMEATSSTVLESPFMATTYHADVALIPMREEDESLFADLGELPECSVVFRQGLLAERRRYTAPWCGTTS

SEQ ID NO: 257 - protein, 313 aa, Glycine max
MGVNEDFNKDIDDHHHEYVDDDDVPLPGFRFHPTDEELVSFYLRRKLHKKPISIELIKQIDIYKYDPWDLPKTSATAEEKEGYFFCRRGRKYRNSIRPNRVTGSGFWKATGIDKPVYSHGGEGNDCIGLKKTLVYYRGSAGKGIKTDWMMHEFRLPSNKDNTTNLPSSKNYVDVPQEAEIWTLCRIFKRNVSQRKHTPDLKQLSAKRHSIHDKNSRMSNVEFNNTNQESYINFGGHYQNEQKPVINYTNSDQRNQYHVMTHQLFAAPVAQHHQQPQQLTSPSSNFWLNSPPGNDFFTFDNWDELGSVVKFVVD

SEQ ID NO: 258 - protein, 327 aa, Glycine max
METSGGVSGGVTLVGSDAPSDYHVAPRTDNPAPASGSTTQIPATAGSVPPSPHPPHTAAMEAYPAKMPAKKKRGRPRKYAPDGSVTMALSPKPISSSAPLPPVIDFSSEKRGKIKPTSSVSKAKFELENLGEWVACSVGANFTPHIITVNSGEDVTMKVISFSQQGPRAICILSANGVISSVTLRQPDSSGGTLTYEGRFEILSLSGSFMPSESGGTRSRSGGMSVSLASPDGRVVGGGVAGLLVAASPVQVVVGSFLAGNQHEQKPRKQRHEVITSVIPAAVVPISTLDPVPILSAASSIRNDNWSAMPAEAKNKPADINVSLPAG

SEQ ID NO: 259 - protein, 233 aa, Glycine max
MKIQCDVCDKVEASVFCPADEAALCHSCDRTIHRANKLATKHARFSLHYPTSKDFPLCDICQERRAYLFCQEDRALLCRECDVPIHRANEHTQKHNRFLLTGVKLSGTCLDPASSSTNYTNNNRVTGSEGRNDARSRMNRPRSSVSNEENASNSSCKVEDNVASDTGSISTSSISEYLIETIPGYCFEDLLDASFAPNGFCKKQNFDHPWAFQDQKRTSGDTMAVPFLKLVIH

SEQ ID NO: 260 - protein, 255 aa, Glycine max
MVQQEVRKGPWTEQEDFKLVSFVGLFGDRRWDFIAKVSGLNRTGKSCRLRWVNYLHPGLKRGKMTPQEERLVLELHSKWGNRWSRIARKLPGRTDNEIKNYWRTLMRKKAQDKKRGEAASSSSSSVDSSISSNNHAVDPHASKKAGEESFYDTGGHGVTASTQDQGQKGEQGLFSMDDIWKDIDNMSEENNTLQPVYEGNSEEGCNFSCPPQVPSPSSWEYSSDPLWVMDEESLFCPLSEPYFSCYAQGSVFLTG

SEQ ID NO: 261 - protein, 337 aa, Glycine max
MGVPERDPLAQLSLPPGFRFYPTDEELLVQYLCRKVAGHHFSLPIIAEVDLYKFDPWVLPGKAVFGEKEWYFFSPRDRKYPNGSRPNRVAGSGYWKATGTDKIITTEGRKVGIKKALVFYIGKAPKGSKTNWIMHEYRLLDSSRKHNLGTAKLDDWVLCRIYKKNSSSQKVEANFLAMECSNGSSPSSSSHVDDMLGSLPEINDRCFTLPRVNSLRTMHQQDEKFGSPNMGSGFFSDWVNSTDLDSISEFESGCQTQRMVNYDCNDFFVPSLPPLGHVDYMVDAPLEEEVQSGVRTRRVDGPGHFQPNPDTRLLPGSGDPFGFGFIMGQQVGFGVRE

SEQ ID NO: 262 - protein, 174 aa, Glycine max
MRSQLVCNGCRSILVYPRGATNFCCALCNTITSVPPPGMDMSQLYCGGCTTLLMYTRGATSVRCSCCHTINLVPESNQVIHCANCRTTLMYPYGASSVKCAICCYITNISMTNGRLSIPVQRPNGTANSGTVSSTSSSMPYSQSQTVVVENPMSVDSSGKLVRNVVVGVTTDKK

SEQ ID NO: 263 - protein, 187 aa, Glycine max
MAKEGLGLEITELRLGLPDAEHVTVVNKNEKKRAFSQIDDENSSSGGDRKIKTNKSQVVGWPPVCSYRKKNSMNEGSKMYVKVSMDGAPFLRKIDLGLHKGYSDLALALDKLFGSYGMVEALKNADNSEHVPIYEDKDGDWMLVGDVPWEMFMESCKRLRIMKRSDAKGFGLQPKGSLKGFIESAAK

SEQ ID NO: 264 - protein, 346 aa, Glycine max
MKNNRDKEKGNDVDQSYRQHHTLSMPMMFSGLNREKEMSAMISALTHVVCGEDEHHGADYSLLNHNINNTNSAVVGDDDFTVTSNMASGSMPPSSTCSSQGGNSVLKRRREYDNTNDFSRGGSFPAISTIAESSSTVTRRTANTVYDYEYRTENVKVVEEEPRRKYRGVRQRPWGKWAAEIRDPFKATRVWLGTFETAEDAARAYDQASLRFRGNKAKLNFPENVRLRQQQEPPLNLNPPPPPNHGAILSIPSTTVHTEALQGSLGSSNFYEHSYSHLHEFPVSLYDQIAESTSTTMASHHLQFLPPASSSTMTMTSPQAPPSIYPTHPAAWSSGYSYNSSSSASG

SEQ ID NO: 265 - protein, 843 aa, Glycine max
MASSEVTMKGNCLNHNDGGATEPHSPSTAKDAEAALFRELWHACAGPLVTVPREKERVFYFPQGHIEQVEASTNQVADQHMPVYDLPPKILCRVINVQLKAEPDTDEVFAQVTLLPEPNQDENAVEKEPPPPPPPRFHVHSFCKTLTASDTSTHGGFSVLRRHADECLPPLDMSKQPPTQELVAKDLHANEWRFKHIFRGQPRRHLLQSGWSVFVSSKRLVAGDAFIFLRGENGELRVGVRRAMRQQGNVPSSVISSHSMHLGVLATAWHAILTGTIFTVYYKPRTSPAEFIVPYDQYMESLKNSYSIGMRFKMRFEGEEAPEQRFTGTVVGIEDSDPKRWRDSKWRCLKVRWDETSNTPRPERVSPWKIEPALAPPALNPLSMPRPKRPRSNAVPSSPDSSVLTREASSKVSIDPSPANGFPRVLQGQEFSTLRGNFTESNEFDTAEKSVVWPPTAVDDEKMDVSTSRRYGSESWMSMGRNEPTYSDLLSGFGTSGDPSHSSLKDQMSPAYSARKQSLDHEGKLHMPHPWPVMPSSLSLNILDSNAKGPTHGGDTSFQARGNLRFSAFGEYPALHGHKVEDSHGNLMPPPPAPQTQYQSPCSRELMSKHVSAKTCEAVKPKDGDCKLFGFSLISGPIVPEPSLSQRNVSEPAGQMHLTAHQQRTSENDEKSDHSKGSRPVDDLVVDDHDRPLQTSQSHTKDVQAKPLSGSARSCTKVHKKGIALGRSVDLTKYSGYDELVAELDQLFEFGGELLSTKKDWLIVYTDNEGDMMLVGDDPWQEFCAMVCKIYIYPKEEIQKMSPGTLSSKNEENQSVMASDGADAKVVKCQPHQKFNSENGLDA

SEQ ID NO: 266 - protein, 640 aa, Glycine max
MTDGHLFNNITLGGRGGTNPGQIKIYPGGIIWKRQGGGKLIEVDKSDIMGVTWMKVPRSNQLGVQIKDGLYYKFTGFRDQDVVSLTNFFQNTCGISVEEKQLSVSGRNWGEVDLNGNMLAFTVGSKQAFEVSLADVSQTQLQGKNDVILEFHVDDTTGANEKDSLMEISFHIPNSNTQFVGDENRPPAQVFRDKIMSMADVGAGGEDAIVTFEGIAILTPRGRYSVELHMSFLRLQGQANDFKIQYSSVVRLFLLPKSNQPHTFVIISLDPPIRKGQTLYPHIVMQFETDYVVESELAINEDLYNTKYKDKLDLSYKGLIHEVFTTILRGLSGAKVTKPGKFRSCQDGYAVKSSLKAEDGILYPLEKSFFFLPKPPTLILHEEIDYVEFERHAAGGSNMHYFDLLIRLKSEQEHLFRNIQRNEYHNLYEFISSKGLKILNLGDAQPTVGIKKVLENDDDDAVDPHLERIKNEAGGDESDEEDSDFVADKDDEGSPTDDSGADDSDATDSGDEKEKPAKKESKKDLPSKASTSKKKSKDDEDGKKRKQKKRKDPNAPKRAMSGFMFFSKLERENLKKTNPGISFTDVSRVLGEKWKKLSVEEKEPYEAKAREDKKRYKDEISGYKNPQPMNIDSGNESDSA

SEQ ID NO: 267 - protein, 188 aa, Glycine max
MRVSTETEPETKKIKRIRGGGDSSKHPLYRGVRMRNWGKWVSEIREPRKKSRIWLGTFPTPEMAARAHDVAALSIKGPAAILNFPHLANSLPRPASLAPRDVQAAAAKAAHMDPSSLSSLVSAMDLSSASDELSQIIELPSLESTDDGSVDLKKEFVFVDSLDAWMYQPPFGFDTEQDTGFEGLMWNY

SEQ ID NO: 268 - protein, 279 aa, Glycine max
MRVGSTANCCYLQLEAPQQNNVTESSSDMSDRMIKIQIANHPLYPDLLSAYIECQKVGAPPELACLLEEIGRESHRMNARREIVEGPELDHFMETFCEVLHRYKEELSRPFNEATLFLGDMESQLSNLCNGTLTKSSDNNNRSDEVASGASEEELSCGEMEAFEDHVSSSVTCPSDQRLKEMLLRKYSGHFSGLRKEFLKRRKKGKLPKDARIALMDWWNTHYRWPYPTEEEKVKLSEITGLDQKQINNWFINQRKRHWKPTDDMRSAVMDGIRGPMLF

SEQ ID NO: 269 - protein, 423 aa, Glycine max
MDPLCEFCRVVRAVVYCKSDSARLCLHCDGCVHSANSLSRRHSRSLLCDKCNSQPAMIRCMNHKLSLCQGCDWNPNDCSALGHRRLALNCYTGCPSLAEFSRLWSFVFDANSSLGGWESVGTLPKSESCTSQCLEQTDHNGGYFGLVSDKLDEIESCVRYQPRMDQSQIIPSNPNYTPYCKDEAFFFPQDSNQPKLQECPNLGIHDGNELCEGFNVDNVQLNFEIADEIFYCSQVATRYHLEDGGMDCLLMDKNIAVTESSSLIESAMEASSSIQQDCVAFQSSRAGGSASVMQVINSNTNCALMNPSCTKNISLGFPQGLVHSNMPLQFPNIVGENNSTEYQDCGLSRVGESPWESNLEGTCPQARDKAKMRYNEKKKTRTFGKQIRYASRKARADTRKRVKGRFVKAGEAYDYDPLGTRDI

SEQ ID NO: 270 - protein, 219 aa, Glycine max
MAPRDKTSAVKPSGNAGVKDLHFRGVRKRPWGRFAAEIRDPAKKTRVWLGTFDTAEEAARAYDAAAREFRGPKAKTNFPLPSENFKNASPSQSSTVESSSRDRDVAADSSPLDLNLAPVAVSSARFPFRNQFPVFPGAVPAANQVMYFDAVLRAGMAGPRGFAFGYNPHPVAASEYHATTSDSDSSSVIDLNHNEGVVKGNGSRMFDLDLNHPPPHEIA

SEQ ID NO: 271 - protein, 695 aa, Arabidopsis thaliana
MDKSQKNPTSQIGTSTPKSKFEDSPVFNYISNLSPIESVKSISTAQTFSSLSFTSPPPVFTSPHVISHRESRFFRCHNSVDRSKHLESLDGSAVKGEVVVPLVEDLNKEASLEDEEETSVETSSELPQIMKFDSQTSEHSDSPCTEDVVIEASSDPPRGDNGSSSEDVTMGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSLESGSILRRRGNGRKLILRSIPAFPSLNPNQ

SEQ ID NO: 272 - protein, 374 aa, Arabidopsis thaliana
MVKSTDGGGGSSSSSSVAPFLRKCYDMVDDSTTDSIISWSPSADNSFVILDTTVFSVQLLPKYFKHSNFSSFIRQLNIYGFRKVDADRWEFANDGFVRGQKDLLKNVIRRKNVQSSEQSKHESTSTTYAQEKSGLWKEVDILKGDKQVLAQELIKVRQYQEVTDTKMLHLEDRVQGMEESQQEMLSFLVMVMKNPSLLVQLLQPKEKNTWRKAGEGAKIVEEVTDEGESNSYGLPLVTYQPPSDNNGTAKSNSNDVNDFLRNADMLKFCLDENHVPLIIPDLYDDGAWEKLLLLSPSRKKTKKQENIVKKGKDDLTLEEEEEDGTMELDKSYMLKLISEEMEKPDDFEFGQLTPERSRNLEILTEQMELLASNE

SEQ ID NO: 273 - protein, 628 aa, Arabidopsis thaliana
MMFNEMGMCGNMDFFSSGSLGEVDFCPVPQAEPDSIVEDDYTDDEIDVDELERRMWRDKMRLKRLKEQDKGKEGVDAAKQRQSQEQARRKKMSRAQDGILKYMLKMMEVCKAQGFVYGIIPENGKPVTGASDNLREWWKDKVRFDRNGPAAITKYQAENNIPGIHEGNNPIGPTPHTLQELQDTTLGSLLSALMQHCDPPQRRFPLEKGVPPPWWPNGKEDWWPQLGLPKDQGPAPYKKPHDLKKAWKVGVLTAVIKHMFPDIAKIRKLVRQSKCLQDKMTAKESATWLAIINQEESLARELYPESCPPLSLSGGSCSLLMNDCSQYDVEGFEKESHYEVEELKPEKVMNSSNFGMVAKMHDFPVKEEVPAGNSEFMRKRKPNRDLNTIMDRTVFTCENLGCAHSEISRGFLDRNSRDNHQLACPHRDSRLPYGAAPSRFHVNEVKPVVGFPQPRPVNSVAQPIDLTGIVPEDGQKMISELMSMYDRNVQSNQTSMVMENQSVSLLQPTVHNHQEHLQFPGNMVEGSFFEDLNIPNRANNNNSSNNQTFFQGNNNNNNVFKFDTADHNNFEAAHNNNNNSSGNRFQLVFDSTPFDMASFDYRDDMSMPGVVGTMDGMQQKQQDVSIWF

SEQ ID NO: 274 - protein, 254 aa, Arabidopsis thaliana
MENSYDSSKWSDSTTPYMVSWSLQSESSDSDWNRFNLGFSSSSFGGNFPADDCVGGIEKAESLSRSHRLAEKRRRDRINSHLTALRKLVPNSDKLDKAALLATVIEQVKELKQKAAESPIFQDLPTEADEVTVQPETISDFESNTNTIIFKASFCCEDQPEAISEIIRVLTKLQLETIQAEIISVGGRMRINFILKDSNCNETTNIAASAKALKQSLCSALNRITSSSTTTSSVCRIRSKRQRWFLSSHYSHNE

SEQ ID NO: 275 - protein, 212 aa, Arabidopsis thaliana
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 276 - protein, 602 aa, Arabidopsis thaliana
MGCCQSRIDSKEIVSRCKARKRYLKHLVKARQTLSVSHALYLRSLRAVGSSLVHFSSKETPLHLHHNPPSPSPPPPPPPRPPPPPLSPGSETTTWTTTTTSSVLPPPPPPPPPPPPPSSTWDFWDPFIPPPPSSSEEEWEEETTTATRTATGTGSDAAVTTAPTTATPQASSVVSGFSKDTMTTTTTGSELAVVVSRNGKDLMEIIKEVDEYFLKAADSGAPLSSLLEISTSITDFSGHSKSGKMYSSSNYECNLNPTSFWTRGFAPSKLSEYRNAGGVIGGNCIVGSHSSTVDRLYAWEKKLYQEVKYAESIKMDHEKKVEQVRRLEMKRAEYVKTEKAKKDVEKLESQLSVSSQAIQSASNEIIKLRETELYPQLVELVKGSMYESHQVQTHIVQQLKYLNTIPSTEPTSELHRQSTLQLELEFSKNPLVRSSYESKIYSFCEEWHLAIDRIPDKVASEGIKSFLTAVHGIVAQQADEHKQKKRTESMLKDFEKKSASLRALESKYSPYSVPESRKKNPVIEKRVKVEMLKGKAEEEKSKHEKSVSVTRAMTLNNLQMGFPHVFQAMVGFSSVCMQAFESVYNQAKSIGEDQEEVKRLLP

SEQ ID NO: 277 - protein, 296 aa, Arabidopsis thaliana
MNKKLLNPLEDPPTASSSEDVDEEISSGEDEKEHISNSSSSEEENELKDLSTQTLNSPSTEAPTLDSGSETNSDSDKPIVLTSQKKKEGTDSSGTKRASEGTSSKDIKRAKKVSGDDDNKKFQSLWTKEDEISLLQGMIDFKAETGTSAHDDMNGFFDIAKRYISFDVSKIQFGDKIRGLKKKYFGVRKKKGLDLDHDKKCLGLAKSIWGLDGKEVVVLGGDSETSNWFEKSFLVRVVARLGVDECIVKWKWSKVSKETKKRIEEKMKMVEAKELELLSQKIDVLKEVASVIAETI

SEQ ID NO: 278 - protein, 237 aa, Arabidopsis thaliana
MSQETAIASFKKFQQSWIEQLRNHLNHLRSAQNHHRNSATGDEERLREAVDRVMEHFREYHRAKWAATDKDVIEVMASPWASALERSLQWVGGWRPTTLFHLVYTESSILFESRIVDILRGFRTGDLSDLSPSQFRTVSELQCETVKEENAITEELSEWQDDASDLVMGTSSDPDQRIRRLAEIVHRTDDLRLRTITRVVEVLSPLQQAEFLVAAAELRTGVAGWGTSHDRRRSSEV

SEQ ID NO: 279 - protein, 222 aa, Solanum lycopersicum
MAPKEKIGAVTAMAMVNLNGISKEVHYRGVRKRPWGRYAAEIRDPGKKSRVWLGTFDTAEEAARAYDNAAREFRGAKAKTNFPKLEMEKEEDLKFAVKNEINRSPGQTSTVESSSPVMVDSSSPLDLSLCGSIGGFNHHTVKFPSSGGGFTGSVQAVNRMYYIEALARAGVIKLEQIGRKRLDYLGGGDSDSSTVIDFMRVDVKSTTAGLNLDLNFPPPENM

SEQ ID NO: 280 - protein, 201 aa, Zea mays
  misc_feature (36)..(36): Xaa can be any naturally occurring amino acid
  misc_feature (40)..(41): Xaa can be any naturally occurring amino acid
MGVESECDRIKGPWSPEEDEALRRLVERHGARNWTXIGRXXPGRSGKSCRLRWCNQLSPQVERRPFTPEEDAAILAAHARLGNRWAAIARLLPGRTDNAVKNHDSARSHFQELSPSSSPSPQSTPPAFPPQAAPSQSSYAFSGELVAAMQEMIRAEVRKYMSGAGLRAGCGPGAVGEVCMPQLVEGVMRAAAERVGVVTRP

SEQ ID NO: 281 - protein, 641 aa, Oryza sativa Japonica Group
MMGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGIGGSNGGVFEDVNGMMQQPQQTTPAQQQFFIRDDTPFGNQMGDINGASEFRFGSGFNMSGAVEYPGAMQGQQKNDGASEFEELE

SEQ ID NO: 282 - protein, 501 aa, Ampelopsis megalophylla
  misc_feature (231)..(258): Xaa can be any naturally occurring amino acid
SDMAEVAQKLEQLEEVIVNAQEDGLSHLASETVHYNPSDLSNWLESMLSEFNPTPNCPLDNPFLPPISQSSAISPLDYTNCSTQPKQEPSLFDSPSLDYDLKAIPGKALYSHIEQPPQQPPPPPLYQRENKRLKPTTSATANSVSSIIGGWGVPTESARPVVLVDSQETGIRLVHTLMACADAVQQENLKLAEALVKQIGFLAVSQAGAMRKVATYFAEGLARRIYRLYPXXXXXXXXXXXXXXXXXXXXXXXXXXXXTANQAILEAFEGKKRVHVIDFSMKQGMQWPALMQALALRPGGPPSFRLTGIGPPSTDNTDHLHEVGWKLAQLAETIRVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLA

SEQ ID NO: 283 - protein, 528 aa, Oryza sativa Japonica Group
MMGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQFFIRDDTPFGNQMGDINGASEFRFGSGFNMSGAVEYPGAMQGQQKNDGSNWYY

SEQ ID NO: 284 - protein, 341 aa, Zea mays
MEAADLRWCCGSSSNDWDLHAVVRFASCSGGGSRVTTSSPLRASDEPFSSCLLPPPQSQTKDEVTDAAAPQQLPTGPAVGVDDLCLHQAFLGLATPQPRNNEAPPPAKRPRTPYRSNNGVGGPTRSKRKKKKSQTSKKEVARVPVGASPDPWAWRKYGQKPIKGSPYPRGYYRCSTDKDCRARKQVERCRTDPSTLIVGYTGEHSHPVPLHRNALAGTTRNKPQPAPPSTSSPAEQPDPAASPIDDTTTPLLCPSVLGVECEEEEENTVAAGLLLEDAEMEGYEDVLLFLKPAPSPSNGSGSKDVMLFPDPHRPAPGADNTGGSEKVVPLSNLQSTSYHFQ

SEQ ID NO: 285 - protein, 75 aa, Chlamydomonas reinhardtii
MSMRNNKRRALASAGAASKQSAVADAVLDVANRKGVRCCVECGATSTPQWREGPMGPKTLCNACGVRRQRLIRKQ

SEQ ID NO: 286 - protein, 103 aa, Oryza sativa Indica Group
MGAPKQKWTSEEEEALRRGVLKHGPGKWRTIQKDPEFSPVLSSRSNIDLKVQPLTLPLRHRRLPCAGGSCDAATSSEEKNYGAVVCGYGHSGLKLAGQTGAVF

SEQ ID NO: 287 - protein, 187 aa, Oryza sativa
  misc_feature (119)..(119): Xaa can be any naturally occurring amino acid
MQSQIVCHGCRSVLRYPSGAPSVCCALCQAITTVPPPAPVMEMAHLICGGCRTLLMYTRNADTVRCSCCSTVNLVRPVNNIAHVSCGQCRTTLMYPYGAPSVKCAICHYITNTGMNTVXAPTPSPMPTSSGSSYNAPPSGSSYNAPPPTSAPTSRPQNVTVVVENPMTVDEKGKLVSNVVVGVTTGK

SEQ ID NO: 288 - protein, 281 aa, Triticum aestivum
MATTVDWRSYRPDLPAAMYHMVDGRDQVMHAFAPPTAQGAAPTISFSFPCPGAEQSAGLLRGASYLTPAQILQLQSQLHHVRRAPGAAMAVAGQPMKRHGVAALPAQPAAKLYRGVRQRHWGKWVAEIRLPRNRTRLWLGTFDTADEAALAYDAAAFRLRGESARLNFPELRRGGEHHGPPLDAAIDAKLRSICHGEDLPQSQSNATPAPTPTLTPSSFPDVKSEPGCSVSESSSSADGEVSSCSDVVPEMQLLDFSEAPWDESLLRKYPSLEIDWDAILS

SEQ ID NO: 289 - protein, 291 aa, Oryza sativa Japonica Group
MAAAIDLSGEELMRALEPFIRDASGSPPVCSQFSPTSPFSFPHALAYGGGLAQQPELSPAQMHYIQARLHLQRQAAQAGPLGPRAQPMKASSSSASAAGAAATPPRPQKLYRGVRQRHWGKWVAEIRLPRNRTRLWLGTFDTAEEAALAYDQAAYRLRGDAARLNFPDNAASRGPLHASVDAKLQTLCQNIAAAKNAKKSSVSASAAATSSAPTSNCSSPSSDDASSCLESADSSPSLSPSSAATTAETPATVPEMQQLDFSEAPWDEAAAFALTKYPSYEIDWDSLLAAN

SEQ ID NO: 290 - protein, 262 aa, Pinus strobus
FYGVNMSEYGDTGVGSMMALMTEQEPGNESIMSTMTMTIPSSAFSSYSHAGQVEGLLSAAAATMFNQGGHHHHQKHLVGGHFPPPEQLVMNEQAAVISDSSLSSVKTEVCSNQLDYHRKTSGGGGGGGGGRSCCPQPSLMVRAPQQQQQQRQQQHHHQHHQQEASRMVTSLEVDIDSACSSNPNDSIDALKSKIACHPHYPQLLAAYMDCQKVGAPPEVVTVLDDIIQENQLGRHSVTMDIGVDPELDQFMEAYCQMLIKYH

SEQ ID NO: 291 - protein, 260 aa, Picea abies
FYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYHLELSKPFKEARTF

SEQ ID NO: 292 - protein, 592 aa, Zea mays
  misc_feature (115)..(115): Xaa can be any naturally occurring amino acid
MTNNNNGGNDTNAAASGWLGFSLSPHMDEHQLQLQQQQQHGLFFPSVTAGAAASYGLGGGLATSASPYYTPQLASMPLKSDGSLCIMEALRRSDQQDHHGPKLEDFLGGGGGGAXQAMALSLDNPAAASSFYYYYYGGGGGGGGPGHHHGPFLQPPCVDLYGGASAGSQLVADDEAAATATAMASWVAARAENGALLAAAGQPQPHQHQHALALSISSGSSPSSCVTAHPSSEYGAAAAASMDGGRKRGGAAGQKQPVHHRKSIDTFGQRTSQYRGVTRHRWTGRYEAHLWDNSCKKEGQSRKGRQVYLGGYDMEEKAARAYDLAALKYWGPSTHINFPLEDYQEELEEMKNMTRQEYVAHLRRHHQHGRWQARIGRVSGNKDLYLGTFGTQEEAAEAYDVAAIKFRGLNAVTNFDLTRYDADRIMASSTLLPPDLARRRKDDDPDCGVTAAAAALVQQAAAAAAAAAPPPPPRDGSQHQHHHDVLSGEACFSVLHDLVATAADGGHHHSNAAQHVPVSSAASSLLTSIGNGNYREGSPDRGLSMLFSKPPPAHAASAKPVSPLGSWASTAASARAAVSIAHMPVFAAWTDA

SEQ ID NO: 293 - protein, 244 aa, Citrus unshiu
MGRGRVQLKRIENKINRQVTFSKRRSGLLKKAHEISVLCDAEVALIVFSTKGKLFEYSTDSCMERILERYERYCYAERQLQANEIEPNGNWTLEYSKLKARMEVLQRNQKHFMGEDLADLSLKELQSVEQQIDSGLKLIRSRKNQLMLQSISELQKKDKLLKEQNNLLAKKVKEKEKLLSQEAQCREQQQQLNHDWNSSNVHLMQTLTNSSYQMGGGSGEEDEDTPTGHRANALLPAWMLRHLH

SEQ ID NO: 294 - protein, 216 aa, Oryza sativa Japonica Group
MAKTKQGKKDVESYTIKGTTKIVRVGDCVLMRASDTEKAPYVGRVERLETDGRGSVRVRVRWYYRPEESKGGRRQFHGAKELFLSDHFDTQSAHTIEGKCVVHSFKNYTKLDNVGPEDFFCRFEYKAATGAFTPDRVAVYCKCEMPYNPDDLMVQCEGCKDWFHPSCMGMTIEQAKKLDHFLCADCVKENGTKRPSNSYPASSNSDSKVEPKKRKR

SEQ ID NO: 295 - protein, 229 aa, Cucumis melo
MSSSKEQSPSPETESSSSSSSDSNKKPKRINSNSSSNSKHAVYRGVRMRNWGKWVSEIREPRKKSRIWLGTFPSPEMAARAHDVAALSIKGNSAILNFPDLVHLLPRPVSLAPRDVQAAAAKAAHMHNLSSNANTNNHNTNSNSSSAFSDELSEIVELPALGTSYDGGVGVGGEFVFVESELESAAWLYQPPWVQSLQEDYDDIDGDGDCGKLGMGFVSNGFKGFLFDY

SEQ ID NO: 296 - protein, 789 aa, Oryza sativa Japonica Group
MAKTRQPQKRVLESFTIKGPDGVIKPGDTVLMMAPDSSKKPYVARVEEIEATGPQASQVKIKVRWYYRPEESIGGRRPFHGSKEVFLSDHYDSQSADTIEGKCYVHTFRDYTKLRSVSAEDFFCRFEYKSATGSFVPDRIAVFCKCEMPYNPDNLMIQCEDCSDWFHPSCVEITIKEAKKLEHFYCKSCIAENGKDLQKSNGATVQSEEKLYLKEKIDPKKVSNVRAREAPPQQQNTAAALSKEAHKYFDHAVVTVRAGDGGHGAVLAMPASPSTDAPKSPRRRSDKGKRSGVKKVSYKRNYDGSVALPMGGHGGDVVVYADEAEETLLRFHEKARYCAKRGGNVGATGTLSSRMHNGFAGETLRIPVPVGTVVKRKKGAVLADLAHPGDEVIVARGGQGGISLIDVPEYRRRKAMVLSPNIMRDVSDRVLIHGQPGEEVSLELILRVVADVGLVGLPNAGKSTLLSAITLARPDIADYPFTTLMPNLGRLGGDPALGALQFSSEATLADLPGLIEGAHLGKGLGRNFLRHLRRTRVIVHVVDAAADDPVDDYKIVREELRMYNPQYLERPYVVVLNKIDLPKAQDRLSSLAFEISSIGCEECDGNNTSEDSLNGNTGEHNTSSETKVEGGEKELRDYPRPQAVVGASVLKHIGIDEMLKEIRAALRKCFDHSLLLYDIQFIIVPVHKTFTLLSEGPSPSSTEPGTDTESCTNKQGPVAAEENNKKCCPRKQASMALGTEIEERKKELLKLMLQMKNIPHCDECFPNKEEQWIRFLQGSQASEQQRQPA

SEQ ID NO: 297 - protein, 73 aa, Physcomitrella patens subsp. patens
MKKTAEKRIGVPRTKLYRGVRQRHWGKWVAEIRLPRNRTRLWLGTFDTAEEAALAYDAAAYKLRGEYARLNFP

SEQ ID NO: 298 - protein, 248 aa, Picea glauca
FYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQQQHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 299 - protein, 305 aa, Zea mays
MANDDTVAGQTGGGEAVVPSTEPINIDPDTVVVDAEADTPTSSRQRGAGAIRTLKRGAWTPEEDELLARAVAKDGEGRWRTLPRRAGLLRCGKSCRLRWMNYLRPDIKRGPIAADEEDLILRLHRLLGNRWSLIAGRLPGRTDNEVKNYWNSHLSKKLVARGIDPRTHTPLPAAAASLHSHSHRADDDSPAGAAGSSADKTPPPLVEVEPSVAPPPAQPNSSFGDGSSGDFAGGMMGLGSEGFDGVGDPFCAPAPGGFHLGCPVVDDATFSSFLDSLMNEERMRIADYIGDHRDADGGNDQGGAY

SEQ ID NO: 300 - protein, 165 aa, Cucumis melo
MELPVEEDNDDEFSPLNLIRYHLLQDSHSFSTLRDFGFKLEFEDFEYVKPSEEEEEEPPIQSPKRHPERQSPRSSSPDGGRRYRGVRRRPWGKFAAEIRDPSRKGSRVWLGTFDSDVDAARAYDSAAFKIRGRKAKLNFPLDAGKSDPPPGNGRKKKRRETNLNA

SEQ ID NO: 301 - protein, 292 aa, Glycine max
  misc_feature (171)..(171): Xaa can be any naturally occurring amino acid
MSIMFSSKVLQINYSRITLHHSLFFSLTQLHLPPGFRFHPTDEELVVHYLCRKCASQEIAVPIIAEIDLYKYDPWDLPGMALYGEKEWYFFTPRDRKYPNGSRPNRSAGTGYWKATGADKPVGKPKPVGIKKALVFYAGKAPKGVKTNWIMHEYRLADVDRSVRKKNSLRXLDDWVLCRIYNKKGAIEKQQPAPPPPSGVHKIECYEMEDVKPEYTAADCLYFEASDSVPRLHTTESSCSEQVVSAEFASEVQSERKRQGNSEFSYNYMDATLGNNQMSPLQDIFMYLSRPF

SEQ ID NO: 302 - protein, 273 aa, Cucumis melo
MCGGAIIADLIPRRDGQRVTASDIWPNSSFFHFNKIRSDQVSTPLKRTPLPASSEASKPKKRQRKNLYRGIRQRPWGKWAAEIRDPRKGIRVWLGTFNTAEEAARAYDREARKIRGKKAKVNFPNEDDAYSIQAPIPQFHPHLYTVPENSEFPYDLNQIGDFTGTHFPVAIEEQSGSGSEDSYSPPKRFGVKEAEDQKPEQKVSVIAAAEEENEVQKLSEELMAYENYMKFYQIPYLDGQSTVTNPAEEQVVGDLWSFDDEDGLHGSVSSSEL

SEQ ID NO: 303 - protein, 291 aa, Arabidopsis thaliana
MQEAALGMMGASVGGDGDAAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESEKSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 304 - protein, 339 aa, Oryza sativa Japonica Group
MMYHQQQVQSDSQHLSSRPGLPPEKQFLLQGGADSSSGLVLSTDAKPRLKWTSELHERFVEAVNQLGGPDKATPKTIMRLMGIPGLTLYHLKSHLQKYRLSKNLQSQANASRAQGVLGCSTTEIDKPCEGNGSPASHLDLETQTNSSMHINEALQMQIEVQRRLHEQLEVQRHLQLRIEAQGKYLQSVLEKAQEALGTIAVAETAATANASSSKRLQNEHTQLHHHQQQQQVGDGSVDSCLTACDCEGSHHSRSHGHRGEQDILSIGLPPFEPAAARSGKEHHYLLFPNEPSRRRSCSDERRREMSTLQASELDLSINGRSSSHSHRRENIDLNGAGWS

SEQ ID NO: 305 - protein, 230 aa, Beta vulgaris
  misc_feature (199)..(199): Xaa can be any naturally occurring amino acid
  misc_feature (212)..(212): Xaa can be any naturally occurring amino acid
MGRGKIEIKRIENTTNRQVTFCKRRNGLLKKAYELSVLCDAEVALIVFSSRGRLYEYANHSVKGTIDRYKKACSNQSGAGSVAEANAQYYQQEAAKLRNQIRTATENNRLLSRHMMGEGLSSLSMKELKNLETKLERGISRIRSKKNELLFAEIEFMQKREIELHNNNQFLRARISENERAQQSMSLMPGGSDYDLVPXQSFDSRNYFQVNXLQPSSQYARQDQTPLQLV

SEQ ID NO: 306 - protein, 388 aa, Triticum aestivum
MGSSEAETPAKANKASAPQEQQPPATSSTATPTVYPDWTSFQGYPPIPPHGFFPSPVVSNPQGHPYMWGPQPMMPPYGTPPYVIYPPGGIYAHPSMRPGAHPFAPYTMTSPNGNPDAAGTTTTAATAGGETNGKSSEGKEKSPIKRSKGSLGSLNMITGKNCVEHGKTSGASANGTISQSGESGSESSSEGSEANSQNDSQHKESGQEQDGDVRSSQNGVSPSPSQAQLKQTLAIMQMPSSGPVPGPTTNLNIGMDYWANTASSSPALHGKVTPTAIPGAVAPTEPWMQDERELKRQKRKQSNRDSARRSRLRKQAECEELAQRAEVLKQENASLKDEVSRIRKEYDELLSKNSSLKDNVGDKQHKTDEAGLDNKLQHSGDDSQKDTN

SEQ ID NO: 307 - protein, 503 aa, Cayratia japonica
  misc_feature (230)..(243): Xaa can be any naturally occurring amino acid
SDMAEVAQKLEQLEEVIGNAPEDGLSHLASETVHYNPSDLSTWLESMLSEFNPPPNCSLDNPFLPPISQPSAIPPLDYTNCSAKPKQEEPSLFDSPAMDYDLKAIPGKALYSHIEHPPAPAPASSLYQRESKRLKPTTSANSVSSAIGGWGVPTESARPVVLVDSQETGIRLVHTLMACAEAVQQENMKLAEALVKQIGFLAVSQAGAMRKVATYFAEGLARRIYRLYPXXXXXXXXXXXXXXHFYEAYPYLKFAHFTANQAILEAFAGANRVHVIDFGLKQGMQWPALMQALALRPGGPPAFRLTGIGPPPPDNTDALQQVGWRLAQLAETIGVEFEFRGFVANSLADLEPSMLQIRPPEVEAVAVNSVLELHRLLARPGAIEKVLSSIKAMKPKIVTVVEQEANHNGPVFLERFTEALHYYSNLFDSLEGCGVAPPSNQDLMMSEIYLGRQICNVVACEGAERVERHETLNQWRSRIGSAGFEPVHLGSNAFRQASMLLAL

SEQ ID NO: 308 - protein, 588 aa, Physcomitrella patens subsp. patens
MCSHDSRTGGPTRRSSKGGWTPEEDETLRRAVQCFNGKNWKKIAEFFTDRTDVQCLHRWQKVLNPDLVKGAWTKEEDDRIMELVNKYGAKKWSVIAQNLPGRIGKQCRERWHNHLNPSIKREAWTQQEDLALIRAHQLYGNKWAEIAKYLPGRTDNSIKNHWNSTMKKKVDPLTANDPISKALAVYQAQQEQSMNSGAGAGQADSGSIGGRPGPPMSEATTSSGPSRHNSNAHAVGRTSHYGEQDTKSTGSAPPPPPHFDMYSNRGKDQQRNASHLQPKKEESQNDPNGQTQGFSGWSSGQAPMYSGGFSRVPPVGSSSQSNSITNQLVTSMQNKRSLSNAELTRIPSFSNSFSLNPAPESGSHSYMSSAMPVPLPNLGSFFASSHMSMEPLSNMQPMTSFSGRMVSSGGETLAMTGSMPSYEQLSRCNLPLSQATEADTAVEDSGASVPCESQHEEPMGQALEQAMDQELSEFSSDDLLRAASEAVDEFQLQSPMVTEEDLEDKSKVLERSDGLFYEPPRIADSPFMSYDLVSSLQAYSPLGVRHMIMPAGNCITPPNYLQSPFQGKSPQSKLRSAARSFSGSPSIL

SEQ ID NO: 309 - protein, 330 aa, Arabidopsis thaliana
MEDDNSNNNNNNNVIAPFIVKTYQMVNDPSTDWLITWGPAHNSFIVVDPLDFSQRILPAYFKHNNFSSFVRQLNTYGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSTPSPSSTENLYRNHSPDGWIVPMTQGQFGSYETGLVAKSMLSNSTSSTSSSLTSTFSLPESVNGGGGGGCGSIQGERRYKETATFGGVVESNPPTTPPYPFSLFRGGF

SEQ ID NO: 310 - protein, 685 aa, Arabidopsis thaliana
MDKSQKNPTSQIGTSTPKSKFEDSPVFNYISNLSPIESVKSISTAQTFSSLSFTSPPPVFTSPHVISHRESRFFRCHNSVDRSKHLESLDGSAVKGEVVVPLVEDLNKEASLEDEEETSVETSSELPQIMKFDSQTSEHSDSPCTEDVVIEASSDPPRGDNGSSSEDVTMGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPERKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 311 - protein, 384 aa, Prunus dulcis
MEGGSNGTCSMMAFGENSSSNGGGLCPMMMVPALMTSHHSHHHHHQHHHPTNSTNADPNTTTPFQLPQLPPSNHNRNSSTSSFIFNDHHPNNNNNHHPATAAACYFMDNNNSNHDGSSSSSSSVKAKIMAHPHYHRLLASYINCQKVGAPPEVVARLEEACASAASIGQMMSSSSGSGCLGEDPALDQFMEAYCEMLTKYEQELSKPFKEAMIFLQRIESQFKALTLSSSSDSAVCGDGLDRNGSSEEEVDVNNNFIDPQAEDRELKGQLLRKYSGYLGSLKQEFMKKRKKGKLPKEARQQLLDWWSRHYKWPYPSESQKLALAESTGLDQKQINNWFINQRKRHWKPSEDMQFVVMDATHPGHYYMDTVLGNPFPMDISPTLL

SEQ ID NO: 312 - protein, 381 aa, Zea mays
  misc_feature (66)..(66): Xaa can be any naturally occurring amino acid
MGKGDVATRSKSQKSPAIQNEQSTPANPPTAYPDWSQFQAYYNAAGTAPVTPPFFHPSVAPSHQGXPYMWGPQMMSPYGTPPPYAAMYAQGTPYQQAPMPPGSHPYSPYPMQLPNGTVQTPTSGAGGTATDKSNKNKRKASLKRSKGSLGSLDVVAVKNNKSPAKPSTSSSNEGSSQSESGSGSSSEGSSTNSKSGSRVKDNSEQGQGNDARSKCTQSSVVEPTQPSSGSVVLNPMMPFWPVPPPMAGPATTLNMGVDYWGTPASVPMHGKVIAAPTSAPSSNSRDIVLSDPTIQDGRELKRQKRKQSNRESARRSRLRKQAEWEEVANRADLLKQENSSLKEELKQLQEKCDGLTSENTSLHEKLKALEDEKSNGNWYKD

SEQ ID NO: 313 - protein, 1325 aa, Oryza sativa
MSSAAGGGGYGGGQGGGAEHHHHHHGHAGHLLLHHHPQHVAGAAVAAAAAAAGGQMYHVPQHSRREKLRFPPDAGDSPPPHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQDILIEFVMLVQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGGNGGVSLTLGLHQNNRVCIAEPLPAALPANLAHRFGLEEVSDAYVMSSFGGQDRHFGKEIGAKIPTLLHRRGAPPPLSPSAARTPTTPHRKNIPNTVKPLAPRTLRLRLLHPMSAPAPASPPASLFHLSRPAAGPRARPRVSRSRCVASLASQPPTPPPANANHLVQTLCASGRLARAAALLQGLPAPTQRTYKSVLLAAARAGDAALAAAVHRRLKADPVFRSDPFLSTRLIDAYASLGELPAARQVFDEAPVKSIFVWNALLKALALADHGEEALARLADMGRLRVPVDSYSYAHGLKACIAASTSHVPASALVREIHAHAVRRGYGLHTHVATTLIDCYAKLGIVSYAESVFATMPERNVVSWTAMIGCYAKNERPGDAILLFQEMVASDEDLVPNSVTIVCILHAFAGVNALGQGKLLHAYILRRGFDSLVSVLNALMAMYMKCGCLEAGRHIFDLIGHRKDVVSWNTLISGYGMHGFGHEAVQVFEDMTQMGVSPNIITFISVLGACSHAGLVDEGKRLFESMVDYNVTPRAEHYACMVDLLGRAGHLDEAVELIQGMHIRPSPQVWGSLLGACRIHRHVEYAEMACSQLFDLEPRNAGNYVLLADIYARAKLHSEVGVLKDLLEEHALEKVPGCSWIEVKKRLHMFVSVDNKNPQIEELQALIGEFVTQMKNDGYVPDTGAVLYDIEEEEKEKILLGHSEKLAVAFGLINTGRGEVIRITKNLRLCEDCHSVTKFISKYAEREIIVRDVNRFHHFRDGICSCGDYW

SEQ ID NO: 314 - protein, 444 aa, Solanum lycopersicum
MAQSNSKPPMSSQNFGVGAVSHVRSLSQSSIFSNSCLPPLSPFPPSEPGMVSGHSSLKDISMEEADVNSQGVGVVSSFTRDGLPPRKGHRRSNSDVPLGFSAMIQSSPQLMPISGQKVLGRAVSLGDSNGKIDERKPKGEVTDELLFSYMNLENIETLNGSGTKDRDKDSIVSGTKVTGSESSNNEAESVMKGNNVSIQPTNLREGTKRSADANIAPAARHFRSLSMDSAIGNFHYGDESPNLPTSLMMRSGQLSPSNSGNESSSKHNLDFGNSEFSEAEMKKIMADERLAEIAVLDPKRAKRILANRLSAARSKERKTRYISELEHKVQKLQTETTTLSTQVTILQKNFVEISSLNSELKFRIQAMEQQAQLRDALHEALTAEVQRLKLAAGEHREEGRLPNNMTQQTPVKHNIFQMQRQQPSQMQQLSVGKASAASATPASA

SEQ ID NO: 315 - protein, 222 aa, Glycine max
MAPRDHKTSNAKANGNGNSGVKEVHFRGVRKRPWGRYAAEIRDPGKKSRVWLGTFDTAEEAARAYDAAAREFRGPKAKTNFPLPLENVKNSSPSQSSTVESSSRDRDVAADSSPLDLNLAPAAVASARFPFQHQFPVFTGAVPAANQVLYFDAVLRAGMAGPRGFAFGYNHHPVAASEFHATTSDSDSSSVIDLNHNEGEVKGNGSRIFDLDLNHPPPHEIA

SEQ ID NO: 316 - protein, 566 aa, Papaver rhoeas
SSPSPAIKSSDESEKIVDMDDDAEMMVDVDVDVDVDVEVRCLENKQETPNSSSSVSDEEEEDLNCSGSSLSVRSASSNRRISGPIRRAKGGWTPEEDEKLRKAVESFKGKNWKKIAACLPHRTELQCLHRWQKVLHPDLVKGPWTLEEDDKIMELVSKYGPSKWSLIAKELPGRIGKQCRERWHNHLNPEIKRDAWTVEEEVALMNAHRLYGNKWAEIAKVLPGRTDNAIKNLWNSSLKKKLDFYLSSGQLPPLGPVLKTEDYALAMSRSSAAGNSIICLDEEINTGTQRSLEKDDSNKFGEGTMVLVQPSTPEFLDREVPTGVRAIKSSNSDDIEGKQLASENYYSCSKSFSTPNPVQYRSSAVADPEKNIAATTLQMAVPVSSPSLFEMSDSNSVLSPSSFLTPPRIRNNGLDLQSAESILKNAAKSFQNTPSILRKRRREAGGTPNRIVQTNGLTAEDKLHSLEREKIEDCKETPGSMESNSSTGRVNSTIRLFYTRKKHRPCRSRVERPDACKSLEKQLESTLDGVNTGNSQYESMKSASDQQGKSTTKEDGHDPLQNSVAS

SEQ ID NO: 317 - protein, 229 aa, Nicotiana tabacum
MVEISPGFRFYPTEEELISFYLLNKLEGKRPELDRVIPVVTIYNLDPWHLPNLPGELCMGDTEQWFFFVPRQEREARGGRPCRTTTSGYWKATGSPTYVYSSESKVIGVKKSMVFYKGKAPTGRKTKWKMNEYRAIEQETSTSSSFSIPKLRHEMSLCRVYVISGSFRAFDRRPVATVTRDTAAVKIQELAGDRDNISSAISVKNESKSYNIVESDFENLNGWEQINWM

SEQ ID NO: 318 - protein, 61 aa, Physcomitrella patens subsp. patens
HYRGVRHRPWGKFAAEIRDPAKNGARVWLGTFDTAELAGLAYDRAALKLRGSRALLNFPLR

SEQ ID NO: 319 - protein, 440 aa, Zea mays
  misc_feature (282)..(282): Xaa can be any naturally occurring amino acid
MATGETAVDRRKDPLGPRDMDLSGEEHVPKARKPYTITKQREKWTEDEHRRFLEALQLHGRAWRHIQEHIGTKTAVQIRSHAQKFFTKVVRESSSGCNASAGAAPAIQVPPPRPKRKPAHPYPRKVDGAAKNPAPELKLLEKLPPRDRDEGSPTSVLASARTASRAEVLGSAFANSSSASRSLDLSASGLDERGDGGGSLVSSVAGEHGCASPRTRAPYTKVLVEANEVSHLGPEAPVLKLFGKKVVVKDLKTDYSPAAASVAKASRDHNPTGAAGASSWSXGPGSVQVQQLMYFVPQHDGLAAQPVAPWFGYSGSVPCAVFYPQAVGSAQEHQQASEPLDHKRAQRERSLTGSNMASSAASAAQNSDTAQSRHGPGQENTGDGCAALRAAIPRLAKCASSASFSGRGFVPYKRCAAESEAPRSVAPGEEDDGELTRLCL

SEQ ID NO: 320 - protein, 249 aa, Vitis vinifera
MATVAKRINNSSEEIELRRGPWTLEEDTLLIHYIACHGEGRWNLLAKCAGLKRTGKSCRLRWLNYLKPDIKRGNLTPQEQLLILELHSKWGNRWSRIAQHLPGRTDNEIKNYWRTRVQKQARQLKIESDSKRFIDAVRRFWMPRLLQKMEQASTSSTAADTVTTNTTNTTTVNSQSSTIPALLPNQITVSSSPPQSSVTSPSISTSDSMKIPLLPEISEHPTSPSQAIGNTVHNNPVINDCSYVEQQCL

SEQ ID NO: 321 - protein, 974 aa, Arabidopsis thaliana
MEGGRGGGDGNFLPNSNFGVFSDSAMDMDFMDELLFDGCWLETTDGKSLKQTMGQQVSDSTTMNDNNNNSYLYGYQYAENLSQDHISNEETGRKFPPIPPGFLKIEDLSNQVPFDQSAVMSSAQAEKFLLEESEGGRRYWIAPRTSQGPSSSVKERLVQAIEGLNEEVQDKDFLIQIWLPIQQEGKNFLTTSEQPHFFNPKYSSLKRYRDVSVAYNFLADEDSKESVGLPGRVFLKKLPEWTPDVRFFRSEEYPRIKEAEQCDVRGSLALPVFERGSGTCLGVVEIVTTTQKMNYRPELDNICKALESVNLRSSRSLNPPSREVCKNGLLNQTLTSSIHRNNEFWLLNVICPFCFSFCRVYDLPLALTWAPCARQGKVGSRHSDENFSECVSTVDDACIVPDHQSRHFLEACSEHHLLQGEGIVGKAFNATKLFFVPEVTTFSKTNYPLAHHAKISGLHAALAVPLKNKFNSSVEFVLEFFFPKACLDTEAQQDMLKSLSATLQQDFRSLNLFIDKELELEVVFPVREEVVFAENPLINAGTGEDMKPLPLEEISQEDSSWISHMIKANEKGKGVSLSWEYQKEEPKEEFMLTSGWDNNQIGSGHNNFLSEAEQFQKVTNSGLRIDMDPSFESASFGVGQTLLGSRRPGEKRRTKTEKTIGLEVLRQYFAGSLKDAAKSIGVCPTTLKRICRQHGITRWPSRKIKKVGHSLKKLQLVIDSVQGVQGSIQLDSFYTSFPELSSPHMSGTGTSFKNPNAQTENGVSAQGTAAAPKSPPSSSCSHSSGSSTCCSTGANQSTNTGTTSNTVTTLMAENASAILKRARSEVRLHTMNQDETKSLSRTLSHKTFSEHPLFENPPRLPENSSRKLKAGGASKVKATFGEAKVRFTLLPTWGFRELQHEIARRFNIDNIAPFDLKYLDDDKEWVLLTCEADLEECIDIYRSSQSRTIKISVHEASQVKLGGSFGSIGLGPSL

SEQ ID NO: 322 - protein, 237 aa, Vitis vinifera
MELMNNRSAPENSHMNGHGFMAFSNVGFSIHHQQEFPVNFRDNTQSPVHAGGLSAVQVLQFSSQPGDFGQETKTGKVNFVSSPPASGSEFLGDNKNLGGRKRKRSNERENNKPREVIHVRAKRGQATDSHSLAERVRREKINEKLRCLQDLVPGCYKTMGMAVMLDVIINYVQSLQNQIEFLSMKLSAASTFYDFNSSEAEALETMQGTNAYEVHEVERSVKEGYGGPSHLHSTWPF

SEQ ID NO: 323 - protein, 657 aa, Chlamydomonas reinhardtii
MLQSLGSLVQSGNWLGGAGPQGWAVATEPLLPWAQRDDSFAAAAGGLLGNLGAGGGAAAVAGLSAPVLALSAPVTLRDLHSVCDNMTRGPGEGGVSRFAAGGGEGDGGAGGEGLMSMTAASFDMMGDAAETCTNADTIMRTVSFSRHGGSKGSSSMTTGSSMGSGDRTGERVSAAAYARPPGPAAAHGEAALRSNEQSAHQGPAAAAAAAAAAAAAAAAAAAVSAAAAAAAAKVTAGANATGAKRLAGQSSGVTGASQDGARSLEPRQQSMPPGSERLPSRTPSDTARILQLGPEATKEHSEGNKGESEADKAAGRAEGQSAAPEPRVRGAAGRRRGTGASRRDRRAPTHGAAGAEEEYGDDEAEGQRASGTQQKPQAQQKSETGDGVQSRDPELGAQPEPELERELLPKSAGSPDAAKPAKAKPKRAQAAKAQAKARKGKRQSTKEDSDAGDSSSSTSSRDNSNEPQSAKGSESGSGGGRNHRGGRSGAGAAAKESSGAGTESDAADGATAGAAGGGGSAFRRARAVTFEDMQAVFHLRVVEAARALGFSATELKRRCRALGFSRWPQRKLLSLQRMADSAAADKRLAPDQKQAMLAALERNRVAIMARPDTPLEDGIKVARQVQYKALHNNRTKGGAAAGAADASGAGDEDDADE

SEQ ID NO: 324 - protein, 253 aa, Physcomitrella patens subsp. patens
MEGGSMTLNPRSVDEVFKDFKGRRSGMLKALTTDVEEFYLQCDPEKENLCLYGFPDEAWEVNLPAEEVPPELPEPALGINFARDGMQRKDWLSLVAVHSDAWLLAVAFYYGARFDKNERKRLFNMVNELPTVFDVVTGKKPVKDKPAVNNNSGNKVKSATKVVSAQVTQAKPAKPTPPPPKEEEDPLDDEDEEEHGDTFCGSCGGPYTADEFWIGCDICEKWFHGKCVKITPARAEHIKQYKCPSCSNKRART

SEQ ID NO: 325 - protein, 297 aa, Zea mays
MEDLYSIHPGISRVVGGAASEASVAGAGAGGPSPSDLTELMKAQIASHPRYPSLLSAYIECRKVGAHPHVTSLLEEVSRERRPGPGAGAGEIGVDPELDEFMDAYCRVLVRYKEELTRPFDEAASFLSSIQAQLSDLCSGGSSPAATATHSDDMMGSSEDEQCSGDTDVPDMGQEHSSHLGDHELKEMLLKKYSGCLSRLRSEFLKKRKKGKLPKDARTVLLEWWNTHYRWPYPTEEDKVRLAAMTGLDPKQINNWFINQRKRHWKPSEDMRFALMEGVAGGSSGTTLYFDTGTIGP

SEQ ID NO: 326 - protein, 408 aa, Arabidopsis thaliana
MDSKLLLVTQSGSVDDLYSLIQAAPDILQKVDVLPIIHTPLHEASSAGKLDLAMELMILKPSFAKKLNEYGLSPLHLAVENDQVELALELVKVDPSLVRIRGRGDFLLACPESIKDVNVNGETILHITIMNDKYEQLKVLTGWMQKMRDSDDVFIDVLNRRDRGGNTVLHLAAYENNDKVVKQLVKCLSLDRNIQNKSGMTALDVLRARGSHMNKEIEEIIQMSGGKTGGSLSGIQEWYIFLREPVTFKEHCKTRIARYRSRISDGSRNALLVIAALIISATFQTAAQLLDKEKLDKVKKNGMRFSEFQLWGCNTVAFSIAILFSFILLPVGRAYEWWYFIITVPLVFSYFLLMYMMHGLSFFFLIIYEGGLFLVYLLVLYVKWKRCTQMKVRKPKSDLISDNFKNMV

SEQ ID NO: 327 - protein, 149 aa, Triticum aestivum
MEENQSSTQMKAASHDELQLFTEEKPVTLCRSQSHMLFSEHKPMENMSGMQEAKPDSLKIKAMYGEERCIFRLQPSWGFEKLKEEIAKRFGISWEVYDLKYLDDESEWVLLTCDADLLECIDVYKSSSAKTVRISVNPAVQPVLRGSFG

SEQ ID NO: 328 - protein, 254 aa, Oryza sativa
  misc_feature (192)..(192): Xaa can be any naturally occurring amino acid
MRLARQQQQVVVAATMEHDVHHHRQMMQQQQQQEMDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKDQEWVLCRVFKKSLELAPXGAGMVHELLMGGGWYCNKGERERLSGASQDTGLTSSEVNPGEISSSSRQQRMDHHDASLWAY

SEQ ID NO: 329 - protein, 658 aa, Arabidopsis thaliana
MDTPQKSITQIGTPISKSRFEDSPVFNYINSLSPIRPVRSIPNPNQFSSLNFTSPPSVFTSPHLTSSHKESRFFKTHNSSSSDPTNSVESQEDESTSHEEVPAEGEDTKGLNIDDCMREEASVETNLDDSVASPCGGNTTDLSLVPYAPTRGEDGSCEDNGMELQKMHDNVQGKTETPDWESLIADASELLIFDSPDASEAFRCFMMQRASNSEARFRNGVEKQTMQHDSNKEPESANAIPYEVNSGVISQAVSLLHRGIRRRCLDFEMPGNKQTSSENNTAACESSSRCVVPSIGLHLNAILMSSKDCKTNVTQDYSCSANIQVGLQRSISTLQDSLDQTENEIREDADQDVPVEPALQELNLSSPKKKSYCECFAAGVYCIEPCSCIDCFNKPIHEDVVLATRKQIESRNPLAFAPKVIRNSDSVQETGDDASKTPASARHKRGCNCKKSNCLKKYCECYQGGVGCSINCRCEGCKNAFGRKDGSSIDMEAEQEEENETSEKSRTAKSQQNTEVLMRKDMSSALPTTPTPIYRPELVQLPFSSSKNRMPPPQSLLGGGSSSGIFNSQYLRKPDISLSQSRIEKSFETVAVDGAEQMPEILIHSPIPNIKSVSPNGKRVSPPHMESSSSGSILGRRNGGRKLILQSIPSFPSLTPQH

SEQ ID NO: 330 - protein, 338 aa, Triticum aestivum
  misc_feature (233)..(233): Xaa can be any naturally occurring amino acid
MAACRGGGGGKDVDRIKGPWSPEEDDALQRLVGRHGARNWSLISKSIPGRSGKSCRLRWCNQLSPQVEHRPFTPDEDDTILRAHARFGNKWATIARLLSGRTDNAIKNHWNSTLKRKYSSSSSASASPAEDGAAMADDEDRRPLKRTSSDGYPGLCFSPGSPSGSDLSDSSHQSLPSVMPSAASQQPHVYRPVARAGGVVVLPTATPQPPQPSPPSPPAAPSSSGEVGLALPXLARPGCARASPGGRSLCPWPPPPAPVQPAAAPQMPPPPPMPFQLQPPPGPPATDGGAPLRGGFLSMMQEMIRIEVRNYMSGFDPRSSPADGVHAAKRMMSMAKIE

SEQ ID NO: 331 - protein, 318 aa, Oryza sativa Japonica Group
MDFPGDAEDFALEFIREHLLGGDAPVLPPAAVPAAAAYLPTSTMFLPQQQRGYAGLTPQEYVVDSAPAADQAAFRDDQPDPAADVMIMFGGERFPAVKPSSSSSPSLTVTVPPSSFGSWAPAAVPAVAATAAAVEDFRKYRGVRQRPWGKFAAEIRDPKRRGSRVWLGTYDTPVEAARAYDRAAFRMRGAKAILNFPNEVGTRGAELWATPPPTNKRKRQPEDDTAAADDVEVIGVANKAVKTEAPTSAYSSSSLSSMSRDTTATTSSAGTSTGSSEPTSFPVVTPSSWSWDQYWDGLPPLSPLSPHPALGFPQLTVS

SEQ ID NO: 332 - protein, 364 aa, Arabidopsis thaliana
MTKKLDPPTAPSSDEDDVETSEDDSSSSEEDEPIKSLPATTAAAPAKSTAVSAATPAKSTAVSAAAPSKSTAVSAAADSDSGSESETDSDSESTDPPKSGSGKTIASKKKEDPSSSSATLALPAVKSGAKRAASEAATTSTKRVKKDEESVKKPALFQRLWSDDDEISMLQGMIDYHADTGKSPSADTNAFYEFQKKSISFEVSKSQFSDKVRSLRKKYRAKEGKDEPRFVKAHDKKAFVLSKFIWGPKGIALDSNAKSNGVSKKNASKTKEKLDSVKQDLAFVGVSSTNGDDWFEKSSLARMIAGSGIDEYYVRQKWSSFTLETKKIVEEKFQLMQAKELEAKLEKNVRLTDLTSYFVDASKN

SEQ ID NO: 333 - protein, 305 aa, Striga asiatica
MTPPFSGIEGQNQFNAHLMASSSSADCITQNTLGLKERNYLGLSDCSSVDSSTVSSSPDEGKTNLNLKATELRLGLPGSQSPKRDLDFSLLSSVNKLDEKQLFPLVPNTVIVSGNKRGFSDTVNANWMFNADSGLPKTTVKKEAPEKDTVEFSNKMNGSNTNNAPAAKAQVVGWPPIRSFRKNTLAITSKVNDEVDGKPGPSALYVKVSMDGAPYLRKVDLRSYATYQELSSALEKMFSCFTIGQCGAQGTENVLTYEDKDGDWMLVGDVPWEMFIASCKRLKIMKGSDAIGLAPRAVEKSKNRN

SEQ ID NO: 334 - protein, 285 aa, Arabidopsis thaliana
MRFVPYLYEIERLWLSLVNYLSPRKNKNRRCGEIDKIRMVKKGGTKRKIAIETIQKSDYLRVTCTKRREGLFSKASQLCLLSDAQIAILATPPTSESNISFYSFGHSSVDAVVSSFLSGQRCVPLQEDTKEMREDVAICLSRTNLGLGFWWNNESLNKSENPQEISDAINSMLTLLSNLKELSGEEALVNDHKDLKKNERSDVVLQHGTQYETLNPNSNTTTICCVPDELPANSNEIVGISPNPLIMLEKKKSQIEEKFEKEWQVSVTRIENEATSSYAKRRRSI

SEQ ID NO: 335 - protein, 493 aa, Arabidopsis thaliana
MDNGNDQQIDVGSVVEAVSADHSFGAPLYVVESMCMRCGENGTTRFLLTLIPHFRKVLISAFECPHCGERNNEVQFAGEIQPRGCSYHLEVSAGDVKTFDRQVVKSESATIKIPELDFEIPPEAQSGSLSTVEGILSRAADELSALQEERRKVDPKTAEAIDQFLSKLRACAKAETSFTFILDDPAGNSFIENPHAPSLDPSLTIKFYERTPEQQATLGYLTNPSQTGQSERSLGTPSTQTTALPHGTIGATAGHRAIAQSNSTDISDNLFRYSAPEEVMTFPSTCGACTKLCETRMFVTKIPYFQEVIVMASTCDDCGYRNSELKPGGAIPEKGKKITLSVKNITDLSRDVIKSDTAGVKIPELDLELAGGTLGGMVTTVEGLVTQIRESLARVHGFTFGDSLEQSKINKWKEFGSRLTKLLSLEQEWTLILDDELANSFISPVTDDIKDDHQLTFEEYERSWEQNEELGLNDIDTSSADAAYESTEPTKLP

SEQ ID NO: 336 - protein, 250 aa, Salix discolor
MGRGRVQLKRIENKINRQVTFSKRRTGLLKKAHEISVLCDAEVALIVFSHKGKLFEYSTDDCMEKILERYERYSYEERQLAATDFDSPGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPALWDDQQNQGPHASSFLLSQPAGLPLPCLNIGGCYQEETDPEVRRNELDHALEPTYSFHLGGYGA

SEQ ID NO: 337 - protein, 150 aa, Zea mays subsp. parviglumis
MDWDLKAAGAWDLAELEQDHAAAAPSSGGHAANAAAAGTGTDSRPPAPGAAGAPAECSVDLKLGGMGECEPGAARREREAAAGAAKRPRPAGPGGQQQQQCPSCAVDGCRADLGKCRDYHRRHKVCEAHSKTPVVVVAGREMRFCQQCSR

SEQ ID NO: 338 - protein, 394 aa, Zea mays
  misc_feature (216)..(216): Xaa can be any naturally occurring amino acid
MEVCSPSDDVMEAQRRQREPTQAGGCSDDPRAVLTCLTFLEQKIAHLRGIISAAPRPPRQMVSAELSCIAVQLVSLSKSLAAAGGAADLDDGAARSPAPNDGGDSDSSDHDPFHADADADDDGRLPPAGSYEVIELGEEEILAPHVHSCKVCGKGFKRDANLRMHMRGHGEEYKTAAALAKPAAAAAATAQSSSSSSARCFYSCPFVGCKRNREAXHRSFQPLKTAVCVKNHYRRSHCDKSYTCRRCNVKRFSVLADLRTHEKHCGRDRWVCSCGTSFSRKDKLFAHVAAFDGHAPALPPEDDAAAHNVADGGLGTDSYRRLTTMDTEAASLEFFSDTMLDALSCSDIEGFALMDGQGQCLDDDGRGSLSPWPVGLDSCDFDGFDLFGAPPIDF

SEQ ID NO: 339 - protein, 150 aa, Zea mays subsp. parviglumis
MDWDLKAAGAWDLAELEQDHAAAAPSSGGHAANAAAAGTGTESRPPAPGAAGAPAECSVDLKLGGMGECEPGAVRREREAAAGAAKRPRPAGPGGQQQQQCPSCAVDGCRADLGKCRDYHRRHKVCEAHSKTPVVVVAGREMRFCQQCSR

SEQ ID NO: 340 - protein, 401 aa, Arabidopsis thaliana; identical to SEQ ID NO: 238

SEQ ID NO: 341 - protein, 409 aa, Oryza sativa
MGAHGDHRHHHHHQEAGVLVDEEEEEVIEQACGGPTSGVVEQEVGGDGGGVCQDAAGMVFEATSSVGSVSATMGPPPIMCWPPPAQSVHGAIHHHHNLGGGGGQQSPFFPLLPPLPPQPPPPPPFFADFYARRALQYAYDHSGGASSSSDPLGLGGLYMGHHGSHVAGMMMPPPFAPSPFGDLGRMTAQEIMDAKALAASKSHSEAERRRRERINAHLARLRSLLPNTTKTDKASLLAEVIQHVKELKRQTSEITEEACPLPTESDELTVDASSDEDGRLVVRASLCCDDRTDLLPDLIRALKALRLRALKAEITTLGGRVKNVLVVTGDDSAAAAACAGTDGDGEQQEEAMQAPMSPQHTVASIQDALRAVMERTASATEESGGSGAGGGLKRQRTTSLSAILENRSI

SEQ ID NO: 342 - protein, 789 aa, Oryza sativa Japonica Group
MPAPSRRNGYIRIDCYGGLNQLRRDLCDGIAVARLLNATMVLPKFEVAAYWNESSGFADVFDVDYFIEQTRGYVEVVKDMPEEIASKEPFKVDCSKRKGHFDYVETVLPALLEHQYISLTPAMSQRRDRNPSYAKASYCQGCYNALRLNKNVETKAIELLQAIPKPFLSLHLRFEPDMVAYSRCVYTGLSSKSLSAIEAARGEDRKALTGEAALLWRNRGKCPLTPSETAFILKALGIPTDTNIYLAAGDGLMELEGFTSIYKNIYTKSSLLTHDDFEKMHGNTKAALDYYVSVSSDAYVATFFGNMDKMVTAMRTMQGHQKTLVLSRRAYANYTAVGLSGEQLAMAMWDAHREEYIMGRGSALPEQCFCEFKLIFRCANMDENFTAIESNADDKEETVLGEMGFHSQHGGWALWREAGSRTEMHLGPPSVSPAYCFDFSALHYSYRFCSVELGRKLDASMMTDYFNYSYSSYQCSSASSAIKGTRVDRLREASDTGHHRGRHKRARSSPPRHDDEPPPPPPLSPAVTGGAHGGAAWHSTVLAEDVESAVIVAALTHVISSTAAEVTTAVPPVTVAPQRAATATMFGQQVMQQPPRGFPPLPSSSGSAATAPEQQQPRRRYRGVRQRPWGKWAAEIRDPVKAARVWLGTFDTAEDAARAYDAAAVRFKGSKAKVNFPDEVAGRQHRRRPAATPSSTPPPNVTAAAAGAGASEATLQPRRRPEHHTGARSRRRRRSAAGGVPRPQQLRAHTAERRPGVRLPRRGFCRTNDDSWAIVVVVVIVDAAAIRGS

SEQ ID NO: 343 - protein, 150 aa, Zea mays subsp. parviglumis
MDWDLKAAGAWDLAELEQDHAAAAPSSGGHAANAAAAGTGTESRPPAPGAAGAPAECSVDLKLGGMGECEPGAARREREAAAGAAKRPRPAGPGGQQQQQCPSCAVDGCRADLGKCRDYHRRHKVCEAHSKTPVVVVAGREMRFCQQCSR

SEQ ID NO: 344 - protein, 365 aa, Oryza sativa
MDPRFPPPAPSGGAPPRGHHRRAHSETFIRLPDADLLLDPDGEFGFSDLDFPSLSDDSPAASDPTPPPPPPALPQAAPRPPGGAHLRSLSLDAAFFDGLAFQGGGGGGGAGSGSSGGGAGHKRSGSMDGESSLFEGESAPPDYAKKAMPADRLAELALLDPKRAKRILANRQSAARSKERKIKYTGELERKVQTLQTEATTLSTQLTLLQAYWDAMIIKSVSLCLVVFILNCEYRYSSVLANCTFQDKQRDTSGLTAENRELKLRLQSMEEQAKLRDALNDALREEVQRLKIAAGQVPNMNGNSFNGGLQQQQQQQMPTYFSQQQQMHYLSGHQGRHHHPNNPHNSLNGGQSMSGQTLNDSMDFM

SEQ ID NO: 345 - protein, 200 aa, Ostreococcus tauri
MLKIPAVKWTVEEERALRDGVQKYGAGKWRAIQLDPTFGLALNHRSNVDLKDKWRNLHANGGSAEAEPTATEVKLGAMTREVSSSGREQSGEKAAKRRKEDESEDASGGRALTGAHEAQVNELMAETQRAKREAETALAAATEAEREAERAEREAWEAEKLASELVTEAHRQKVGLPVEGAEDVADVAAELLDEDERGGG

SEQ ID NO: 346 - protein, 150 aa, Zea mays subsp. parviglumis
MDWDLKAAGAWDLAELEQDHAAAAPSSGGHAANAAAAGTGTESRPPAPGAAGAPAECSVDLKLGGMGECEAGAARREREAAAGAAKRPRPAGPGGQQQQQCPSCAVDGCRADLGKCRDYHRRHKVCEAHSKTPVVVVAGREMRFCQQCSR

SEQ ID NO: 347 - protein, 88 aa, Triticum aestivum
  misc_feature (41)..(41): Xaa can be any naturally occurring amino acid
MSSESLGKNSKIMGGRERKEVNSTAKHFVDFTEAEEDLVFXRMHRLVGNRWELIAGRIPGRTAEEVEMFWGKKAPRTNENENRMHAVK

SEQ ID NO: 348 - protein, 504 aa, Cissus discolor
  misc_feature (235)..(259): Xaa can be any naturally occurring amino acid
SDMAEVAQKLEQLEEVIVNAQGDGLTYLASETVHYNPSDLSNWLGNMLSESNANFTPNCSLDNPFLPPISPLDYTNCSTQPKQEPSIFDSPSLDYDLKAIPGKALYPHIEQPPPPPPPPPQPAPAPIYGRESKRLKPTTSAATTANPVSSVVGGWAVPAEAARPVVLVDSQETGIRLVHTLMACAEAVQQENLKLAEALVKQIKLLAVSQAGAMGKVAFYFAQGLAGRIYGLYPXXXXXXXXXXXXXXXXXXXXXXXXXAHFTANQAILEAFEGKKRVHVIDFSMKQGMQWPALMQALALRTGGPPSFRLTGIGPPSTDNTDHLQEVGLKLAQFAETIHVEFKYRGLVANSLADLGASMLDLREDESVAVNSVFELHSLLARPGGIEKVLSTVKDMKPDIVTIVEQEANHNGPVFLDRFTESLHYYSTLFDSLEGCAVSPVSAQDKLMSEEYLGQQICNVVACEGAERVERHETLTQWRARLGSAGFDPVNLGSNAFKQASMLL

SEQ ID NO: 349 - protein, 303 aa, Avicennia marina
MKGGDQQLNLPAGFRFHPTDEELVVHYLCRKCAGQQIGVPVIAEIDLYKFDPWELPDLALYGEKEWYFFSPRDRKYPNGSRPNRAAGTGYWKATGADKPVGKPKTLGIKKALVFYAGKAPRGVKTNWIMHEYRLANVDRSAGKTKNLRLDDWVLCRIYNKKGTLEKHLSVDQKEVQFSDSEEQKPEVDAFPFGDMVMPGPAPPVQAPVTLASQRMNDYMHFDASDSFPKLHTDSSSSEHVLSPEFMCDKEVQSAPKWSELESTLDFPLIYMDGFQDDPFGSQMQYGDQLSLFPDMYAYMQKPF

SEQ ID NO: 350 - protein, 301 aa, Populus trichocarpa
MQEPNLGMMGSGSGGALGGLSSGEMSVSLSGDQSRQLKAEIATHPLYEQLLSAHVSCLRVATPIDQLPLIDAQLSQSHHLLRSYASQHNQHGHSLSPHERQDLDNFLAQYLIILCTFKDQLQQHVRVHAVEAVMACREIETTLQALTGVTLGEGTGATMSDDEDDLQMDFSLDQSSADGHDMMGFGPLLPTESERSLMERVRQELKIELKQGFKSRIEDVREEILRKRRAGKLPGDTTSVLKNWWQQHSKWPYPTEDDKAKLVEETGLQLKQINNWFINQRKRNWHSNSQSVTSLKSKRKR

SEQ ID NO: 351 - protein, 213 aa, Brassica napus
MEATQKHTIQDGSSMFYHQPSVKQMDISVQTFDSYCTLESSSGTKSHPCPNNNITSSTTSFSSNGSPVSHSNTNNNTSHLSPDNNNSPLSGSSATNNNETELSLMLKDLETAMMEPDLDNNSFNGYEFGQQQQQQHHRAASSAMYRSMEMISRGDLKGTLYECAKAVENCDVAMTDWLISQLQQMVSVSGEPVQRLGAYMLEGLVARLASTGS

SEQ ID NO: 352 - protein, 258 aa, Cissus hastata
HFYETCPYLKFAHFTANQAILEAFEGKKRVHVIDFSMKQGMQWPALMQALALRPGGPPSFRLTGIGPPSTDNTDHLREVGLKLAQFAETIHVEFKYRGLVANSLADLDASMLDLREDESVAVNSVFELHSLLARPGGIEKVLSTVKDMKPDIVTIVEQEANHNGPVFLDRFTESLHYYSTLFDSLEGCAVSPVSAQDKLMSEEYLGQQICNVVACEGPERVERHETLTQWRARLGSAGFDPVNLGSNAFKQASMLLAL

SEQ ID NO: 353 - protein, 250 aa, Salix discolor
MGRGRVQLKRIENKINRQVTFSKRRTGLLKKAHEISVLCDAEVALIVFSHKGKLFEYSTDDCMEKILERYERYSYEERQLATTDFDSQGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPAPIWDDQQNQGPHASSFLLSQPAGLPLPCLNIGGCYQEEAPEVRRNELDHALEPTYSFHLGGYGA

SEQ ID NO: 354 - protein, 175 aa, Zea mays
MQNQIMCHACRTLLLYPRGASSVCCAVCQAITTVPPPGLEMAQLICGGCRTLLMYTRSADTVRCSCCNTVNLVRPVNNIAHVNCGQCRTTLMYPYGAPSVKCAVCNYVTATGVNTVAPTPSARPTSDGSSYSGSSTSAPKSQSQNVTVVVENPMTVDDKGKLVSSVVVGVTAGKE

SEQ ID NO: 355 - protein, 97 aa, Mirabilis jalapa
KSYQDLSDALGKMFSSFTLGNYGSQGMIDFMNESKLMDLINGSDYVPTYEDKDGDWMLVGDVPWEMFVESCKRLRIMKGKEAAGLAPRAMEKCKNRI

SEQ ID NO: 356 - protein, 93 aa, Mirabilis jalapa
VKVSMDGAPYLRKIDLKVYQSYAELLRGLENMFKVRIGSYSERDGYNGSDYVPTYEDKDGDWMLVGDVPWEMFISSCKRLRIMKSSEAKGLGS

SEQ ID NO: 357 - protein, 279 aa, Oryza meridionalis
QPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPPYAAAAAAPSSVQYGGVGAAPHIGSYGHHHHHHHHHGHGAAASGASSMGECSTMPVMVPVDPHRSSMSSSLLDMDRNDHDFLFSSADDNSGYLSSVVPESCLRPRGGGAAADHQDMRRYSDADAYGMMGLREDVDDLAQMVAGFWGGGDAADQLGACGFPASGGGADMVASSQGSDS

SEQ ID NO: 358 - protein, 622 aa, Saccharomyces cerevisiae
MSFSTINSNVNKTTGDSNNNTTENSSTADLLGMDLLQSGPRLMNTMQPNNSSDMLHINNKTNNVQQPAGNTNISSANAGAKAPANEFVRKLFRILENNEYPDIVTWTENGKSFVVLDTGKFTTHILPNHFKHSNFASFVRQLNKYDFHKVKRSPEERQRCKYGEQSWEFQHPEFRVHYGKGLDNIKRKIPAQRKVLLDESQKALLHFNSEGTNPNNPSGSLLNESTTELLLSNTVSKDAFGNLRRRVDKLQKELDMSKMESYATKVELQKLNSKYNTVIESLITFKTINENLLNNFNTLCSTLANNGIEVPIFGDNGNRNPTGNTNPATTTAIQSNNNTNNASPATSTVSLQLPNLPDQNSLTPNAQNNTVTLRKGFHVLLVEDDAVSIQLCSKFLRKYGCTVQVVSDGLSAISTLEKYRYDLVLMDIVMPNLDGATATSIVRSFDNETPIIAMTGNIMNQDLITYLQHGMNDILAKPFTRDDLHSILIRYLKDRIPLCEQQLPPRNSSPQTHSNTNTANSNPNTINEQSLAMLPQDNPSTTTPVTPGASISSAQHVQQGQQEQQHQIFHAQQQQQHHNAIANARSDVAIPNLEHEINTVPHSSMGSTPQLPQSTLQENQLS

SEQ ID NO: 359 - protein, 279 aa, Oryza longistaminata
QPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPPYAAAAAAPSSVQYGGGVGAAPHIGSYGHHHHHHHHHGHGAASGASSVGECSTMPVMVPVDPHRSSMSSSLLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDS

SEQ ID NO: 360 - protein, 409 aa, Vitis vinifera
MKALQATLFSLPFLLLLLLLLLPAPYFYFSFSSREPANPGVLKVDHKHGKRSVPSGASEEKEEDPIFPVYPAAQSQRDTSAMISAFADHQDIGSWDNRLAHGYHGQGSLLAASVSSMRQHGLSQPPQDRGLNPGFLSLTLCFNQQILNYVNWPGREGSARKRHYRGVRQRPWGKWAAEIRDPKKAARVWLGTFDTAEAAAAAYDAAALNFKGTKAKLNFPERVQGGSHSHSHSPSPSHYSRPITVPPPSPPPPPPPPPPPQPYSPSPPFAPPFPVQEEFPNLLQYAQLLCSNTDDDLSNATSALYDQQTFASQGLSNPSAVSQQHRQVEEELLRVSSDMGSSYVSSFCGRPCTSKQMLSASCQPLRLSIFTSLIRFVTVVVVFSVPSKSQVEEAGQIDLFATWLPSSTF

SEQ ID NO: 361 - protein, 279 aa, Oryza glumipatula
QPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPQYAAAAAAPSSVQYGGGVGAAPHIGSYGHHHHHHHHHGHGAASGASSVGECSTMPVMVPVDPHRSSMSSSLLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDS

SEQ ID NO: 362 - protein, 368 aa, Solanum tuberosum
NSSTYTQFVASRRMGICEPIHQMGMWDDFNASCPSTSATMILEVEKCLEDQIPNMIETEDTSHGTVGTSNRYEAETSKPIEKVLRRLAQNREAARKSRLRKKAYVQQLENSKLKLIQLEQELDRARKQGLYVGAGLDASQLSYSVTASSGTAVFDTEYGQWVEEQNRQTNDLRNALHHSQISEAELRIIVDGCLNHYFELFRVKATAAKADVLYIMSGMWKTSAERFFMWIGGFRPSELLKVLTPHLELLTEQQLREVCNLRQSCQQAEDALSQGMVKLHQILGEAVAAGRLGEGNYSLPQMGPAIEKLEALVRFVNQADHLRQETLQQMSRILNTHQAAQGLLALGEYFEQLRVLSSHWATRLHEPA

SEQ ID NO: 363 - protein, 368 aa, Solanum tuberosum
STYTQFVASKRMGICDPIHQIGMWGDFKGSSFPDTLILEVENCLENEMPIMEKRLENEIEEPSQVTVGMSNRYEPETTKRIDKVRRRLAQNREAARKSRLRKKAYVQQLENSKLKLLQLEQELERNRQQGLYVGDGLDASQIGCSGTANSGIASFEMEYGHWVEEQDRQTDDLRNALHNSQMGEIELRILVESCLNHYFDLFRLKATAANADVLYLMSGTWKTSAERFFLWIGGFRPSELLKVLTPHVEPLSDQQIQEVSNLTQSCQQAEDALSQGMVKLHQILAEAVAAGTLGEGIILPQMTATIEKLEALVRFVNQADHLRQETLLQMSCILAAHQSAQGLLALGEYFKRLRALSSLWAGRLSEPA

SEQ ID NO: 364 - protein, 166 aa, Sorghum bicolor
MGRIPCCEKDSVKRGPWTPEEDNKLLSYITQYGTRNWRLIPKNAGLQRCGKSCRLRWTNYLRPDLKHGEFTDAEEQTIIKLHSVVGNRWSVIAAQLPGRTDNDVKNHWNTKLKKKLFGMGIDPVTHKFFSHLMAEIRHHAGAAAGGAPRRGPRLVCFKGRNAPPSS

SEQ ID NO: 365 - protein, 150 aa, Zea mays subsp. parviglumis
MDWDLKAAGAWDLAELEQDHAAAAPSSGGHAANAAAAGTGTESRPPAPGAAGAPAVCSVDLKLGGMGECEAGAARREREAAAGAAKRPRPAGPGGQQQQQCPSCAVDGCRADLGKCRDYHRRHKVCEAHSKTPVVVVAGREMRFCQQCSR

SEQ ID NO: 366 - protein, 311 aa, Oryza sativa Japonica Group
MGGGGGVEADCDRIRGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRKLAVATTTTTTTTGAAAAPGVVADAAELVERPCKRFSPTPDSPSGSGSGSDRSDLSHGGGFGQIFRPVARTGAFEPVDCAISRRQEEDPFTSLSLSLPGTDQRFNHDSAHSHFQELPSSPSPPPPPPPAAAASTTQYPFTPEFAAAMQEMIRAEVHKYMASVGVRAGCGDAGGADLHMPQLVEGVMRAAAERVGRMH

SEQ ID NO: 367 - protein, 227 aa, Glycine max
MVREKIQIKKIDNATARQVTFSKRRRGLFKKAEELSVMCDADVALIIFSSTGKLFEYSSSSMKEILERHHLHSKNLARMEQPSLELQLVENSNCSRLSKEVAEKSHQLRQLRGEDLQGLNIEELQQLERSLETGLGRVIEKKGEKIMSEITDLQRKGMLLMEENERLKRHVAGIINGQRHGGAESENFVMDEGQSSESVTYVCNSTGLPQDYESSDTSLKLGLPYSG

SEQ ID NO: 368 - protein, 385 aa, Trifolium pratense
MCGGAIISDFIPAAAAVGGSRRVTADILWPNLRKTGSKKSSFLLDDDFEAGFRQFKDDSDFDEDEDEDDDEGLLVGVKGFTFAASNNKSSRNFSRGSAGAKSVASKSNEQAEKESKRKRKNQYRGIRQRPWGKWAAEIRDPRKGVRVWLGTFNTAEEAARAYDAEARRIRGKKAKVNFPDEAPNASSKRLKTNPDNQLLNKNLNSFKPNGNNKMFNFSENMENFYSPMDQVEQKPLVNNQYGAADIGAFTGNGVHLAPADVNAYFSSEHSSNSFDYSDLCWGEQGPKTPEISSVFSAPLEAEPQMNMQSNNSQDMLPMQAESAKTLSEELADIESQLKFFENSFDDNWSDASLASLLGADVTQDAGNTMNLWSFDDLPSIAGGVF

SEQ ID NO: 369 - protein, 345 aa, Triticum aestivum
KVCKRYRQYYQQLQAVISSFETVAGLSNAAPFASIALRTMSKHFKYLKSTIQSQLRNTSKVAGGKDSLGKEDMANFGLMAGGAALMRGSNANAFSQPHNIWRPQRGLPERAVSVLRAWLFEHFLHPYPTDSDKQMLAKQTGLTRNQVSNWFINARVRLWKPMVEEIHNLEMRQGHKSSAADKNQLGPQQQTQQHSPDSSGRPSDPSNPHQGQSSSMSQDRSAHAAHRHIQSELSPMTHDMPGQVSFAYNGGGMAAHHHGSIALSHPQHVEGGAGSSGGVSLTLGLHQNNRAYIAEPLPAALPLNLAHRFGLEDVSDAYAMAASFGGQDRHFTKEMGGHLLHDFVG

SEQ ID NO: 370 - protein, 278 aa, Datura metel
MGRAPCCEKMGLKKGPWTPEEDQILISYIQSNGHGNWRALPKLAGLLKCGKSCRLRWTNYLRPDIKRGNFTREEEDSIIQLHEMLGNRWSAIAARLPGRTDNEIKNVWHTHLKKRLKNYQPPQTSKRHCKNNNDSKAPSTSQIALKSSHNFSNIQEDINGPGPGPNSPQRSSSEMSTVTADSLAVTMGITNGGGHMDSSENFIPEIDESFWTDDLSTADNSNFNMVGSGGEELQVQFPFHAMKQESVEMDVGAKLEDDMDFWYNVFIKSGDLLELPEF

SEQ ID NO: 371 - protein, 325 aa, Triticum aestivum
MAWWAGSMGGLDLRNHLAQFGGPAAGGAAMGGAEQAPTTPNSSGSNNHDDSSGAAQDSPTAGAGDNSPNPNAAISGSGPSGGGGGSGGGGSSSGRRPRGRPAGSKNKPKPPIIITRESPNTLRSHVLEIASGADIMEAVSTFARRRQRGVSVLSGSGVVGNVTLRQPAAPPGSVVTLHGRFEILSLSGAFLPSPCPPGATGLAVYLAGGQGQVVGGTVIGELVASGPVMVVAATFSNATYERLPLADEEPGEAAAAATGSDGMQLPDGPAPGGNGGMGAAVGVPGLPDPSSMPFYNLPPNLQMPNGGGQMAHDVFGSFRPPPPAF

SEQ ID NO: 372 - protein, 121 aa, Glycine max
  misc_feature (46)..(46): Xaa can be any naturally occurring amino acid
RIWQIVADLQSPKRGGSLVVETGFPTSLIDLFVKNRSRFQKHRSKXNHRRRRRQNPSPPPIRLPRRLPLRPPLRRHASPPLQPLQYNETTPPFRLRIESPSALLSPVGCERCRSRREDSDG

SEQ ID NO: 373 - protein, 379 aa, Oryza sativa Japonica Group
MSSGGGGGGGGDRHGPYHQHGHLGRGEGADYVYSSSDMESFFFSQPGGVGIGGGGGGVVGAGGADEIMPYSSITDYLQGLLDPSGLARHLDVACPSSQDTVVKQELSVDVTSHDSQGTGGVAGEGVAQATPNSSASFSSSDGEAEGGKSSRRCKKGQAKAEEEDDKDEEDGENSKKPNKPKKKAEKRQRQPRVAFLTKSEVDHLEDGYRWRKYGQKAVKNSPYPRSYYRCTTPKCGVKKRVERSYQDPSTVITTYEGQHTHHSPASLRGGGGGVGIVGGHHHHHLFMPGVHGLPPSHLMPAGFHPELMGLMHHHPAMAAAAANPSMYFPGVAASAPPPPAVAGGGAMPPNDHPPLQQHHFTDYALLQDLFPSTMPSSNP

SEQ ID NO: 374 - protein, 236 aa, Zea mays
  misc_feature (89)..(89): Xaa can be any naturally occurring amino acid
MVGTGKRERIAIRRIDNLAARQVTFSKRRRGLFKKAEELSILCDAEVGLVVFSATGKLFHFASSSMKQVIDRYDSHSRTLQGSEPQSSXLQSHMDDGTCARLKEELAETSLKLRQMGGGELPRLGVGQLQELGKTLESGLGFVLKTKSQKILFEISGLERKRTQLIGGNSRLKGQVTRMSGVGGQLGADPEFVFGEGQWFEFVRDTSYPPPPRPCKDKSFTCNFRYGNYRIIFFWR

SEQ ID NO: 375 - protein, 433 aa, Arabidopsis thaliana
MCSVSELLDMENFQGDLTDVVRGIGGHVLSPETPPSNIWPLPLSHPTPSPSDLNINPFGDPFVSMDDPLLQELNSITNSGYFSTVGDNNNNIHNNNGFLVPKVFEEDHIKSQCSIFPRIRISHSNIIHDSSPCNSPAMSAHVVAAAAAASPRGIINVDTNSPRNCLLVDGTTFSSQIQISSPRNLGLKRRKSQAKKVVCIPAPAAMNSRSSGEVVPSDLWAWRKYGQKPIKGSPFPRGYYRCSSSKGCSARKQVERSRTDPNMLVITYTSEHNHPWPIQRKALAGSTRSSTSSSSNPNPSKPSTANVNSSSIGSQNTIYLPSSTTPPPPPPTLSSSAIKDERGDDMELENVDDDDDNQIAPYRPELHDHQHQPDDFFADLEELEGDSLSMLLSHGCGGDGKDKTTASDGISNFFGWSGDNNYNNYDDQDSRSL

SEQ ID NO: 376 - protein, 372 aa, Nicotiana sp.
MNSTYTQFVASKRMGICDPIHQIGMWGDFKNSSFPDTSATLILEVENCLENEMPIMEKRPHNETEELSHGTVGTSNRYEPEARKPIDKVLRRLAQNREAARKSRLRKKAYVQQLENSKLKLLQLEQELERTRQQGQYAGVGLDESQIGYTGTANSGIVAFEMEYGHWVEEQDRQTDELRSALNSQVGEIELQLLVEGCLNHYFDLFRMKAAAAHADVLFLMTGTWKTSAERFFLWIAGFRPSELLKVLTPNVEPLTEQQLRDVCNLMQSCQQAEDALSQGMVKLHQILAEAVAAGTLGDGIILPKMAATIENLEALVRFVNQADHLRKETLLQMSCILTPQQSAQGLLALGEYFKRLRALSSLWTSRTSEPA

SEQ ID NO: 377 - protein, 218 aa, Triticum aestivum
NKVEELSFGDQATEHREEASWTSLAGTSKESDLAELSIHGMLSPVGQGLSPAGAQTSAQGSKGKRRTKTEKTVSLPVLRQYFAGSLKDAARSLGVCPTTLKRICRQHGINRWPSRKIKKVDHSLRKLQQIIDSVHGGETAFQLNTLYKDLTNTSVSSDNNLSGSVTVPPHKQSNLTDFEGHRHHRLSSIVPSTSHSHSSCSQSSDSSPSSCSGGSTKH

SEQ ID NO: 378 - protein, 308 aa, Arabidopsis thaliana
MNWLPEAEAEEHLKGILSGDFFDGLTNHLDCPLEDIDSTNGEGDWVARFQDLEPPPLDMFPALPSDLTSCPKGAARVRIPNNMIPALKQSCSSEALSGINSTPHQSSAPPDIKVSYLFQSLTPVSVLENSYGSLSTQNSGSQRLAFPVKGMRSKRRRPTTVRLSYLFPFEPRKSTPGESVTEGYYSSEQHAKKKRKIHLITHTESSTLESSKSDGIVRICTHCETITTPQWRQGPSGPKTLCNACGVRFKSGRLVPEYRPASSPTFIPSVHSNSHRKIIEMRKKDDEFDTSMIRSDIQKVKQGRKKMV

SEQ ID NO: 379 - protein, 243 aa, Triticum aestivum
MVKNHPGSGTSRCDAAAAMAESGGGGGTAALCGGGSRQPAMAARQFKGVRMRSWGSWVSEIRAPHQKRRIWLGSYATPEAAARAYDAALLCLKGSDAVLNFPSSSSASPSSPHSLPSPANRHADDLSPRSIQRAAAAAAAAFEATRIVVDDSCSSSAEATTPTSFSVSTLGSADVQEHATSSMSAAASTGSPVGDQDELWTELDAFASPKLMDLIAAGHATPFSCTWEEPEEDGDMMRLWSFC

SEQ ID NO: 380 - protein, 347 aa, Petunia x hybrida
MEGGGNSSGNNTSSLMAYGDHENNNNAICPPMMMMMMPPPPLSITNTSNNGESSSNNNNNILFLPFMENNSNTIHEDGNSCSSNIKAKIMAHPHYPRLLAAYINCQKIGAPPEVVARLEEVCATSAHMGRNGGGGGGGGNNVIGEDPALDQFMEAYCEMLTKYEQELSKPFKEAMVFLSRIECQFKALTLASTSESVAAFGEAMDRNGSSEEEVDVNNSLVDPQAEDRELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYIDNVLGNPFPMDMTPTLL

SEQ ID NO: 381 - protein, 321 aa, Zea mays
MDNHIHSQPAANLYYQFGMGTEQQYPPPFASPPSTNIPHMDWNPATMLDNLTFIEEKIQQVKDVIRTMVDNAGQVQVQCHHQAGELLAQKQKQQVVNADLTCLIVQLISTAGSLLPSLKNSSFLSHPHPGGHVDMANHVGPSSSLVPNAMTVSEDYEELFKGWTDGAMEDGGIEVDDDGVLVEEQETKDGDSLSYELLQLEEDEILAPHTHFCTICGKGFKRDANLRMHMRGHGDEYKSPAALAKPPRDPGAEQEPAKRRYSCPFAGCKRNKLHKSFQPLKTILCVKNHYRRSHCEKSHTCGRCHAKKFSIVADLRTHEKH

SEQ ID NO: 382 - protein, 137 aa, Mirabilis jalapa
DSLSIPFVGSTFRSAIGNELPPGSEMSTTSCIDESGYLQSIENVDQTNQPTRTFVKVHKMGSFGRSLDISQFSSYQELRSELARLFGLENELKDSPRSGSQLVFVDRENDVLLLGDDPWQEFVKTVGHIRILSPQEV

SEQ ID NO: 383 - protein, 150 aa, Zea mays subsp. parviglumis
MDWDLKAAGAWDLAELEQDHAAAAPSSGGHASNAAAAGTGTESRPPAPGAAGAPAECSVDLKLGGMGECEPGAARREREAAAGAAKRPRPAGPGGQQQQQCPSCAVDGCRADLGKCRDYHRRHKVCEAHSKTPVVVVAGREMRFCQQCSR

SEQ ID NO: 384 - protein, 298 aa, Zea mays
MEDLYSIHPGISRHGAAATSEASGVAGGPGSPPPPPPPAADLTELVKAQIAGHPRYPSLLSAYIDCRKVGAPSEVATLLEEIGRERCAAASAGGEVVGMDPELDEFMETYCRLLERYKEELSRPLDEAASFLSNVRTQLSSLCGGAASLSDEMVESSEDEPCSGDTDATTDPGQEHSSRLADRELKEMLLKKYSGCLSRLRSEFLKKRKKGKLPKDARSALMDWWNTHYRWPYPTEEDKVRLAAMTGLDPKQINNWFINQRKRHWKPSEDMRFALMEGGVAGSSSGTTLYFDTGTIGP

SEQ ID NO: 385 - protein, 150 aa, Zea mays subsp. parviglumis
MDWDLKAAGAWDLAELEQDHAAAAPSSGGHAANAAAAGTGTESRPPAPGAAGAPAECSVDLKLGGMGECDPGAARREREAAAGAAKRPRPAGPGGQQQQQCPSCAVDGCRADLGKCRDYHRRHKVCEAHSKTPVVVVAGREMRFCQQCSR

SEQ ID NO: 386 - protein, 294 aa, Cucumis sativus
MGRPPCCEKVGIKKGPWTPEEDIILVSYIQQHGPGNWRSVPTNTGLLRCSKSCRLRWTNYLRPGIKRGNFTPHEEGMIIHLQALLGNKWAAIASYLPQRTDNDIKNYWNTHLKKKLKKLNSAAVDTPEPPESATTRFQSNDKVPTADSPSSLVSNRATTYASSAENISRLLQAWMRSSPEESRRKMSGENSIAAATQQQQQPKAEPDGGELVSGEEFDSILSFENMKSVNSWGKSSLSYKGKEEVNVGEKQSSENDDATAENATAPPLSFLEKWLFEEGAAGQVEEMMELSPVF

SEQ ID NO: 387 - protein, 150 aa, Zea mays subsp. parviglumis
MDWDLKAAGAWDLAELEQDHAAAAPSSGGHAANAAAAGTGTESRPPAPGAAGAPAECSVDLNLGGMGECEPGAARREREAAAGAAKRPRPAGPGGQQQQQCPSCAVDGCRADLGKCRDYHRRHKVCEAHSKTPVVVVAGREMRFCQQCSR

SEQ ID NO: 388 - protein, 312 aa, Arabidopsis thaliana
MVSHKVLEFGDDGYKLPAQARAPRSLRKKRIYEKKIPGDDKMCAIDLLATVAGSLLLESKSPVNACLVVQNTVKNEYPADENPVKAVPYSESPSLFDNGKCGFSSVITNPNHLLVGDKVGKEVEGFSSLGVSGDVKPDVVASIGSNSSTEVGACGNGSPNESRDDVNLFSRNDDDENFSGYIRTRMTRPVPRIGDRRIRKILASRHWKGGSKNNTDAKPWYCSKRSYYLHHHQRSYPIKKRKYFDSVYDSNSDDYRLQGKTHKGSRTISSMKSRNASFVSRDHHVKLRIKSFRVPELFVEIPETATVGSLKV

SEQ ID NO: 389 - protein, 354 aa, Nicotiana attenuata
MQSLKNNAQSNGGNQYNNQSSQSIREQKRSEDGYNWRKYGQKQVKGSENPRSYYKCTFPNCPTKKKVERSLDGQITEIVYKGNHNHPKPQSTRRSSSTASSSSAVQPYNTQTNEIPDHQSYGSNATPENSSISFGDDDHEHSSQKSRSRGDDFDEEEEEPDSKRWKRESESESLSAPGSRTVREPRVVVQTTSDIDILDDGYRWRKYGQKVVKGNPNPRSYYKCTSPGCPVRKHVERASQDIRSVITTYEGKHNHDVPAARGSGINRPVAPSITYNNGANAVRPFVTSQIPLQSIRPHQSPFTLEMLQKPSNYNGFSGYANSEDSYENQLQDNNVFSRAKDEPRDDMFMDTLLC

SEQ ID NO: 390 - protein, 271 aa, Vitis vinifera
  misc_feature (43)..(43): Xaa can be any naturally occurring amino acid
MQSFRPSQPFLGMDVTMEMVNQFAEMNPIMLENFNITDVSVEXLLAHQQPELMGTFAYNLQSSFESNGLSSMPVVQSMPSSGNAFHESKRRKVMEQSKSSSENISSMASGSGLKEISSTKKKNNLGKGKKGRNSDKELLDKPDEVIHVRARRGQATDNHSIAERVRREKIKTRLRCLQDLVPGCYKVYDPQNKGMAVMLDEIINYVHSLQNQVEFLSRELAAASSLHNFNSETEAIKNAQCFRVDRDHVGAGLTMLQSQGNGMLGGELPTP

SEQ ID NO: 391 - protein, 354 aa, Triticum aestivum
  misc_feature (131)..(131): Xaa can be any naturally occurring amino acid
  misc_feature (250)..(250): Xaa can be any naturally occurring amino acid
  misc_feature (260)..(260): Xaa can be any naturally occurring amino acid
  misc_feature (282)..(282): Xaa can be any naturally occurring amino acid
  misc_feature (291)..(291): Xaa can be any naturally occurring amino acid
  misc_feature (306)..(306): Xaa can be any naturally occurring amino acid
MDSSPSDLTLDYTPNGNGTASAGGGYPKQASPVVDHHHHLSAEQATTQKLQEFLARLDDERLKIDAFKRELPLCMQLLNQAMEAYRQQLEACQMGSHGGAAARAPLVLEEFIPLKNIGIDAAEKAAGEPAXRNKANWMVSAPPVGTGPAPGGTPGGQGAPKTPKERSEHPLDTSPMLGALDGGGGNGVGAFLPFTKEKACMAESAALPELGLAPAEKDREADRKPYHDDSGSNGTVVSRRDVGAPPTSTXREGQSVPPPXPQTKPEGRGCWSPDLHRRFRNXALKILGGAXQVATPKQIRELMKVXGLTNDEVKSHLRKVRLKTLRAESGNPRGPPPGATKLVVPGGILDPPGT

SEQ ID NO: 392 - protein, 330 aa, Oryza sativa
LRRRRARSEVAFRFPDDLGLGGGADGGGFDEIGSEDDLFSTFMDMEKIAGADRDRAAETSSPPRPTKHRHSASFDGFAFGAGAGGPGPGLGKQQDGAGGVFSEVMEAKKAMSSEQLAELAAIDPKRAKRILANRQSAARSKERKARYITELERKVQTLQTEATTLSAQLTLFQRDTTGLSAENAELKIRLQAMEQQAQLRDALNDALKQEVERLKIATGEMAKSNDAYNTGMQQVPYSPSFFQLSDQHAVQHHAGVQQLLHQFQQPHPSVPSHQMLSHPNSLSDMMQQDSLGRLQGLDIGKGPVAVKNEAEVVVKSEGSSISAGESNSTF

SEQ ID NO: 393 - protein, 502 aa, Cissus repens
EVAQKLEQLEEVIVNAQGDGLSYLASETVHYNPSDLSNWLGNMLSESNANFTPNCSLDNPFLPPISPLDYTNCSTQPKQEPSIFDSPSLDYDLKAIPGKALYPHIEQPPPPPPPPPPPAPAPIYGRESKRLKPTTSAATTANPVSSVVGGWAVPAEAARPVVLVDSQETGIRLVHTLMACAEAVQQENLKLAEALVKQIKLLAVSQAGAMGKVAFYFAQGLAGRIYGLYPDKPLDTSFSDMLQMHFYETCPYLKFAHFTANQAILEAFEGKKRVHVIDFSMKQGMQWPALMQALALRTGGPPSFRLTGIGPPSTDNTDHLREVGLKLAQFAETIHVEFKYRGLVANSLADLDASMLDLREDESVAVNSVFELHSLLARPGGIEKVLSTVKDMKPDIVTIVEQEANHNGPVFLDRFTESLHYYSTLFDSLEGCAVSPVSAEDKLMSEEYLGQQICNVVACEGAERVERHETLTQWRARLGSAGFDPVNLGSNAFKQASMLLAL

SEQ ID NO: 394 - protein, 218 aa, Medicago truncatula
MVTKTKNAANLKIKKPSNNNNNATEIHFRGVRKRPWGRYAAEIRDPGKKSRVWLGTFDTAEEAARAYDNAARQFRGPKAKTNFPPPPSDVKEDSPSQSSTVESSVPAPDREVTRREVPTGGSVMDRFPFLSIQQQIMPFAGAGAGAVDGMVPVFFYDPAGRAEFLNQRFTNRFEPEPVQFNIGFGGGVQSDSDSSSVVDCQPKRALNLDLNLAPPMEY

SEQ ID NO: 395 - protein, 421 aa, Physcomitrella patens
MGRKPCCEKVGLRRGPWTSEEDQKLVSHITNNGLSCWRAIPKLAGLLRCGKSCRLRWTNYLRPDLKRGIFSEAEENLILDLHATLGNRWSRIAAQLPGRTDNEIKNYWNTRLKKRLRSQGLDPNTHLPLEDSKLDDTEDDTDDEGGDSSDVTMSDASKSEKRSKKKSKPKETVKVRQPKGPKPAPQLKMCQSDEGPVLLKVPKAPKSPISVNPGPGCNYDDDSEHSSSSTVTTKSHEDHRDSSDFIKALTSVSSFPEAELWSCIKPITNSFSSTALLSEWDSYRAFDSSLFPSSYPQLNSGLPKLEDVNSKSSAVASPVQGMLPAYNPMGMEMQTRMQFSSQLTHEIGQNYGGIFQETCYPQPDMGMSWSMHAELSHCGTESLFATPNPANAPSNFEEVPQPSPCTTSQELQRLAALLDLI

SEQ ID NO: 396 - protein, 89 aa, Brassica napus
PPQLSKLVAALQSLSLSVLHLSVTTLETFAIYSISTKVEESCQLSSVDDIAGAVHHMLSIIEEEPFCCSTIPELPFTFPLNHTNATHSL

SEQ ID NO: 397 - protein, 320 aa, Glycine max
MSSGATHWCHACRQPVVLDGRDAVCPYCDGGFVQELDELEGIAPHHTFCSQSGEFHQMPDIFDAIPAFMGQRGSDQRSRLMDDAVDNFMRHRTAGRNSNFDVRGRSGSRPVPERSWGVFSSGPYLIFHGQVPGSTFAAGSPRGGSRHVDFGDYFMGLGLEELIEQLTMNDRRGPPPAALSSIDAMPTIKITQAHLRLDSHCPVCKEKFELGTEAREMPCNHIYHSDCIVPWLVQHNSCPVCRVELPPQGQASSRGTQNWGGRNDSNTSSSGSNDSSRGRENSRQNHGRRNPSSFLWPFRSSNSNNNHHSDTGGSSSSNHS

SEQ ID NO: 398 - protein, 248 aa, Glycine max
MLPLQRGNELVIQFSNSPHHHLQHKISEDLILDDYASLNVNDSNQKFITSSSSQPTKKLFYGANKKNHDYSNEHKKKMIHKEIERQRRQEMATFYASLRSLLPLEFIKGKRSISDHMNEAVNYIKHMQKHIKELGAKRDELKKLSNHSNNMENNHEGLHTSCNFTVHEKNGIMGIEITSVFREEKPKISKLLQFLTEEGLEVVSFFSTEVNGRLLHSVQCEVNHSNSVDPSELRKKVSKAFSTFRCSD

SEQ ID NO: 399 - protein, 285 aa, Oryza sativa Indica Group
MDVAGDAGGGRRPNFPLQLLEKKEEQPCSSSAAGGGTGPSSAGGNGNNGSGPGGAGGEMQLRKAAPKRSSTKDRHTKVEGRGRRIRMPALCAARVFQLTRELGHKTDGETIEWLLQQAEPAVIAATGTGTIPANFTSLNISLRSSGSSLSAPAHLRALPSPAADDRFGSRADAWDRVMSSAAAAAAVYRGSVPSGLHFMNFPAPMALLPGQQLGLGPVGGGGGGGGGGEGHMGILAALNAYRTQAATDAAGQQGGGGGGGGSSQQQHGGGGGGGERHQSISTSDS

SEQ ID NO: 400 - protein, 409 aa, Arabidopsis thaliana
MNSFSHVPPGFRFHPTDEELVDYYLRKKVASKRIEIDFIKDIDLYKIEPWDLQGKILKVFFYSFVEIELCKIGHEEQSDWYFFSHKDKKYPTGTRTNRATKAGFWKATGRDKAIYLRHSLIGMRKTLVFYKGRAPNGQKSDWIMHEYRLETDENGTPQEEGWVVCRVFKKRLAAVRRMGDYDSSPSHWYDDQLSFMASELETNGQRRILPNHHQQQQHEHQQHMPYGLNASAYALNNPNLQCKQELELHYNHLVQRNHLLDESHLSFLQLPQLESPKIQQDNSNCNSLPYGTSNIDNNSSHNANLQQSNIAHEEQLNQGNQNFSSLYMNSGNEQVMDQVTDWRVLDKFVASQLSNEEAATASASIQNNAKDTSNAEYQVDEEKDPKRASDMGEEYTASTSSSCQIDLWK

SEQ ID NO: 401 - protein, 428 aa, Oryza sativa Japonica Group
MDMSESSEKGMESNASSGPGNGIPVEWQSQFSSAFACQPSVAAQHQQHAMMDSFAAASAGLWASSDVVSAMSSAAPPRGAGFLAPVPGFLQQGLGHFPVDSGFIERAARSTCFGGGMMAGGPYGAADQAMGDAFGGTAEGLMDHHRNVGNDKAEEFAGNGHDEVPSSEVAGGDCSSKGSDSKKRRRPNEVMGTDQVHSSNLPSDSANESVHSKDKGEESSPATTNGGKSKGKGAKETSESQKEEYIHVRARRGQATNSHSLAERLRREKISERMKLLQDLVPGCSKVTGKAVMLDEIINYVQSLQRQVEFLSMKLATVNPRLDLNIEGLLSKDLLRFPGVPSSSIGFSPEMMHPQLQLSQPGLIHGGTAGMANPDVFRRIIQAQLGAKDGSQMPHSLNGSFSDVSQMAYPSLGSQDLSIRPSQDGFQM

SEQ ID NO: 402 - protein, 222 aa, Vitis vinifera
MAREKIQIKKIDNATARQVTFSKRRRGLFKKAEELSVLCDADVALIIFSSTGKLFEFSSSSMKEILEKHSLQSKNLEKLEQPSLELQLVENNNHSRLSKEVADKSHKLRQMRGEELQGLNIEDLQQLEKSLEAGLSRVIQKKGERIMKEITDLQSKGVQLMEENERLRQQVVEISNRRRQVAGDSENMFHEEGQSSESVTNVSNSNGPPQDYESSDTSLKLG

SEQ ID NO: 403 - protein, 256 aa, Arabidopsis halleri subsp. gemmifera
MEDYERNSNSPTHEEDSDVRKGPWTEDEDAILVNFVSIHGDARWNHIARSSGLKRTGKSCRLRWLNYLRPDVRRGNITLEEQFMILKLHSLWGNRWSKIAQYLPGRTDNEIKNYWRTRVQKQAKHLRCDVNSNLFKETMRNVWMPRLVERINAQSSPATCEPVESMITDPGQPIEEPIPVEPGFLQFNQQFVPASELSATSSNSPAETLSDVQGGVVNGSGSDPAGQTGFGEFNDWGCVGGDNIWTDEESFWFLQD

SEQ ID NO: 404 - protein, 223 aa, Crucihimalaya himalaica
GDARWNHIARSSGLRRTGKSCRLRWLNYLRPDVRRGNITLQEQFMILKLHSLWGNRWSKIAQYLPGRTDNEIKNYWRTRVQKQAKHLRCDVNSNLFKETMRNVWMPRLVERINAQSSSATCEPLESMVTDPGQPIDEPSPVEPGFAQFNTNHYHQQQLVPATEISATSSNSPAETLSDVQNGVVNGSGYDLVGQTGFGEFNDWGCVGGDNMWTNDESLWFLQD

SEQ ID NO: 405 - protein, 248 aa, Oryza sativa Japonica Group
MAGGGGGGGRGEGEGRAATGKRERIAIRRIDNLAARQVTFSKRRRGLFKKAEELSILCDAEVGLVVFSATGKLFQFASTSMEQIIDRYNSHSKTLQRAEPSQLDLQGEDSSTCARLKEELAETSLRLRQMRGEELHRLNVEQLQELEKSLESGLGSVLKTKSKKILDEIDGLERKRMQLIEENLRLKEQVSRMSRMEEMQPGPDSEIVYEEGQSSESVTNASYPRPPPDNDYSSDTSLRLGLSLFSSK

SEQ ID NO: 406 - protein, 284 aa, Arabidopsis thaliana
MTAVTAAQRSVPAPFLSKTYQLVDDHRTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 407 - protein, 150 aa, Zea diploperennis
MDWDLKAAGAWDLAELEQDHAAAAPSSGGHAANAAAAGTGTESRPPAPGAAGAPAECSVDLKLGGMGECEPGAARREREVVAGAAKRPRPAGPGGQQQQQCPSCAVDGCRADLGKCRDYHRRHKVCEAHSKTPVVVVAGREMRFCQQCSR

SEQ ID NO: 408 - protein, 594 aa, Physcomitrella patens subsp. patens
MGCSNSKVDNEDAVARCKQRKQLMKKTILSRHNFAASHAQFVSSLKGVGSAFRQFAEGEETKDGGANTMCLLETPTTSTTHVLSLRPPPLLPAWSFLYGFSAGFSTPFPPHSPLRRSPSATRSPNSRAANSPENVQNVKNFKPEPETLPKSLSKVQNHMSITTKSTKAHVSRKPPKLEQSDKTVVNTEIDLAVIKMESGDRDLLDVLKEVDDHFLQAAERGEDISRILETKKTHFHTSFSDSLKGTSAQSIHGLIFYIFQVNGSYIRSISDMRSARWSEECGLTGSHSETLDKLFAWEKKLFSEVKEAEALRIDLEKKYLMFKNQDAKNEDQINIDKTRASIRALQTRMVVAIHAVDGAAQQVQKLRDENLYPQVLELLEGGISLCHQAQLEAVKAVKRLDNSAACKPTTSFHRHSTAQLELALHRSPLCYVEASAAYGLCLGWQVALDQLADRVVLEGIGSFTAVVREMMKLQWEELRIKRRVETYHRELKKREKALLSATMRDTSSIPVPQIPSATSGKRTEVAEKRLKMESTKRKLENELEAEKKAYTCTRAYTLNSLQAGLPQLFQAVIAFSDLEAEIHRRLSSTQQTLH

SEQ ID NO: 409 - protein, 114 aa, Glycine max
MSSDALKVAAEGNNIDGLYQEIQQDPRILESIDSIPFVETPLHVAATLGHFEFATEIMTLKPSFAQKLNPEGFTPIHLALQCNHDEMVLRLVEMNKDLVRVKGREGLTPLHLAS

SEQ ID NO: 410 - protein, 344 aa, Capsicum annuum
MDRVKGPWSPEEDELLQQLVQKHGPRNWSLISKSVEHRAFTPEEDETIIRAHARFGNKWATIARLLNGRTDNAIKNHWNSTLKRKCSSLSADEGNELADQIFENQQPPLKRSVSAGSAMPVSGFHFSPGSPSGSDSDSSLHVTSSSQSHVFKPVARTGGVFPQSIDISSPPVDPPTSLSLSLPGVDLAEFSNRSADSTQSKNPFQLLLPPMQIPPPPPPPPPPPPQATTVPFERVSAIQQSLQNPDFGKNAGGEQPDKVFVPFSQELLGVMQEMIKTEVRNYMMGVEQKQQFQQQQQHYQQQPQQFQQQNHQLPSGLGLGLCMQQASDGFRDRAANRMRLSKFD

SEQ ID NO: 411 - protein, 517 aa, Capsicum chinense
NYAFSSSQFMTSPFSDLLSDNNDDNNNNRNWGFSYQRIMNSINKDEVPKFKSFPPSSLPMISSSSPASPSSYLAFPHSLSPSVLLDSPVLFNNSNTLPSPTTGSFGSLNSKEDNSRTSDFSFHSRPATSSSIFHSSAPRNSLDDLITRQQQTTEFSTAKIGVKSEVAPIQSFSQENMQNNPAAMHYCQPSQYVREQKAEDGYNWRKYGQKQVKGSENPRSYYKCTFPNCPTKKKVERNLDGHITEIVYKGSHNHPKPQSTRRSSAQSIQNLAYSNLDITNQPNAFLENAQRDSLAVTDNSSASFGDEDVDQGSPISKSGENDENEPEAKRWKGDNENEVISSASRTVREPRIVVQTTSDIDILDDGYRWRKYGQKVVKGNPNPRSYYKCTFLGCPVRKHVERASHDLRAVITTYEGKHNHDVPAARGSGSYSMNKPPSGSNNNMPVVPRPSLLANNSNQGMNVSNTLFNTAQVEPPITLQMLQSSGSSSYSGFGTSSGSYMNQMQPTNNSKLISKEE

SEQ ID NO: 412 - protein, 563 aa, Nicotiana attenuata
MASSGGNMNTFMNSFTSNYSFSSFSDLLSDNNNNNNNNNNMRSNNSSMNQEKNSLNWGFSDQRMNQQNKDEVPKFKSFPPCSLPMISSSSPASPSSYLAFPPSLSPSVLLDSPVLFNNSNTLPSPTTGSFGNLNSKEDNSKISDFSFQSRAATSSSMFQSSAPRNSLEDLMTRQQHANQQNEFSTAKTTGVKSEVAQIQSFSQEKMQSYPAPVHYTQPSQYVREQKAEDGYNWRKYGQKQVKGSENPRSYYKCTFPNCPTKKKVERNLDGHITEIVYKGNHNHPKPQSTRRSSSQSIQNLAYSNLDITNQPNAFLDNAQRDSFAGTDNSSASFGDEDVDQGSPISKSGEDDGNEPEAKRWKCDNENEVISSASRTVREPRIVVQTTSDIDILDDGYRWRKYGQKVVKGNPNPRSYYKCTFTGCPVRKHVERASHDLRAVITTYEGKHNHDVPAARGSGSYAMNKPPSGNSNNSMPVVPRPSMLANNSNQGMNFNDTFFNTRVQTTQNQPPITLQMLQSSGSSSYSGFDTSSGSYMDQMQPMNNTKPISKEEPKDDLFFSSFLN

SEQ ID NO: 413 - protein, 218 aa, Brassica napus
MGSISESAPTANSSTTVVMSSIPPFLSKTYDMVDDPSTDEVVSWSSGSNSFVVWNVPEFSKQFLPKYFKHNNFSSFVRQLNTYGFRKVDPDRWEFANEGFLKGQKQLLKSIIRRKPTQVQPPQQPQVQHSSVGACVEVGKFGLEEEVERLQRDKNVLMQELVRLRQQQQVTEHHLQHVGQKVHVMEQRQQQMMSFLAKAVQSPGFLNQFSQQSNNEGN

SEQ ID NO: 414 - protein, 493 aa, Arabidopsis thaliana
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTVEGILARAADELSALQGERKKVDPKTAEAIDQFLSKLRACAKAETSFTFILDDPAGNSFIENPHAPSPDPSLTIKFYERTPEQQATLGYVANPSQAGQSEGSLGAPSTKTAYVPNGTIGATAGHRAIAQSNSTDISDNLFRYSAPEEVMTFPSTCGACTEPCETRMFVTKIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 415 - protein, 244 aa, Brassica napus
SETSALFFIKKHLLDEFSPLPNATTTNPWETSSDFSFFGSFDQTGFDFPEFETKPEITDTPLAPNDSFTFQSNRKPPLKIAPPNRTEWIQFAAGNPQREQIPLPQVAAEEKRHYRGVRMRPWGKFAAEIRDPTRRGTRVWLGTFDTAVEAARAYDQAAFRLRGAKAIVNFPLEVGMWEPRAENGQKNKRKRDGGEEETRVVAKVVKTEESHGVEQVASSLTGIDDWDLTEFLSMPLFSPLSPHP

SEQ ID NO: 416 - protein, 325 aa, Hordeum vulgare subsp. vulgare
MKVEEQTVVGGGGGAGQGGAGFWGLAGRPCDTCAVDAARLYCRLDGAYLCAGCDARAHGAGSRHARVWLCEVCEHAPAAVTCRADAAALCATCDADIHSANPLASRHLLLPTPFFGALADPPQPVPSPSSAAATQEDAEDDGSNEAEAASWLLPEPGDSPEDSAATFFADSDAYLDLDFVRSMDGIKAIGVPVAPSELDLAGGTLFYPEHSMNHSMSTSEVAVVPDALSAGGAPAPAPSVAVVASKGKEREARLMRYREKRKNRRFQKTIRYASRKAYAETRPRIKGRFAKRTAEDDALEQDGPFSPASSAHLASDGDYGVVPSF

SEQ ID NO: 417 - protein, 119 aa, Hordeum vulgare subsp. vulgare
YPEHSMNHSMSTSEVAVVPDALSAGGAPAPAPSVAVVASKGKEREARLMRYREKRKNRRFQKTIRYASRKAYAETRPRIKGRFAKRTAEDDALEQDGPFSPASSAHLASDGDYGVVPSF

SEQ ID NO: 418 - protein, 367 aa, Dendrobium sp. XMW-2002-1
  misc_feature (176)..(176): Xaa can be any naturally occurring amino acid
MGRSPCCDKVGLKKGPWTPEEDQKLLAYIEKHGHGSWRALPNKAGLQRCGKSCRLRWTNYLRPDIKRGKFSMQEEQTIIQLHALLGNRWSAIATHLPKRTDNEIKNYWNTHLKKRLAKMGIDPITHKPKSDNLSSADGHSKCTANLNHMAQWESARLEAEARLVRESKLRSSSISXNTTTIFTSKNQPLLPPAVPMTPAASPCLDVLSAWQGAWTKPAANNSQGRGYTIDLESPTSTLSFSDNMMAPTISGMGLAEDSTREDQEWKCLRKTGFSMHTAAPFVSTEASSWLSESSGGDFAAGFTGMLSDKANEQNSEDGCNDSDNAECGSCVDVEESEGEEDENKNYWSSILNLVNSSSPPNSPPPVF

SEQ ID NO: 419 - protein, 766 aa, Saccharomyces cerevisiae
MSEEETVSAPAPASTPAPAGTDVGSGGAAAGIANAGAEGGDGAEDVKKHGSKMLVGPRPPQNAIFIHKLYQILEDESLHDLIWWTPSGLSFMIKPVERFSKALATYFKHTNITSFVRQLNIYGFHKVSHDHSSNDANSGDDANTNDDSNTHDDNSGNKNSSGDENTGGGVQEKEKSNPTKIWEFKHSSGIFKKGDIEGLKHIKRRASSRNNSSINSRKNSSNQNYDIDSGARVRPSSIQDPSTSSNSFGNFVPQIPGANNSIPEYFNNSHVTYENANHAPLESNNPEMQEQNRPPNFQDETLKHLKEINFDMVKIIESMQHFISLQHSFCSQSFTFKNVSKKKSENIVKDHQKQLQAFESDMLTFKQHVMSRAHRTIDSLCAVNAAATAASVAPAPAPTSTSAYAPKSQYEMMVPPGNQYVPQKSSSTTNIPSRFNTASVPPSQLLYNTNRSRNQHVTYASEPAHVPNFINQPIPIQQLPPQYADTFSTPQMMHNPFASKNNNKPGNTKRTNSVLMDPLTPAASVGVQGPLNYPIMNINPSVRDYNKPVPQNMAPSPIYPINEPTTRLYSQPKMRSLGSTSSLPNDRRNSPLKLTPRSSLNEDSLYPKPRNSLKSSISGTSLSSSFTLVANNPAPIRYSQQGLLRSLNKAANCAPDSVTPLDSSVLTGPPPKNMDNLPAVSSNLINSPMNVEHSSSLSQAEPAPQIELPQPSLPTTSTTKNTGEADNSKRKGSGVYSLLNQEDSSTSSADPKTEDKAAPALKKVKM

SEQ ID NO: 420 - protein, 379 aa, Zea mays
MASPAIPFAPLTSHRAAPFVLGCPPPWPPPPPPAARPRPPPPRPDAAAAARLLEEEAGAGSSRARSPGGPELESMVLDLNAESPTPGSASAASSSSVVVGGGFFRFDLLGGTPDEEGCSPSPPIVTRQLFPLPYPDAAGSTAASTASNGSPPPEVAGAWARRPADLGAPALAQGKVMSAPSSPAVLSPAAGKKSRRGPRSRSSQYRGVTFYRRTGRWESHIWDCGKQVYLGGFDTAHAAARAYDRAAIKFRGLDADINFQLKDYEDDLKQMRNWTKEEFVHILRRQSTGFARGSSKYRGVTLHKCGRWEARMGQLLGKKYIYLGLFDSEIEAARAYDRAAIRFNGPDAVRNFDSVSYDGDVPLPLFKHNKVGTGGGKGV

SEQ ID NO: 421 - protein, 371 aa, Dendrobium sp. XMW-2002-2
MWRHSCCYKQKLRKGLWSPEEDEKLLKHITKYGHGCWSSVPKLAGLQRCGKSCRLRWINYLRPDLKRGTFSQQEENLIIELHGVLGNRWSQIAAQLPGRTDNEIKNLWNSCIKKKLRLRGIDPNTHKPLAETEVQLAEIDSADQPAPEPEKHTVQQTETGVPNNSVRPGNSPAASYFSLPDLTYSPDCGGSIGQIQQFWLNQSGKFFSNNNSNSEFSFNSVSSLVPSVPRSTLSTSKELKPLTSLLMENSPSGFYWETGNSSNSSASSGSNDPLFDGSIFQWTQLIPERDINVQLHGETEDLKWSEYLNGSIPLSTELQSQNPELCNGMKAEEQFGIDGLSIWLQNHQQQQQQQQQASNNYGKDSQRDIIC

SEQ ID NO: 422 - protein, 333 aa, Vitis vinifera
MADASPRTDTSTDVDTDEKNQRFEMGQSAALVASDSSDRSKEKAGDQKTLRRLAQNREAARKSRLRKKAYVQQLENSRMKLTQLEQELQRARQQGIFISSSGDQSHSMSGNGALAFDVEYARWLEEHNRQINELRSAVNSHASDTELRTIVDNVTAHFDDIFRLKGIAAKADVFHILSGMWKTPAERCFMWIGGFRSSEVLKLLVNQLEPLTEQQLMSIYNLQQSSQQAEDALSQGMEALQQSLAETLTSGSPGPSGSSGNVANYMGQMAMAMGKLGTLEGFLRQADNLRQQTLQQMHRILTTRQSARALLAINDYFSRLRALSSLWLARPRE

SEQ ID NO: 423 - protein, 295 aa, Glycine max
  misc_feature (181)..(181): Xaa can be any naturally occurring amino acid
  misc_feature (211)..(211): Xaa can be any naturally occurring amino acid
MIAVARKDMDRIKGPWSPEEDEALQKLVERHGPRNWSLISRSIPGRSGKSCRLRWCNQLSPQVEHRAFTPEEDETIIRAHARFGNKWATIARLLSGRTDNAIKNHWNSTLKRKCASFMMAGDEAVAVSPRPLKRSFSAGAAVPPPGSPSGSDFSESSAPGVVSVSPSHVFRPVPVRPIVEXGVVARRCRRCRTRDFAVAVSSRCGVGGNFXRATTVPVMPVNTVAAPAPVPAEVGLGALNLSGEFMAVMHEMIRKEVRSYMEQQKNGMMCFQGMEMMEGFRNVSVKRIGISRVDS

SEQ ID NO: 424 - protein, 537 aa, Gossypium hirsutum
MKRDHQEISGSGSNPAESSSIKGKLWEEDPDAGGMDDELLAVLGYKVRSSDMADVAQKLEMLEKVMGTAQEDGISQLGDTVHFNPSDLSGWVQNLLIEFNGSTTTPDPNFNDDSEYDLRAIPGVAAYPPVKSDPGLEITRKRAKTESSSSSSSTTTRPVVLIDSQEAGVRLVHTLMACAEAVQQDNLKLADALVKHIGLLASSQTGAMRKVATYFAEALARRIYRIFPPDSLDPSYNDKLQIPFYETCPYLKFAHFTANQAILEAFSMASRVHVIDFGLKQGMQWPALMQALALRPGGPPAFRLTGIGPPQPDNTDALQQVGWKLAQLAERIGIEFEFRGFVANSLADLEPEMLDIRPPEIEVVAVNAVFELHPLLARPGGIEKVVSSIKAMKPKIVTVVEQEANHNGPVFLDRFTEALHYYSTLFDSLEGSGVAPASQDLAMSELYLGRQICNVVACEGMDRVERHEPLTQWRTRMETAGVSPVHLGSNAYKQASMLLALFASGDGYRVEENNGCLMLGWHTRPLIAHLGLATRWY

SEQ ID NO: 425 - protein, 349 aa, Solanum tuberosum
MSPPLLGVGEEEGQSNVTLLASSTSLGSICKKGSALKERNYMGLSDCSSVDSCNISTSSEDNNGCGLNLKATELRLGLPGSQSPERGEETCPVSSTKVDEKLLFPLHPAKDTAFSVSQKTVVTGNKRGFSDTMDGFSEGKFLSNSGVKSGDAKETSRVQPSKMKDANTQSTVPERPSAVNDASNRAGSGAPATKAQVVGWPPIRSFRKNTLASASKNNEEVDGKAGSPALFIKVSMDGAPYLRKVDLRTYSAYQELSSALETMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 426 - protein, 345 aa, Oryza sativa
MTGTEQMMYHQQQVQSDSQHLSSRPGLPPEKQFLLQGGADSSSGLVLSTDAKPRLKWTSELHERFVEAVNQLGGPDKATPKTIMRLMGIPGLTLYHLKSHLQKYRLSKNLQSQANASRAQGVLGCSTTEIDKPCEGNGSPASHLDLETQTNSSMHINEALQMQIEVQRRLHEQLEVQRHLQLRIEAQGKYLQSVLEKAQEALGTIAIAETAATANASSSKRLQNEHTQLHHHQQQQQVGDGSVDSCPTACDREGSHHSRSHGHRGEQDILSIGLPPFEPAAARSGKEHHYLLFPNEPSRRRSCSDERRREMSTLQASELDLSINGRSSSHSHRRENIDLNGAGWS

SEQ ID NO: 427 - protein, 342 aa, Vitis vinifera
MNTFSHVPPGFRFHPTDEELVDYYLRKKVASRRIDLDVIKDVDLYKIEPWDLQELCKIGTEEQNEWYFFSHKDKKYPTGTRTNRATKAGFWKATGRDKAIYCKHSLIGMRKTLVFYKGRAPNGQKSDWIMHEYRLETNENGTPQAKGWVVCRVFKKRMATMRKVGEHGSPCWYDDQVSFMPDLDSPRRISQPYTSFQHHYSCKQELELPYNMPHDPYLQLPQLESPKLPQSAASVSCNSSSTLTQEEHIQQSYQQNMSSLYSSNNEQAVDQVTDWRVLDKFVASQLSHDQDASKETNYSNAAVPTFHVADHMNLLVNDSKRPEIPQEYASTSTSSCQIDLWK

SEQ ID NO: 428 - protein, 760 aa, Oryza sativa
  misc_feature (398)..(398): Xaa can be any naturally occurring amino acid
  misc_feature (405)..(405): Xaa can be any naturally occurring amino acid
MDTPDRPPRAAATAAVEDSPVFNFINSLSPIPPPKPSDSAHNVQLFKSSDLAPVSSIFASPHVNPAKESKLPIREDSVQLSRESHSPNSVRTRTGATSSIIRMIRCKNIVSENCSITCYLNDSTSSKASQPIQLCGGSAESDTNQNTDGKKDPTTEQDRTDIEFVLLDQCGPEKMDSSQSGNNACENQLSEQDKDELGSFDGGYMFAHQPHSDMLRLAPPFESETQLVNETLQTDNVYCETLLTDGPSGSYTQNSAPDPHPYWAGAVEGCATDYTPQMLPGACQSQLVPNDQINNKLNEPSDYMPMEHNVSSQNLRGMRRRCLFNEKSGAANEGAKNSSARHSTNSTTPRRKISSSDNNLKTLRTPPCALPGIGLHLNALATVPKDKMVPHNDIQSSXAEESDEXSAVGSSPPTDDPHTINDDSSQTAVVAYVGESSQGSPKKKRHKFDNGDGTSCKRCSCKKSKCLKLYCECFHAGVFCSEPCSCQGCLNMPSNMETVLSTREQIESRNPLAFAPKVIRTEPGQELADDSNKTPASSRHKRGCNCKKSSCLKKYCECYQGGVGCSVSCRCEGCKNAFGRREGVALLGIEEAKRGCEEKDGGVKEETTDNDKQLVIYQDSINLTPAESVLATPSVVDYRPLVALPPLSSKKPRSSTKLGGYSSRLEGHLKSDILLSPFESYAEMMLGDGTSNVLKGESSPQTSVKVVSPNKKRVSPPRIGTGLSPICKSGRKLILKSIPSFPSLGVDITNEDPNTSSLAP

SEQ ID NO: 429 - protein, 368 aa, Glycine max
MPESRKQPASRPKQKLHHHSLQESKAMRKLRIICDDPDATDSSEDETEKVQSPRRVKRNVSEISLPPLPPPFTTTPETSSCEVNSGKNATLKGFIEGQPQSKKRVLTHPPSTRRNTSGKFRGVRQRKWGKWAAEIRDPFQSTRIWLGTFNTAEEASQAYEARRLEFEAMAEAQAYKTSSVSEPLATISDNKSNCCNSSAAAISAAAVSAADVSVSEKFSTTFDDLEESVLSHNSPSSVLELDTLASKSLEKGNVSTEEAIEANDLVAELAGLEVPDVSLLNLLPPPSDSGGAAAAVSSGIEPNFGLDFDWLSFNDYGQGFDDFGGLEDIHIGGFDDNEPTELPDFDFGDFGADEFAGWIEEPLNIPCA

SEQ ID NO: 430 - protein, 91 aa, Glycine max
  misc_feature (41)..(41): Xaa can be any naturally occurring amino acid
  misc_feature (79)..(79): Xaa can be any naturally occurring amino acid
MITSSEKVSLSPPPSNRLCRVGSGASAVVDPDGGGSGAEVXSRKLPSSKYKGVVPQPHGRWGAQIYEKHQRVWLVTVLXEDEAALSYDIPA

SEQ ID NO: 431 - protein, 266 aa, Tripsacum dactyloides
ASADPSTDSAREPKRMRTGGGSTSSSSSSSSSMDGGRTRSSVVEAAPPATQASAAANGPAVPVVVVDTQEAGIRLVHALLACAEAVQQENFSAAEVLVKQIPMLASSQGGAMRKVAAYFGEALARRVYRFRPPPDSSLLDAAFADLLHAHFYESCPYLKFAHFTANQAILEAFAGCRRVHVADFGIKQGMQWPALLQALALRPGGPPSFRLTGVGPPQPDETDALQQVGWKLAQFAHTIRVDFQYRGLVAATLADLEPFMLQPEGD

SEQ ID NO: 432 - protein, 302 aa, Hordeum vulgare
MGRPSSGAVGQPKVRKGLWSPEEDEKLYNHIIRHGVGCWSSVPRLAALNRCGKSCRLRWINYLRPDLKRGCFSQQEEDHIVALHQILGNRWSQIASHLPGRTDNEIKNFWNSCIKKKLRQQGIDPATHKPMASADTATAAAALPDAEEEDRKPLCPAVDGSLVPKQPAVFDPFPLCVDYGAGFAEELGAANAAALYGQLCGGKEVADDDAGFGAADYSCVLDVSENLGYGESSSNSSNWNYGGEVGSVLDGEVPHWAKAEPAFAEMERQQQHSPAEQKLSLPCQEQSLLASFDFNLELEPYF

SEQ ID NO: 433 - protein, 239 aa, Arabidopsis thaliana
SLPSLRSQHSRFVTSPDENSDVVYSFSGYSHASEIVDCYLNGKSPPKTTINPESSKFWWEDPNLYGDCDDLSELRIIEDRLMRTKKHLMDCLEKKEKSYSVSKSDQNPKNNGGSSSSSSSSSSQIASDFGQNPSTSSPFFDHHSYSSLEPSSQVTTCFDQNPIFSVGSESSSDQFRYLVNEDAGFVDCLFETEEEKNRMIVPQETQTQPMFSEEDQSFWENLDVDDVFGLFNDDTNLEV

SEQ ID NO: 434 - protein, 677 aa, Vitis vinifera
MDTPERNQIAAPISKFEDSPVFNFINSLSPIKPVKSAHIAQTFNSLSFVSLPSIFTSPHVSSHKESRFLRRHNFSDPSKPEFSSVNGNKVSTNEEVMDADQLSSFERNNGHSELAIELPQTLKYGCGSPDCDPTPCGGTEVELASKSGSLAPFSEEASETGRFNSQLHLKGMCQIEQKKEEAGCDWESLISDAADLLIFDSPDDTRAFKGLIQKSLDPGTSVCASLGSQFSQDDVSDLQKKQFNNEMYPFACFYVQTLSNLHRGMRRRCLVFEMAGVRRKNMDDGSNCIPLKPGNDSSRRILPGIGLHLNALATTSKDYNIVKHETLTSGRQLIKRQTLLKMDFRLWKMLLRHLHMRLVKSSIRVAPKKRGMLEHGGETEGCKRCNCKKSKCLKLYCECFAAGVYCVEPCSCQECFNKPIHEDTVLATRKQIESRNPLAFAPKVIRSSDSLPEVGDEPSKTPASARHKRGCNCKKSSCLKKYCECYQGGVGCSINCRCEGCKNAFGRKDGSALIGMEAELEEETETLEKSVVDKNLQKSIVQNDEEYLDSALPVTPLRTCRQPSQLSFPSKTKLPRSSFLTIGSSSGLHTSQIFGKPNFPQPQSKFEKKFQTIPEDEMPEILRGNCSPTSSSIKTASPNSKRVSPPHCDFGSSPSRRSGRKLILQSIPSFPSLTPQH

SEQ ID NO: 435 - protein, 431 aa, Oryza sativa Japonica Group
MEASAAKEKDKDGKKMSRVGSWGSMAFYSSSSSSRSQPVSAAEGKNGGKKEKRRSSISRSITCAGSICSTKESSVSSRGRGRRRRSGGGGGGDGGGGGSTSSRSLMGPGYHGDSAAAVSASSSFNSVMTAATSATATTTTTTTSSSATSPPSALSSPLSSIGGSFRAMQIRKLSGCYLHCHSVLDPRTLAAVVFSCPDCDEVFVKPDSLELHRSTRHAVSELGADDTSRNIVEIIFQSSWLKKNAPVCRIERILKVQSSDKTIKRFEQHKEAVKEKARSAGDEAGRNPRCVADGNELLRFHCTTFACSLGLAGGTALCCASSSPPPLHCKLCSIIKDGFRVDGNGRITTMATSGRAHDTAEVSPDGEKRAMLVCRVVAGRVKKLHSSNSSEDHDCDSVSPCSEGVYSDLDELFVFSPRAILPCFVVIYSGY

SEQ ID NO: 436 - protein, 359 aa, Antirrhinum majus
MGRSPCCDKVSLKRGPWTPEEDQKLLSYIQEHGHGSWRALPSKAGLQRCGKSCRLRWSNYLRPDIKRGKFSLQEEQAIIQLHAFLGNRWSAIATHLPKRTDNEIKNYWNTHLKKRLTKMGIDPMTHKPKSHDVLGCGQPKVVANLSHMAQWESARLQAEARLVRESRLVSHHYHSQLLNRATAITHPTLPPCLDVLKVWHGAWTTRPGKDIITSAMFNGFFASNNGNLESPTSILKSSDNMLNASTSVGLLHENPFITDMSYVGKPSNVYEDWVKGIMDNSNELNKIIEPIDSTHYVAHDDDSIGFPGFMEGSTNLVTSTVRTNGPDDDNVVGVFEENDINYWRNVLNVVNSPMGSPVF

SEQ ID NO: 437 - protein, 809 aa, Malus x domestica
MGIVTLPPLPPPPPKGNLHHRHHSIDSENYSNPPNSMSQDYHQGIFTFSNGFERSAMTTHQEQQQQQQHHLAQQIRREKLRVQGFETPPPPPLVGLNEEESSGLPAYETAGMLSEMFNYPPGGGPVGAAELLEHPMSANYRMMPRPQQAAAVSAAADWYGRVGGGGLGPLGDSKNQHHHQISTINADSAAAMQLFLMNPSQPRSPSPPPSHTTSSTLHMLLPNPSTTTNSLQGFAAASGGGAFGQFTWVPESHQGHEAGGNTAGGGGEIGGVVEGQGLSLSLSTSLQHLEAAKAEEFRMGSDSASGLLYYNNQGDHQHQGSNPQYKNLGSHHHQALHSLQQGGVVGGHHVSFGSSSSFGVVNVLRNSKYVKAAQELLEEFCSVGRGQLKKNKFGGSTSGRQNTTTNPSSNPASGGGGDGGASSSSSKDVPPLSAADRIEHQRRKVKLLSMIDEVDRRYNHYCEQMQMVVNAFDLVMGFGAAVPYTALAQKAMSRHFRCLKDAIAAQLKHSCELIGEKDGAGTSGITKGETPRLKLLEQSLRQQRAFHQMGMMEQEAWRPQRGLPERSVNILRAWLFEHFLHPYPSDADKHLLARQTGLSRNQVSNWFINARVRLWKPMVEEMYQQEANEEEEVGEGGVGGATSAAADQERERNSNAGLAAQTPTPTTTTTTTTKNSPASKRSDINASENDPSLVAINRHQQQQHHHPMMATTTSTTVASPAYQCFPAAASDDTCRSYGTTSANANIAAHHDHQNSSNIDSSTTLISFGTTTAAGDVSLTLGLRHAGGGGGNNMPDKTSSSFSIRDFGGC

SEQ ID NO: 438 - protein, 303 aa, Vitis vinifera
MEALQNEADRVKGPWSPQEDQALQCLVKRYGARNWSLISRSIPGRSGKSCRLRWCNQLSPQVEHRPFTPEEDRRIIEAHAKYGNKWATIARMLNGRTDNAIKNHWNSTLKRKFAAEIEQVPAPVSVDNEGSRPEKRQSSGGGPSMPATGLCLSPGSPTGSDVSDTGFPVVSSPNLYRPVARTGAVQVPPQQFEPSSKKDDPPTALTLSLPGTETYENEYESPPLDSAPRHNKLASPEKQPALTFAMPENPEPMTFGSDFFLMIQDMIKTEVKNYMSGLEINEICSQSEGNIRNAAINRIGMGD

SEQ ID NO: 439 - protein, 423 aa, Arabidopsis thaliana; identical to SEQ ID NO: 269

SEQ ID NO: 440 - protein, 364 aa, Zea mays
CIKSIHDIYTSDIDRTPDRLSWQVERSTMVAKVKRDGEVLVAAATGDSEEQDDLVLPGFRFHPTDEELVTFYLRRKVARKPLSMEIIKEMDIYKHDPWDLPKASTVGGEKEWYFFCLRGRKYRNSIRPNRVTGSGFWKATGIDRPIYPAAAGESVGLKKSLVYYRGSAGKGAKTDWMMHEFRLPPAASSPSTQEAVEVWTICRIFKRNIAYKKRQPAGSNAPPPPLAESSSNTGSFESGGGGDDGEYMNCLPVPVPATAAVVPRQQHRIGSMLNGGGVTASGSSFFREVGVHGQQFQGHWLNRFAAPEIERKPQLLGSSAMTIAFHQNDQTAATNECYKDGHWDEIARFMEVNDPTVLYDCRYA

SEQ ID NO: 441 - protein, 305 aa, Arabidopsis thaliana
  misc_feature (175)..(175): Xaa can be any naturally occurring amino acid
  misc_feature (179)..(179): Xaa can be any naturally occurring amino acid
  misc_feature (192)..(192): Xaa can be any naturally occurring amino acid
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAXVLPXPIETSSSSDDPPXSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 442 - protein, 244 aa, Hordeum vulgare subsp. vulgare
GTRSFGGSVDGEKQDAVVNLNDALEAGPDGKENVKLDFLFADMMDPFFGSELPRFPHADSVVPSGGAVELDFGGVAAAAAVVSNPSYSSYTAASIGGSGSSSEVGLVPDAICGRGGGIIELDFAQSKAAYLPYTPTPSHSTVSSVDVGPVPERSESAVAAATPAMGEGREARLMRYREKRKNRRFEKTIRYASRKAYAESRPRVKGRFAKRADDADADAVAAGTITAPRPCVLDFSGYGVVPTF

SEQ ID NO: 443 - protein, 614 aa, Oryza rufipogon
MSSAAGGGGYGGGQGGGAEYHHHHHGHAGHLLLHHHPQHVAGAAVAAAAAAAGGQMYHVPQHSRREKLRFPPDAGDSLPPHGHGHGHGHAPQQQQQHGSWPPPPAFYSYASSSSSYSPHSPTLAQSQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGGNGGVSLTLGLHQNNRVCIAEPLPAALPANLAHRFGLEEVSDAYVMSSFGGQDRHFGKEIGGHLLHDFVG

SEQ ID NO: 444 - protein, 398 aa, Oryza sativa Japonica Group
MASAAAATGAALGARTARACDGCMRRRARWHCPADDAFLCQACDASVHSANPLARRHHRVRLPSASSSPASSPRSAAAPRAGSDDPDAPAWLHGLKRRPRTPRTKPGGGGKHDASAATVAAAAASAVPDLEAEESGIVGDTDHDVGKRTTRDLLYRVPVFDPMLRGGHGEPPHGSRRGVRRSGLLGRREAHVKLDLDMDMDFASISPAPAPEREERKRKRPEMILKLDYEGVIDSWARDGASPWFHGERPRFDPSESWPDFPAGSRGGLGAAVTAVTGGEREARVSRYREKRRTRLFAKKIRYEVRKLNAEKRPRMKGRFVKRAAALPPLPLPRHQHPPPPPPRALPAGADDARAARRARALPFLRATALDRLPMRMRASSSYMHACMLAIAVCVIQQ

SEQ ID NO: 445 - protein, 214 aa, Arabidopsis thaliana
MGFCSESFRFEGGGRNIRIGLNRTGKSCRLRWVNYLHPGLKRGKMTPQEERLVLELHAKWGNRWSKIARKLPGRTDNEIKNYWRTHMRKKAQEKKRPMSPTSSSSNCCSSSMTTTTSQDTGGSNGKMNQECEDGYYSMDDIWREIDQSGANVIKPVKDNYYSEQSCYLNFPPLASPTWESSLESIWNMDADESKMSSFAIDQFPLSFEHGSGRL

SEQ ID NO: 446 - protein, 466 aa, Ostreococcus tauri
MSGCEPRRRKSSFKTTDDRASVPCPTQLDNEFSALGMQSLEDDRYVLQNMYDEFDDSVLGVDERGSQPRTAGTREDLNGKRSSTTGASTEWTAGFTKTLKNFDVDSPRVGTRSARRTVVPPRTPSKAVRRPRSLRSIPRIRLLAVNQLRARNATAKKASVSSCTANASRRCQNTVENVSVVEKTRSQIEARNPNAFLSKIEDDGDDARHTKGCHCKKSACLKKYCECFQAGVKCQEYCKCEGCMNKEDAPPSSGPRGGSAKNGKASTQKTKAGRLAKTPIEVASELAARSIQDDLVIEDFKVFDKFGSPPRSFSHADDLSSEYSALNKSVEQSPLRTLLLSEGVQLSPFFSTSSLPQSALSPLRGAGYMSPLRPQLSPLRPSGFMSPITPGLRAGPGKYSIRSIGKAAVPLFNEDSGNSAGSREFKSPQDARTIGLGGWAHEVSKDGSFRATFTSPIPLKTPDVRE

SEQ ID NO: 447 - protein, 828 aa, Candida glabrata CBS 138
MRIINEVTHTPVQELREEIGLQTNKIKVKLQNPSDIPRVFIKKRIAGKLNPSVLNNNERIVLVSGPPDMMNSEIQDRSYLTQKYSEYKPPNNSRANVPQYFTGQNRAAEQFQRSAPIGAASEIPYQPPSHPYDHEIDLNNTLPAYYESFRGNQHGPKPSWGTDSLLSSPTEKSDEQYFNDDISETRINTSDIKSVGEDVSNRLKSLVSRLERYGIENNSGNIYGTNNQNLRYETIKIELIETIRKVKELQQELVKIFDNNTNLKYSTTGHEDSYKSTKRRRSGLVTTLNDTEIDSAPNKFEPNNLEGKGQFHSSGGAYKNSLNDYKFPPGNTANSGAFFRANGDGSINTYKARPSNIRSMSSYPLIRSPYGKILQKNTMIPAIHSRQDPYNRRVLLQPPYFHRPNLSDPSGIRPQSMHRSTLPTLPFPRNQSIDETFYQSRNLPEPSGFIPQTYLGKPLPRCTHNQYQDNVYQQINIIENRSTSNEIKSMGETKIGSSRVSNEIGPLAQRYMAKNNDDSDSYQQRALDSKPPQQNQSRDILSTEYSNFTYEGTDVVDNIDKGNGRKAYIQKRKKSVYSRDLNAKTFNLPRLGSPNLTRDTSTKISVGLQGSETEGEDSRTDISKAENPNSKKQENLVSHQDHISHVEQCADNATDKPSKNERSQYKSKVTSRENRVTKKDQSAADAKIQSKCDKSSIRTTGKVTKPSKENLTKRRQYEAKSNTTSSSSEKVTVEITLRCHHCGESDTPEWRRGPYGSRTLCNACGLFYRKLTKKFTVPYGNLYMRYRRIQAPLDRRVPLVLDVPTDIVREFDLDQNIDSNYFTIGSDT

SEQ ID NO: 448 - protein, 306 aa, Zea mays
MSSAEDGYCSSDSPRAESPDEPQAGADAESPRAGAGLNKRERDLPASPSSPLPPAKRSRRSVEKRVVSVPLAECGDRPRGASGEGPPPSDSWAWRKYGQKPIKGSPYPRGYYRCSSSKGCPARKQVERSHADPTALLVTYTFEHNHEAPQPKTSGGSCCHQQGKPSARPPAPKPEPSVVLVQRDELGPEHELVETEVPEQEQETEPEEEHEPAEEGVPCLAGPEAAATLTVAPAAEEDESFDFGWFDQYPTWHRSALYAPLLPPEEWERELQGEDALFAGLGELPECAVVFGRRRELSLAATAPCS

SEQ ID NO: 449 - protein, 279 aa, Oryza rufipogon
QPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPQYAAAAAAPSSVQYGGGVGAAPHIGSYGHHHHHHHHHGHGAASGASSVGECSTMPVMVPVDPHRSSMSSSMLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDS

SEQ ID NO: 450 - protein, 206 aa, Glycine max
MVRRKIPIKKIDDVTARQVTFSKRKSGLFKKARELSLLCDAEIALIVFSPGGKLFDYGSSSMQKVIERHILRSELNLEKLDQSCPTEQVRCNYADLNKEFADRTREMRQLNGEELQGLTLRELQKLEERLDSSLNRVYKAKVENFIKEIGILKEKGKKLMEDNMLIKQMIKLPRNEICSVQRHEHEQGQLFDTSLTLGLPFPAGSK

SEQ ID NO: 451 - protein, 84 aa, Prunus armeniaca
DLAVALEKLFGCFGIGEVLKDAENCEFAPIYEDKDGDWMLVGDVPWEMFTESCKRLRIMKRSDAKGFGLQPKGFLKATMKDDPI

SEQ ID NO: 452 - protein, 241 aa, Vitis vinifera
MGRGRVQLKRIENKINRQVTFSKRRTGLLKKAHEISVLCDAEVALIVFSTKGKLFEYSTDSCMEKILDRYERYSYAERQLTATDPESQGNWSLEYSKLKAKIELLQRSQRHFLGEDLDSLSLKELQNLEQQLDTALKHIRSRKNQLMYESISELQRKEKAMQEQNNMLAKEIKEKEKTVAQQTHWEQQNHGLNTSSFLLPQQLPCLNMGGTYQGEAHGARRNELDLTLEPIYPSHLGCFTT

SEQ ID NO: 453 - protein, 336 aa, Oryza sativa Japonica Group
MEHFNDWDLQAVVRSCSFPQSEPPRVGVGVPAAPGAGGAPVVVAPPARAPDGPDQMARASASALYDLEYLDLDHKPFLLPGSSSSSSSSRAVARARGEDDGKGRHEVMISFPAAAAASTSGAQPRSPSGRKPGIRTPRPKRRSSKKSQLKKVVYEVPVADGGVSSDLWAWRKYGQKPIKGSPYPRGYYKCSSMKGCMARKMVERSPAKPGMLVVTYMAEHCHPVPTQLNALAGTTRHKSAPTGDDDKPTSPGPAAGRAAAGEGVVKCEDVDGNELSAMAADGGAEDTAAAADDDGELWPEGMGLELDEFLGPMDDDVFEFDHVLEDDGVLGRRLSL

SEQ ID NO: 454 - protein, 234 aa, Gossypium hirsutum
MLPAAMAAAGIRLWPGIQERDYGRGYKKGLWAMEEDKLLIDYVNVHGKGQWNKIANRTGLKRSGKSCRLRWMNYLSPNVKKGDFSEEEEDLVIRLHKLLGNRWSLIAKRVPGRTDNQVKNYWNSHLRKKLGIIDQNKTRIDFCQSSKQVKVCHVDEAATDPSPGHGTTTETTGITVDQSNQQEVIDHRVLNNTTQESMTSESYINTFWIPDHDYELSTLAMIDHFHECSSFHLS

SEQ ID NO: 455 - protein, 247 aa, Vitis vinifera
MGRGRVQLKRIENKISRQVTFSKRRSGLLKKAHEISVLCDAEVALIVFSTKGKLFEYSTDSSMERILERYERYSLSERQLLSTDPDPQGNWSMDYPKLTARIEVLQRNLRHFVGEDLDPLSLRELQNLEQQLDTALKRIRTRKNQLMHESISELQKKEKSLVEQNNALAKKVKEKEKVEQNNRAQWEQQNNIGQNSSAYVVPPPPLQLPSLTIGGSFVGRAVEEDGAEARPSPNTLMPPWMLRHVNE

SEQ ID NO: 456 - protein, 87 aa, Zea mays
  misc_feature (20)..(20): Xaa can be any naturally occurring amino acid
  misc_feature (60)..(60): Xaa can be any naturally occurring amino acid
NRHFVKFDSSIIKVPYRDFXIPARSQLVTLSTVERIIMRSVYDLHSLQHELNKVYPHNAXSIYQFLLNFTSLGSRYSSFTFILDYPS

SEQ ID NO: 457 - protein, 251 aa, Physcomitrella patens subsp. patens
MEGASVSTNPRSVEEVFKDFRGRRAGMLKALTTEVEEFYRQCDPEKENLCLYGFPEETWEVNLPAEEVPPELPEPALGINFARDGMQRKDWLSLVAVHSDAWLLAVAFYYGARFDKIERKRLFNLINELPTVFDVVTGKKPVKEKSSVNNNVNSNSNNNNNSGGNKAKSAAKVVTPPPPKEDDDLEDEDEEEHGDTFCGTCGGSYTAEEFWIGCDICEKWYHGKCVKITPARAEHIKQYKCPACSNKRART

SEQ ID NO: 458 - protein, 854 aa, Oryza sativa Indica Group
MASFASVFYSQSKILRAAWKSQPPRKAQQQQAAAESPEATNHIAPSTASVHHSPHYLTPNPLHYLNVEASTNQVAEQQGAPLYNLPWKIPCKVMNVELKAEPDTDEVYAQLTLLPEKYSFFDRLIVAMPLTSLLDQDMSQHPPTQELVAKDLHGVEWRFRHIFRGQPRRHLLQSGWSVFVSAKRLVAGDAFIFLRGENGELRVGVRRAMRQQANIPSSVISSHSMHLGVLATAWHAVNTGTMFTVYYKPRTSPSEFVVPRDLYKESLKRNHSIGMRFKMTFEGEEAAEQRFTGTIVGVGDSDPSGWADSKWRSLKVRWDEAASVPRPDRVSPWQIEPANSPSPVNPLPAPRTKRARPNVLASSPDLSAVNKEVASKVMANSQQNGLPRAFHSQENMNLRSRFGDSNELNTSQKLTMWSSGSNQEKNNVSVQRELGSQSWMQMRSPDGSSEILSGFQPLKDTRNPLSSFPSQISGNRSNTWNTINVHYPDQNANHNMYPGTWSLMPPNTGFGVNQQNYLMTPDITLPQRSLNAKFGGNGAFTSLRAHGIDQRSSGWLGHIEPSSHIDDASSSLIKPQPLVIDHNVQKAKGSSCMLFGISLDSPAKPELLISPPSVAFDGKLQQDALEEDECSDPSKTVKPLDGAQHDSATEKHQSCPDGTKNIQSKQQNGSSRSCKKVHKQGIALGRSIDLTKFTCYDELIAELDQMFDFNGELNSSSKNWMVVYTDNEGDMMLVGDDPWNEFCNMVHKIFIYTREEVQKMNPGALNSRSFVVCKNRRRHIHGRKESFRGVVVVAGALYVSGKPRSTPFVDGACPGISCPLFVFDKFWVCFVEVLSYCMICPVVVKGAEAKLPRP

SEQ ID NO: 459 - protein, 409 aa, Oryza sativa Japonica Group
MGAHGDHRHHHHHQEAGVLVDEEEEEVIEQACGGPTSGVVEQEVGGDGGGVCQDAAGMVFEATSSVGSVSATMGPPPIMCWPPPAQPVHGAIHHHHNLGGGGGQQSPFFPLLPPLPPQPPPPPPFFADFYARRALQYAYDHSGGASSSSDPLGLGGLYMGHHGSHVAGMMMPPPFAPSPFGDLGRMTAQEIMDAKALAASKSHSEAERRRRERINAHLARLRSLLPNTTKTDKASLLAEVIQHVKELKRQTSEITEEACPLPTESDELTVDASSDEDGRLVVRASLCCDDRTDLLPDLIRALKALRLRALKAEITTLGGRVKNVLVVTGDDSAAAAACAGTDGDGEQQEEAMQAPMSPQHTVASIQDALRAVMERTASATEESGGSGAGGGLKRQRTTSLSAILENRSI

SEQ ID NO: 460 - protein, 177 aa, Oryza sativa
PTRPKNPRLRWTPELHLSFVRAVDRLGGQDRATPKLVLQLMNVRGLSIGHVKSHLQMYRSKKIDESGQVIGGESWRSDDHLLVGSKPYYPPAAEAEAPFRRSSASEGSNHQEGPLNLDLSLDICPRGEKRKRELISWRKHEEDHDHTTIAIGGDQEAESCATGLSLFLWFWIQCARP

SEQ ID NO: 461 - protein, 59 aa, Physcomitrella patens subsp. patens
RRYRGVRQRPWGKWAAEIRDPKKAARVWLGTFDTAEDAAMAYDIAATKFRGLRAKLNFP

SEQ ID NO: 462 - protein, 608 aa, Oryza rufipogon
MSSAAGGGGYGGGQGGGAEHHHHHHGHAGHLLLHHHPQHVAGAAVAAAAAAAGGQMYHVPQHSRREKLRFPPDAGDSPPPHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGGNGGVSLTLGLHQNNRVCIAEPLPAALPANLAHRFGLEEVSDAYVMSSFGGQDRHFGKEIGGHLLHDFVG

SEQ ID NO: 463 - protein, 368 aa, Arabidopsis thaliana
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSVSGTDGDAKQSEVKEKLPIKRSRGSLGSLNMITGKNNEPGKNSGASANGAYSKSGESASDGSSEGSDGNSQNSSLLFFHSAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKVKKK

SEQ ID NO: 464 - protein, 411 aa, Physcomitrella patens subsp. patens
MPSIFDVPSFCILKLSRRKCAKIKSLIHPVGEKRINSELWHACAGPLVSLPPVGSQVVYFPQGHSEQVAVSTQKEADIHIPNYPNLRPHLICTLENVTLHADLETDDVYAQMVLIPTQDPEKETMLLPDVVVQNKQPTEYFCKTLTASDTSTHGGFSIPRRAAEKVFPTLDYTQQPPAQELVARDLHDQDWHFRHIYRAGQPRRHLLTTGWSIFISAKRLQAGDAVLFIRDDKGQLLLGIRRANRLQTIMPSSVLSSDSMHIGILAAASHAAQTSSRFTIFYNPRQSPSEFVIPSAKYQKAVYSTQITVGMRFRMMFETEESTVRRYMGTVTGIGDLDPVRWPNSHWRSLKVGWDESTAGERQRRVSLWEIEPLTTPFLICPPPIVLRSKRARGIHGKALISRRRPRIVYI

SEQ ID NO: 465 - protein, 101 aa, Magnaporthe grisea 70-15
MPKAATKKSAKPEKRRAKKDPMAPKRGLSAYMFFANEQRDNVREENPGVTFGQVGKILGERWKALSDKQRAPYDAKAAADKKRYEDEKAAYQAGGDEDESS

SEQ ID NO: 466 - protein, 614 aa, Oryza rufipogon
MSSAAGGGGYGGGQGGGAEHHHHHHGHAGHLLLHHHPQHVAGAAVAAAAAAAGGQMYHVPQHSRREKLRFPPDAGDSPPPHGHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGGNGGVSLTLGLHQNNRVCIAEPLPAALPANLAHRFGLEEVSDAYVMSSFGGQDRHFGKEIGGHLLHDFVG

SEQ ID NO: 467 - protein, 612 aa, Oryza rufipogon
MSSAAGGGGYGGGQGGGAEYHHHHHGHAGHLLLHHHPQHVAGAAVAAAAAAAGGQMYHVPQHSRREKLRFPPDAGDSPPPHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGGNGGVSLTLGLHQNNRVCIAEPLPAALPANLAHRFGLEEVSDAYVMSSFGGQDRHFGKEIGGHLLHDFVG

SEQ ID NO: 468 - protein, 130 aa, Glycine max
MRDMKDAGALGGKTARACDSCVSRRARWFCAADDAFLCHGCDTLVHSANQLASRHERVRLQTASSKVTTTHAWHSGFTRKARTPRHNSKHFALQQRLKDEVLFNKNRWLWITMRRRNRCCVACPCSTLLM

SEQ ID NO: 469 - protein, 216 aa, Dendrobium sp. XMW-2002-8
MGRSPCCEKAHTNKGAWTKEEDERLVAYIKVHGEGCWRSLPKAAGLLRCGKSCRLRWINYLRPDLKRGNFTEEEDELIIKLHSLLGNKWSLIAGRLQGRTDNEIKNYWNTHIRRKLLSRGIDPTTHRPLHGQADASFVNEVEKVVSFRRREDENKSSNSSSSNSRSNSEEAKRWRCPDLNLELCISPPLQKQEDSEEDMMREEFGLCFTNGLLEFR

SEQ ID NO: 470 - protein, 612 aa, Oryza nivara
MSSAAGGGGYGGGQGGGAEHHHHHHGHAGHLLLHHHPQHVAGAAVAAAAAAAGGQMYHVPQHSRREKLRFPPDAGDSPPPHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLSGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGGNGGVSLTLGLHQNNRVCIAEPLPAALPANLAHRFGLEEVSDAYVMSSFGGQDRHFGKEIGGHLLHDFVG

SEQ ID NO: 471 - protein, 351 aa, Oryza sativa
SSFPARVRRREKWPLPSRQQQMLLKKVMAKKPKTKRLSGFGLKPSAAFSRPHVPSAAASLQPSRRVRVVFEDPDATDSDSDDDEDAGAASKKRYFELFIGKPASSTKQASPASTVAAYANIGKVGSTCYRGVRLRKWGKWAAEIRNPFTGHREWLGTFDTADAASAAYQSASRNFAEEKRRRGVASSASPASSATPTPTASSSSSTSAAPFAHPSPSSVLEATKPAPKPESPPLPEQAATPLLVEATNETAELPDDPEFYKDILRGLQLPDIDPMDFRAGLDALDISDVPAYMNGEQDVLFTEDMLLGDFAEEDDLDLDDIGDDFCEDFPEIPSGYDFGRGDMFRQVDFCV

SEQ ID NO: 472 - protein, 151 aa, Dendrobium sp. XMW-2002-9
MEEDGILINYIANHGEGVWNNLAKSAGLKRTGKSCRLRWLNYLRPDVRRGNITPEEQLLIMELHARWGNRWSKIARQLPGRTDNEIKNYWRTRIQKKVKNGDAVDYSSQMIIDEACTSHTSSIEEGMAQQNYPVHPNTNPEGYRLQTTRVN

SEQ ID NO: 473 - protein, 527 aa, Oryza sativa
  misc_feature (88)..(88): Xaa can be any naturally occurring amino acid
MMGGGLVMDQGMMFPGVHNFVDLLQQNGGDKNLGFGALVPQTSSGEQCVMGEGDLVDPPPESFPDAGEDDSDDDVEDIEELERRMWRXMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQFFIRDDTPFGNQMGDINGASEFRFGSGFNMSGAVEYPGAMQGQQKNDGSNWYY

SEQ ID NO: 474 - protein, 220 aa, Dendrobium sp. XMW-2002-10
MGRSACCEKAHTNKGAWTKEEDERLIAHIRTHGEGCWRSLPKAAGLLRCGKSCRLRWINYLRPDLKRGNFTDEEDELIIKLHSLLGNKWSLIAGRLPGRTDNEIKNYWNTHIRRKLLNRGIDPATHRPVSTATASNLTMSFSSGSSVKDKRTSSSSSSSRVGRISALLPRCPDLNLDLCISPSLEEQMPQDLLVEESNCGGEFLRLGSSFLLDYRSLEMK

SEQ ID NO: 475 - protein, 253 aa, Arabidopsis thaliana
MARSYNDHESSQETGPESPNSSTFNGMKALISSHSPKRSRRSVEKRVVNVPMKEMEGSRHKGDTTPPSDSWAWRKYGQKPIKGSPYPRGYYRCSSTKGCPARKQVERSRDDPTMILITYTSEHNHPWPLTSSTRNGPKPKPEPKPEPEPEVEPEAEEEDNKFMVLGRGIETTPSCVDEFAWFTEMETTSSTILESPIFSSEKKTAVSGADDVAVFFPMGEEDESLFADLGELPECSVVFRHRSSVVGSQVEIF

SEQ ID NO: 476 - protein, 247 aa, Vitis vinifera
MGRGRVQLKRIENKISRQVTFSKRRSGLLKKAHEISVLCDAEVALIVFSTKGKLFEYSTDSSMERILERYERYSLSERQLLSTDPDPQGNWSMDYPKLTARIEVLQRNLRHFVGEDLDPLSLRELQNLELQLDTALKRIRTRKNQLMHESISELQKKEKSLVEQNNALAKKVKEKEKVEQNNRAQWEQQNNIGQNSSAYVVPPPPLQLPSLTMGGSFVGRAVEEDGAEARPSPNTLMPPWMLRHVNE

SEQ ID NO: 477 - protein, 789 aa, Coccidioides immitis RS
MTSQGSSRKRPAPGTVPISQHPIAPSHNYPVSDSQLSNDQFLQWGQAGPPLVNPPGNSPIDPYQSVPHPADMGSIQAASQQLARRPGNQLIGRPRKNEQGVMTLMEPPPRPGEVIDPATGETEEQLEQRALAAKKEAQAKRKQIPPFVQKLRSFLDESKNTDLIRWSEDGRSFIVLDEDQFARTLIPELFKHSNYASFVRQLNMYGFHKKVGLSDNSMRASERKNKSPSEYSNPYFRRGHPDLLWLIQKPKNVSQSKAAAKGPSRMKTEGEGDDGENEEYVEDGGSREDRSRFRGQLSISPGDAALAKEQFANVYRELQNIRHQQQVISNTISKLRREHEQLYDQALNFQEQHNRHENSINAILTFLATVYNRSLQGHDGAQGMINSFAAGTMPQEQGQGNIIDVGDYLGNVESNLNPAQRPTKKQPLLLKAPPAGGQEPSPSRASTSSPANNQYDIQQGTNNGHGHRPSTRAGSVEELFESVSPQHTGQPPHQQPYTPVSHARSPSDAKYPPQRDIMSLIQSSNARSNMQPGAADFPSVLSSLENAGGHVPLTATQRADMLRLIANESHASDPSAISSPNNALITPNPPPMPHSYSTRLANTRAEIDNLVKMQAEQDRNVPPPTLDLDQIFHSGDYFSDYANMEPIKGGMASGYGSNQGAQTNTQDDHNNENSGDSLVAQAHDLFDFDKLQSDHVGELFADGNTDPKQAQTNSFFDAYGSGNEGGNLRQTGAGDLSGNGGNRITETFTSSEATSPANTSVDENLQALDNSNGSSFGARSPVKRRKRAQ

SEQ ID NO: 478 - protein, 135 aa, Physcomitrella patens subsp. patens
MSDACEDPGDVKRPDVGGNERSPDGTNAAAGADSGADEQEDSSERVESPTSSRRQETEVRKKAKAEGDTRHPIYRGVRKRPWGIWVTEIRRPKKKSRIWLGSFATAEMAARAYDCAALALRGNGALLNFPKLAHS

SEQ ID NO: 479 - protein, 212 aa, Glycine max
MRRGRATAAVVDPTAEQAKETRFRGVRKRPWGRFAAEIRDPWKKQRVWLGTFDSAEDAARAYDKAARSFRGPKAKTNFPSFPGPTDHHSSQQIPPLYQAHGLSTKFEPAQVNRPTTSGMSSTVESFSGPRVPPSSSSSRKPLVVVNPIIPLDDDDDDCHSDCDSSSSVVDDQDCVLTSSFRQPLPFDLNLPPPDAAYDDDDDDDVPATALCL

SEQ ID NO: 480 - protein, 236 aa, Vitis vinifera
MFQRIWSEEDELGILKGMIDYSAKNGSVPYPNGDMNEFYDFVKNTLHGDFSRVQLTDKARRLKKKYSNNVSRAKLGEDPTFQKPHEQRAFELSKKIWGGEGNSVGVQQSNKANGKARKNQKPNKAVKVEDVEVLSVINGDDKEAVKLENEPKSEPPKKYSLVVSDFTRINESVGMSSSMDRAIEIGLGLLSEPVKAELKEKWKELEDEEFQLYMKKLDLIQMEARVSMQAYRAKHQ

SEQ ID NO: 481 - protein, 164 aa, Brassica napus
SRSPPERPGFTCENGQCPHSKINLGFQDRSSRDNHQMVCPYRDNRLAYGVRPVVVSQQSQPFPQPVQPIDLSGYGVPKNGQKMITELMAMYDRNVQSSQASNQSMIIDSTAAQNYQEQQLCFNRNQMFMQQGNSEINNQSQMVFDSTSFDISSFDYKNDWQAGV

SEQ ID NO: 482 - protein, 161 aa, Triticum aestivum
  misc_feature (6)..(6): Xaa can be any naturally occurring amino acid
  misc_feature (17)..(17): Xaa can be any naturally occurring amino acid
PSGAPXLCCPMCRAITXVPPPAPAVEMAQLICGGCRTLLMYTRNADTVRCSCCSTVNLVRPVNNIAHVNCGRCRTTLMYPHGAPSVKCAICDYITNTGINTMSPAPCPRPTSNESAYNASSASVPTPQPQNVTVVVENPMTVDEKGKLVSNVVVGITPGKN

SEQ ID NO: 483 - protein, 215 aa, Vitis vinifera
MKIQCSFCSKEEASVFCTADEAPLCDICDRQVHHANKLAGKHKRYSLLRPSDKDFPSCDLCQDKRAFLFCKEDRAILCRECDVSIHKANEHTRKHYRFLLTGVKLSASASEYPISASSSSPSTIDSETKPSKSSTKRPTSVSADIFCNTAIGAEIKPSKTSTKRPTSVSAASYKRDHDNQSISEYLMETLPGWRVDDFLDPSSGFSEVCSTTHYI

SEQ ID NO: 484 - protein, 931 aa, Vitis vinifera
  misc_feature (113)..(113): Xaa can be any naturally occurring amino acid
  misc_feature (216)..(216): Xaa can be any naturally occurring amino acid
MEDGAPPPETALGTVPDSSMDLDFMDELFLGGCWLETTDGSEFLLQSPSNSGSVFDPSSLWPTFGSNNVDLSANLSANNIQEETQRSNFPGNAVESTDKTQSLSQSMTNVAGXPVQSENYLMDDFDLSRRWWIRPKSSPGPSSTVMERLIRALSYIRGSTKNKDALIQIWVPVNRGGRRVLTTNDQPFSLDPSCPRLARYRDISVNYQFSAEEDSXELAGLPGRVFLGKVPEWTPDVRFFRSEEYPRVDYAQHFDVRGTLALPVFEQGSQTCLGVIEVVMTTQKSNYRPELESVCKALEAVDLRSSEVLSTRNVKACNKFYQAALPEILEVLTSACGTHGLPLAQTWVPCIQQGKWGSRHTDGNYIHCVSTVDSACCVADPRTQGFHEACSEHHLLKGQGIAGRAFTTNEPCFSADITSFSKTQYPLSHHARMFGLCAAVAIRLRSIHVPVSDFVLEFFLPVDCRDPEEQKGMLCSLSIIIQKVCRSLRVVTDKELEGETPSLVSELTVLSDGSPGREETQKVQHTPTEKISQEQSSWMASLKEAQQSIDITPPSQKEKVRERLSEKSLEFRQHQQDSSQQGSFDCRDDSTFGKSSLSSVGKTGERRRSKAEQTITLQVLQQYFAGSLKDAAIKSIGVCPTTLKRICRQHGIKRWPSRKIKKVGHSLHKIQLVIDSVKGASGAFQIGNFYSKFPELASPELSGTHPYSTSKLFDHQKPLSVQPEGDNSSTGVAASKSLSSSCSPSSSSSQCCSTGTQEHPSTCSVTGSDPMVGENSAEGMLKRVRSEVELPISSQEELKLLPRSQSHKSLPECPNLESHPAIPQSGSLASQEGDAWRVKVTYGDEKIRFRMQSNWGLKDLRQEIGRRFNIDDSSGFHLKYLDDDLEWVLLTCEADFEECKDICGSSQNHVIRLAIHQISHHLGSSLGSTCP

SEQ ID NO: 485 - protein, 138 aa, Physcomitrella patens subsp. patens
YKGVRMRTWGKWVSEIREPNKRSRIWLGSFPTAEMAAKAYDAAVVCLRGPSATLNFPDCPPSNLCRCTAPRDVQAAAAAAAAACAPLTESTESTPQSPGTASSEVETGSHHDSSSDGATKDSFQCSTPTTSQPNSMAM

SEQ ID NO: 486 - protein, 612 aa, Oryza nivara
MSSAAGGGGYGGGQGGGAEHHHHHHGHAGHLLLHHHPQHVAGAAVAAAAAAAGGQMYHVPQHSRREKLRFPPDAGDSPPPHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDSDPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGVGGGNGGVSLTLGLHQNNRVCIAEPLPAALPANLAHRFGLEEVSDAYVMSSFGGQDRHFGKEIGGHLLHDFVG

SEQ ID NO: 487 - protein, 127 aa, Lamprocapnos spectabilis
PRDRRMRLSLEIARRFFTLQDMLGFDKASKTIEWLLTKSNGAIIELSRSLSETETTKRSSISEVSECEVVSELIHTTNVDDDDQVVVLPQQKLINSKEKRVRAIRKTKYHNPPLGKDSRAKARARAR

SEQ ID NO: 488 - protein, 58 aa, Physcomitrella patens subsp. patens
TAKGPRDRRVRLSVPTAVQFYDVQDRLGFDQPSKAVEWLIKNAKAAIDELAQVPPMRQ

SEQ ID NO: 489 - protein, 197 aa, Vitis vinifera
MASTISQCTKKEANRGAWTAEEDYKLAQVIAVHGAKRWKCVAMKAGLKRCGKSCRLRWMNYLRPNIKRGNISDQEQDLILRLHKLLGNRWSLIAGRLPGRTDNEIKNYWNSHLSKKIKQKEKQSRSSTTVECRPQKTKVMEMESVDNGSERVASKGDEDSKTSFVGDESFDYSSEGPLNLEWMSKFLEMDEAWLDFA

SEQ ID NO: 490 - protein, 207 aa, Triticum aestivum
MSDCSTGTDSPRADSVDEQPPADAESPGGGQSKRDHPSPSSPLPPPKRSRRSVEKRVVSVPISECGERAKTNGEGPPPPDSWAWRKYGQKPIKGSPYPRGYYRCSSSKGCPARKQVERSRADPTVLLVTYSYDHNHPWPAPKSGCQPNKSSPRLVDPSPSLARRWSARPSTDLKRRSTGLKRRRQIRKRSMSRSLSSVWPDPGGSRR

SEQ ID NO: 491 - protein, 233 aa, Oryza sativa Indica Group
MGLTHLGPAQIQQIQAQFLAQQQQQRALAGAFLRPRGQPMKQSGSPPRAGPFAAVAGAAQSKLYRGVRQRHWGKWVAEIRLPKNRTRLWLGTFDTAEDAALAYDKAAFRLRGDLARLNFPTLRRGGAHLAGPLHASVDAKLTAICQSLATSSSKNTPAESAASAAEPESPKCSASTEGEDSVSAGSPPLPTPLSPPVPEMEKLDFTEAPWDESETFHLRKYPSWEIDWDSILS

SEQ ID NO: 492 - protein, 247 aa, Oryza sativa Japonica Group
MEQLFVDDPAFASSMSSLEADIFSGAGQLPSSPWLDLDLDDDVQDLSMAPTTANAVSSGYGSGGSGSHRKLSHNAYERDRRKQLNELYSSLRALLPDADHTKLSIPTTVSRVLKYIPELQKQVENLERKKKELTTTSTTNCKPGVLGSQLMSEGMAPIVSATCINDMEIMVQVSLLSNVAGSVLPLSKCIKVLENEGLHFISSSTSSGFGNRTFYSIHLQRSEGTINEECPAFCERLEKVVRNKAKL

SEQ ID NO: 493 - protein, 216 aa, Capsella bursa-pastoris
MNSFSAFSEMFGSDYESSVSSGGYYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 494 - protein, 282 aa, Mesembryanthemum crystallinum
MSLIANFESDFAVLESIRRHLLEDWDPRAGAPAITTGSGPVYHRNSSFSSLYPCLTDNWGELPLKEDDSEDMVLFGVLRDAVHTGWSPQSGSESGSGSPAPVTVKPEPVDSPVSSPAPVRVAGGEAPVAAAPARGKHYRGVRRRPWGKFAAEIRDPAKNGARVWLGTFETAEDAALAYDRAAFRMRGSKALLNFPLRVNSGEPDPVRITSKRSSPERSVSSSSSESASPKRRKKEEVVVGPVAGQARPGLQQVGNVVEGMQVGVGCQVGVGTMPLGDQLLVT

SEQ ID NO: 495 - protein, 153 aa, Oryza sativa
  misc_feature (135)..(135): Xaa can be any naturally occurring amino acid
MASSSQTTVSMEVAMKVEGSGGGGGDGEEGEVVAKKEEEVAAAAAAMELDLLGALRAEEVMPAEKGKAAVVMVGEAVAPSVEERASAVAAAAANGGGGGGEARRRLFKCNYCQRKFYTSQALGGHQNAHKRERSXLAKRGAAVAAAAAAAGRG

SEQ ID NO: 496 - protein, 910 aa, Arabidopsis thaliana
MVTTGNSRYERGNGNREIKTKEGIKWTTEASFELFQRRIWRFLVDIVCLEAYLVPDETDLSFGRYGEFGGFNESDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 497 - protein, 92 aa, Candida albicans
MAPGERKKSSRKKKDPDAPKRSLSAYMFFANENRDIVRAENPGISFGQVGKLLGEKWKALNSEDKLPYENKAEADKKRYEKEKAEYAKKNSA

SEQ ID NO: 498 - protein, 312 aa, Populus trichocarpa
MMPRSCSQCGNNGHNSRTCGESPAGGDQSSSTGIMLFGVRVTEVAASFRKSYSMNNLSQYDEQPHEEPNADVAAGYESDDVVHASGRSRERKRGVPWTEEEHKLFLLGLQKIGKGDWRGISRNFVKTRTPTQVASHAQKYFLRRNNQNRRRRRSSLFDITTDTFMGSSMEEDQVHQETATPALPQLQLQPRPCLNNNRPGGFPMSTFPVTAISPVTSPVSGDNPLEKLTSGQTNVNKKSSKLVRPVPIVPIPPSSKMADLNLNQKSPEDQFPALSLKLSTPSSEEQQQSPPASTHSSTFQAISSSDSIISVA

SEQ ID NO: 499 - protein, 224 aa, Oryza sativa
MAKSRPPKRILESYTIKGSDKVIKHYGSSVSGDCVLMRASDTSKPPYVARVEAIEAAGSRGTNVRVRVRWYYRPEESMGGRRPFHGAKEVFLSDHYDVQSADTIEGKCNVHSFRSYTKLDSVNAEDFFCRFEYKSATGSFVPDRIAVFCKCEMPYNPDDLMIQCEECSDWFHPSCIGMTIKDAKKLEHFFCQSCTAENGKMAENSHEATAQSEEKQVESKRRRR

SEQ ID NO: 500 - protein, 171 aa, Vitis vinifera
MQSHLMCNGCRSILVYPRGATNVCCALCNSVTSVPPPGLEMAQLICGGCRTLLMYTRGATSVRCSCCHTVNLAPAPSNQVAHVNCGNCRTTLMYPYGAPSVKCAVCHYVTSVGMVNVRVPIPVHRPNAAAISASTPSTSSSQTVVVKNPMSVDESGKLVSNVVVGVTTEKK

SEQ ID NO: 501 - protein, 466 aa, Medicago truncatula
TSLNLLTTNTSNDQSMMEEDIASDSEDKRAKLELVVLQAELERMKVENHQLRNMLDEGNRKYNTLQMHWMSMVQDKKVEDCNEEQKQVMGGKLDEEKQNGNGGVLVPRQFMELGLPANHSDAIDEPRSQDQSKSLANNNEEGSKDEELVLDHDKKESDRGNERNGSPADRVLAANNNNNVANFSPQTNVEQAEATMRKARVSVRARSEANMINDGCQWRKYGQKMAKGNPCPRAYYRCTMALGCPVRKQVQRCAEDKTILITTYEGHHIHALPPAAMEMVQTTSSAARMLLSGPMTSADGLMNPNYLTRAILPYSSSIATISASAPFPTVTLDLTQSPNQNQFPNNHSNQFQFPFPQNFLPQVFGQTLLNQSKFSGLQMSQDAANSSQQTPQNLADTVNAIAADPNFTAALAAAITSIIGAAQPNNNNGTSNNGNGTIANNSNGNVTSSNNTNGSPKINNPNSSVE

SEQ ID NO: 502 - protein, 373 aa, Populus trichocarpa x Populus deltoides
MEGGGGDGGSSTTSCMMAFGDNSNGLCPMMMMTPLMSSSSSAHHQHPHHHHRANEGDSSISNTLFLPLPPTNNQGHNRIHSNASGSSSMIIDDHNRNHNNNTVTATGCYFMDNNDGSSSSVKAKIMAHPHYHRLLAAYANCQKVGAPPEVVARLEEACASAASIAPANTGCIGEDPALDQFMEAYCEMLTKYEQELSKPLKEAMLFLQRVECQFKALTLSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 503 - protein, 368 aa, Populus trichocarpa x Populus deltoides
MEDYNQMSENTTPRGNFLYASQLLAPNSSPYGRTSSGSTVSNQQTQMPLNPFHLQSNDQCFQSDTHPIVKTEASTSHAQKFHYPLLRGYQTINQQQQGSESSSEVEAIKAKIIAHPQYSNLMEAYMDCQKVGAPPEVVARLAAARQEFESRQRSFITSRDNSKDPELDQFMEAYYDMLVKYREELTRPIQEAMDFMRRIETQLNMICHGPLRIFNSDDKSEGVGSSEDDQDNSGGETELPEIDPRAEDRELKNHLLRKYSGYLGSLKQELSKKKKKGKLPKEARQKLLSWWELHYKWPYPSETEKVALAETTGLDQKQINNWFINQRKRHWKPSEDMQFMVMDGLHPQNAALYMDGHSMGDGHYRLGP

SEQ ID NO: 504 - protein, 340 aa, Physcomitrella patens subsp. patens
MSDAGGNPHGVGKERSPDGNAGVDSGADEQDDSNERVESPTLSKREEREVRKKAKLEGDTRHPIYRGVRKRPWGIWVTEIRRPKNKSRIWLGSFATAEMAARAYDCAALALRGNGALLNFPKMAASLPRPADLTDKSIQAAATIAANNFAQLPSEMDVYGAMPSQSALSSSPKGDEDHQQHGSQQKLRQTSKSTTFTLGRVGGSSSQRLISNSDGSKSYQPSSSTKQGEEANLHKIIVSTSNPQSRSSEIAGTQSRYSSMCTSDTESMENLKHHATGGENNPPSSSGVQQLLFVDSEDMFTIGFTNLCDAMCIPPPAPEHATETDGEEGSTIWEPHLWSY

SEQ ID NO: 505 - protein, 372 aa, Solanum lycopersicum
MCGGAIISDLVPPSRISRRLTADFLWGTSDLNKKKKNPSNYHSKPLRSKFIDLEDEFEADFQHFKDNSDDDDDVKAFGPKSVRSGDSNCEADRSSKRKRKNQYRGIRQRPWGKWAAEIRDPRKGIRVWLGTFNSAEEAARAYDAEARRIRGKKAKVNFPDEAPVSVSRRAIKQNPQKALREETLNTVQPNMTYISNLDGGSDDSFSFFEEKPATKQYGFENVSFTAVDMGLGSVSPSAGTNVYFSSDEASNTFDCSDFGWAEPCARTPEISSVLSEVLETNETHFDDDSRPEKKLKSCSSTSLTVDGNTVNTLSEELSAFESQMKFLQIPYLEGNWDASVDAFLNTSAIQDGGNAMDLWSFDDVPSLMGGAY

SEQ ID NO: 506 - protein, 154 aa, Lamprocapnos spectabilis
PRDRRMRLSLPIARQFFSLQDMLGVDKPSKTVQWLLTMSKSAIDELTLSFSKRGDSFHVSTGDIINGGGGGGCKSGSSMSECEVVSEIEEAVTYNQEERRSKDLSKGKGKSLEGSSSPNPPNRKGKKMIRPSTRKTTYHPLARESRAKARERAR

SEQ ID NO: 507 - protein, 445 aa, Triticum aestivum subsp. spelta
MVLDLNVESPADSGTSSSSVLNSADAGGGGFRFGLLGSPDDDDCSGEPAPVGPGFVTRQLFPASPPGHAGAPGVTMGQQAPAPAPMAPVWQPRRAEELLVAQRMAPAKKTRRGPRSRSSQYRGVTFYRRTGRWESHIWDCGKQVYLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIIAGLQLTFDSPESSTTMVSSQPMSSSSSQWPVHQHGTAVAPQQHQRLYPSACHGFYPNVQVQVQERPMEARPPEQPSSFPGWGWQAQAMPPGSSHSPPPAASSGFSTAAAGANLAPPPPYPDHHRFYFPRPPDN

SEQ ID NO: 508 - protein, 291 aa, Zea mays
MWLLCLVSRKNQARKVVCIPAPAASAGGRTTGEVVPSDLWAWRKYGQKPIKGSPYPRGYYRCSSSKGCPARKQVERSRTDPSLLVITYNWEHNHPWPTQRNALAGSTGSHHAKSSKNKYSSHSLPQTPNLKAEPEHHQASGAVPSATAATAATATSTTTTTSTTSNSTPPPPPTMAVKEEAIMVGSEMEKVIDHHDASGWLDHGDLMQQMFSQSYYRPMIPEAAGGGLHADDFFADLAELESDPMSLIFPAGGEPGKENKSLDADPLFNMLDWGATNVAATSSFEQDESGW

SEQ ID NO: 509 - protein, 278 aa, Musa acuminata
MAMSHLSMVEARLPPGFRFHPRDDELVCDYLERKVSGENGNGGMHGWPVIVDVDLNKCEPWELPEMACVGDKEWYFFNLRDRKYATGQRTNRATRSGYWKATGKDRRVARRGMLVGMRKTLVFYRGRAPKGRKTDWVMHEFRIEPSSNPPNFSFEEDWVLCRVSSKTRGVITKPDVKNYDDDTTSSSLPPLRNTYITFDQAPRSLEGFEQVPCFSNFTAQLAAAAPPVGSPDLSYYDNKFSTRPAFDHFPKLNPPNIIQENLESYFGENAVSHMRNPF

SEQ ID NO: 510 - protein, 266 aa, Glycine max
MVQQEIRRGPWTEQEDYKLVYFVNMFGDRRWDFIAKVSGLNRTGKSCRLRWVNYLHPDLKRGKLTPQEEHLVMDLHSKWGNRWSRIARRLPGRTDNEIKNYWRTHMRKKKAQEKKHASAASPVSSSCQSSLSSNNHVVDSHASKEVGEESCYDTGGYDDGMMMGLIGGEKGYSMDDIWKDIMSEEENNIYNNNLQPVYEGHSEEGCNFSCPPPPMIMPSPPSWDQYNISSQPLWVMDEEESNKMLFPTLSDQYFPYYEQGNAFLTG

SEQ ID NO: 511 - protein, 128 aa, Oryza sativa
  misc_feature (18)..(18): Xaa can be any naturally occurring amino acid
  misc_feature (41)..(41): Xaa can be any naturally occurring amino acid
  misc_feature (66)..(66): Xaa can be any naturally occurring amino acid
SGFNYLGNSKWKKRAWTXEEDNYLTRLVMKHGPQKWTLIAXNLPGRVGKQCRERWHNHLSPNIKKXEWSKREEWILFLAHKKMGNRWAEIARFLPGRTDNAIKNHWNSTMKKRSSVYAEKLKRYRSGQ

SEQ ID NO: 512 - protein, 107 aa, Oryza sativa Indica Group
MESSSGSQLGKNSKTSDDRETKATSSLLLLITAIHFVALCPKGENEDARKEVNSTAQNFVHFTEEEEDIVFRMHRLVGNRWELIAGRIPGRTAEEVEKFWAIKHQAT

SEQ ID NO: 513 - protein, 334 aa, Triticum aestivum
  misc_feature (232)..(232): Xaa can be any naturally occurring amino acid
  misc_feature (254)..(254): Xaa can be any naturally occurring amino acid
  misc_feature (275)..(275): Xaa can be any naturally occurring amino acid
  misc_feature (292)..(295): Xaa can be any naturally occurring amino acid
  misc_feature (300)..(300): Xaa can be any naturally occurring amino acid
MAYQYHHQDHALGMDAAAAAAGNPGGGFAPGLGAGAGGGGWEREKAAIEAHPLYERLLEAHVACLRVATPVDQLPRIDAQIAARAPPPMPPAGAPAGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKACGPQGRTYCRKRKAGNAPXDRASTLKAWCQAHPKGAYPTDXDRAGMGPATGLLLNQNHRGLXNQRNGNLVPNPDSSFSXXXXLKKKXEGTGSPPCKGSGKKKTSPLPPGRRGRVKKACERR

SEQ ID NO: 514 - protein, 221 aa, Brassica napus
  misc_feature (128)..(128): Xaa can be any naturally occurring amino acid
MSDTGNDEQMDVGSVVEAVSADHSFGAPLYVVESMCMRCGKNGTTRFLLTLIPHFRKVLLSAFECPHCGERNNEVQFAGEIQPRGCSYRLEVSAGDDKIFDRQVVKSESATIKIPELDFEIPPEAQRXSLSTVEGILARAADELSALQEERRKVDPKTAEAIDQFLSKLRACAKAESSFTFILDDPAGNSFIENPHAPSPDPYLHIKFYERTPEQQAALGY

SEQ ID NO: 515 - protein, 287 aa, Oryza sativa Japonica Group
MEVLPPMDHYASRGNWFMARKWSPEENKQFERALAGLDLRCPDWDRVARAIPGRSALEVMNHFRDLELDVQQIENGMVPFPVYGAAAAGGAFTLQWDGAHGVGDFRNAYRFGGGGGGKRHFGRTPEQERKKGVPWTEEEHKLFLLGLKKYGKGDWRNISRNFVQTRTPTQVASHAQKYFIRLNSGGKDKRRSSIHDITTVNLTDDRPPSPSQSSLISNQSNTSTLTAAVAPFSSTADVKPQNAANASFNSPSRTLGMAGYGMGLQDQGLQCGGPLHDQLAASRSILF

SEQ ID NO: 516 - protein, 228 aa, Triticum aestivum
MARERREIKRIESAAARQVTFSKRRRGLFKKAEELSVLCDADVALIVFSSTGKLSQFASSSTNEIIDKYSTHSKNLGKTDQPALDLNLEHSKYANLNDQLAEASLRLRQMRGEELEGLSVDELQQLEKNLETGLHRVLQTKDQQFLEQINELHRKSSQLAEENMKLRNQVGQIPTAGKLVVADTENVVAEDGQSSESVMTALHSGSSQDNDDGSDVSLKLGLPCLPWK

SEQ ID NO: 517 - protein, 437 aa, Triticum aestivum
VTLQNKFVQKSRLPPVRNSRDIVDPRVRASAGAAIGARAARACDGCMRRRARWHCAADDAYLCQACDASVHSANPLARRHHRVRLPSSSSPAATSSLQHADPDEPAWLHGLKRRPRTPRSKPGTVGKHGAPAAAKAAAASAVPDLEAEDSGSGIVGDNDDGHGVEVDDEDLLYRVPVFDPMLAELYNPMPVDEFREPLEQKPAVCCFSSLANQPSSEYASGVAEAADGFTGFDVVPDMELASFAADMESLLMGGVEEGFDDLRFLDEEKPQLNLDFDMADFDDQSTAAPAPEQELEDRKRKRSDSGMILKLDYERVIDSWAHDGGSPWFYGERPHIDPSDDSWLDLPAGSRGFGLGAAVTAVTGGEREARVSRYREKRRTRLFAKKIRYEVRKLNAEKRPRMKGRFVKRTALPPLPPRPPMVLAGHGHGGAHGRFRF

SEQ ID NO: 518 - protein, 639 aa, Zea mays
MTDGHHFNNILLGGRGGTNPGQFKVHSGGLAWKRQGGGKTIEIDKADVTAVTWMKVPRAYQLGVRIKAGLFYRFIGFREQDVSNLTNFIQKNMGVTPDEKQLSVSGQNWGGIDIDGNMLTFMVGSKQAFEVSLPDVAQTQMQGKTDVLLELHVDDTTGANEKDSLMDLSFHVPTSNTQFVGDESRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEAVVERDLALSKELLVEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRNEYHNLFNFINGKNIKIMNLGGDGQGASGVVTDVLRDTDDDAVDPHLERIKNQAGDEESDEEDEDFVADKDDSGSPTDDSGDEESDASDSGGEKEKSSKKEASSSKPVQKRKHKARDDEGQEKKKPKKKKDPNAPKRAMTPFMYFSMAERGNMKSSNPDLPTTEIAKKLGEMWQKMSGEEKQPYIQQAQVDKKRYEKESAVYRGEATVDVDSGNESD

SEQ ID NO: 519 - protein, 364 aa, Hordeum vulgare
MEEIGHHFGLGATAHGQHHSQLPWGSSPLSAVISPPPQQQQQHQQQSAGYLAHSPLSLNTAPPGVSHGGGSGCSNPVLQLANGSLLEACAKAAKEPSSSSYAADVEAIKAKIISHPHYSSLLAAYLDCQKVGAPPEVSARLTAVAQDLELRQRTALGGLGTATEPELDQFMEAYHEMLVKYREELTRPLQEAMEFLRRVETQLNSLSISGRSLRNILSTGSSEEDQEGSGGETELPEIDAHGVDQELKHHLLKKYSGYLSSLKQELSKKKKKGKLPKEARQQLLSWWEMHYKWPYPSESQKVALAESTGLDLKQINNWFINQRKRHWKPTDEMQFVMMDAYHPPNAAFYMDGHFVNDSGLYRFG

SEQ ID NO: 520 - protein, 298 aa, Vitis vinifera
MKNASSTSPSSTLSPSSSPSTSSFYPSSDFYSPISTQYPDGCSTSTTHVISQGFSSHDLQGFEHSGPIGLNHLTPSQIHQIQAQIQLQQHHNHMPAVAAAASPKPIPMKQVGVPPKPTKLYRGVRQRHWGKWVAEIRLPKNRTRLWLGTFDTAEEAALAYDKAAYKLRGDFARLNFPNLRHQGSHIGGEFGDYKPLHSSVDAKLQAICQSLAETQKQGKPTQGKKSRSRAVAPSASQPPTSSSMFTESDGSGGSSPLSDLTFPDDCEEAPFYGAWENFNLQKYPSNEIDWAAISSQWP

SEQ ID NO: 521 - protein, 258 aa, Oryza sativa Japonica Group
MVKNTSNKCIAAAGATAAAGLGGGAASCSGGGGDGKVTTAAAAALAVRPYKGVRMRSWGSWVSEIRAPHQKRRIWLGSYATPEAAARAYDAALLCLKGSDAVLNFPSSASSRRRLDIHRGGTDSAAGDMSPRSIQRVAAAAAAAFDAAAAAVVVDESCSCSAEAMSSTPTSGATSLSTLGSSGGGDVLDHATTPSSSSSAAANVCSPPLEGDHELWTELDAFASPKFMDLMAAGGTAFSSPWEEPEEDGELMRLWSFC

SEQ ID NO: 522 - protein, 382 aa, Zea mays
  misc_feature (215)..(215): Xaa can be any naturally occurring amino acid
MGKGDVATRSKPQKSSAIQNEPSTPANPPTAYPDWSQFQAYYNAAGTGPVTPPAFFHSSVAPTHQGHPYMWGPQMMPPYGTPPPYATMYAQGTPYQQAPMPPGSYPYGPYPMPSPNGTIQPPTSGAGGTETDKSKNKRKTPLKRSKGSLGSLDVVAVKNNKSAAKPSVSSSNEGSSQSESGSGSSSEGSSTNSKSGSRAKDGSERGQGNDARSKXVLKSSVVEPTQPSSGSVVLNPMMPFWPVPPPMAGPATTLNMGVDYWGTPASVPMHGKVIAAPTSAPSSNSRDIVLSDPTIQDGRELKRQKRKQSNRESARRSRLRKQAEWEEVANRAVLLKQENSSLKEELKQLQEKCDGLTSENTSLHEKLKALEDEKSNGNWYKD

SEQ ID NO: 523 - protein, 255 aa, Petunia integrifolia subsp. inflata
MSTSNASTSGVRKGAWTEEEDLLLRECIEKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNHVSCWNGKSCSKNTIDKNEGDTEIIKFSDEKQKPEESIDDGLQWWANLLANNIEIEELVSYNSPTLLHEETAPSVNAESSLTQEGGSGLSDFSVDIDDIWDLLS

SEQ ID NO: 524 - protein, 609 aa, Arabidopsis thaliana
MDTPEKSETQIGTPVSKLKVEDSPVFSYICNLSPIKTIKPIPITCPLSSLNYASPPSVFTSPHAVSHKESRFRSQKDVSASKEVGEEEALVGSEPEQSYKNDCNTPRVLNDVKDNGCGKDLQVMMDNVKKKSDTPDWETLIAATTELIYGSPRESEAFSCLLKKTSNSEARLRGSITATSVAVTNTDVVNNESESVDALSILHRGVRRRCLDFEVKGNNQQTLGESSSSCVVPSIGLHLNTIAMSSKDKNVANEYSFSGNIKVGVQSSLTPVLHSQHDIVRENESGKDSGQIIEVVPKSLASVDLTPISPKKKRRKSEQSGEGDSSCKRCNCKKSKCLKLYCECFAAGFYCIEPCSCINCFNKPIHKDVVLATRKQIESRNPLAFAPKVIRNSDSIIEVGEDASKTPASARHKRGCNCKKSNCLKKYCECYQGGVGCSINCRCEGCKNAFGRKDGSLFEQDEENETSGTPGTKKTQQNVELFKPAAPPSTPIPFRQPLAQLPISSNNRLLPPQSHFHHGAIGSSSSGIYNIRKPDMSLLSHSRIETITEDIDDMSENLIHSPITTLSPNSKRVSLSHLDSPESTPWRRNGEGRNLIRSFPTFPSLTPHH

SEQ ID NO: 525 - protein, 255 aa, Petunia integrifolia
MSTSNASTSGVRKGAWTEEEDLLLRECIEKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNHVSCWNGKSCSKNTIDKNEGDTEIIKFSDEKQKPEESIDDGLQWWANLLANNIEIEELVSYNSPTLLHEETAPSVNAESSLTQGGRSGLSDFSVDIDDIWDLLS

SEQ ID NO: 526 - protein, 254 aa, Petunia integrifolia
MSTSNASSSGVRKGAWTEEEDLLLRECIEKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNHVSCWNGKSCSKNTIDKNEGDTEIIKFSDEKQKPEESIDDGLQWWANLLANNIEIEELVSYNSPTLLHEETAPSVNAESSLTQGGSGLSDFSVDIDDIWDLLN

SEQ ID NO: 527 - protein, 78 aa, Oryza sativa Indica Group
MDSSSGSQGKNSKTSDGCETKEVNNTAQNFVHFTEEEEDLVFRMHRLVGNRWELIAGRIPGRTAKEVEMFWAVKHQNT

SEQ ID NO: 528 - protein, 359 aa, Nicotiana tabacum
MGICDPIHQLGMWDDFNSSFPSTSATMILEVDKCLEDQIPIMEKRLDNETEDTSHGTVGTSNRYEPETSKPVEKVLRRLAQNREAARKSRLRKKAYVQQLENSKLKLIQLEQELERARKQGMCVGGGVDASQLSYSGTASSGTAVFDMEYGHWVEEQTRQTNDLRIALHSQIGEAELRIIVDGYLNHYFDLFRMKATAAKADVLYIMSGMWKTSAERFFMWIGGFRPSELLKVLTPHLELLTEQQLREVCNLTQSCQQAEDALSQGMVKLHQILAEAVAAGRLGEGNYTLPQMGPAIEKLEDLVRFVNQADHLRQETLQQMSRILNTCQAAQGLLALGEYFERLRVLSSQWATRLREPT

SEQ ID NO: 529 - protein, 130 aa, Papaver rhoeas
  misc_feature (127)..(127): Xaa can be any naturally occurring amino acid
PRDRRMRLSLKVARPFFAIQDMLGFDKASKTVEWLLTNCKEEINELKRSLRISDEDDTVMMAATNKRSSCSRGGKNVSSTSDCEVVSEIDVSNNSSSNNLRKEKKVRPSRKPTFHPQAKESRAKARXRAR

SEQ ID NO: 530 - protein, 257 aa, Oryza sativa Indica Group
MAALDSLTRQPRDGTSHPGRPFLPPTADLASSVIWTGTGCAEEVYHTFGFWGSSTLIGRNVRRQRVRPRGQDMECPYCDSGFVSEMDDVDALMRHFVGMDPDFHRDPRFGIMEAISAVMRHGMAGTNREVDVRGRPNIFSDLEMEFGSGPWLLFRGQLPGHLSEDNGFDVFINGRRGVGMRRANIADYFVGPGLDDLIEQLTQNDRRGPPPATQSSIDAMPTVKITQRHLSGDSHCPVCKDKFELGSEAREMPCKHL

SEQ ID NO: 531 - protein, 233 aa, Oryza sativa Japonica Group
MGLTHLGPAQIQQIQAQFLAQQQQQRALAGAFLRPRGQPMKQSGSPPRAGPFAAVAGAAQSKLYRGVRQRHWGKWVAEIRLPKNRTRLWPRHLRHRRGRRARLRQGPLSATAALEGLNFPTLRRGTLHLAGPLHASVDAKLTAICQSLATSSSKNTPAESAASAAEPESPKCSASTEGEDSVSAGSPPPPTPLSPPVPEMEKLDFTEAPWDESETFHLRKYPSWEIDWDSILS

SEQ ID NO: 532 - protein, 125 aa, Ustilago maydis 521
MPSSFLSTQSSFASVLIVSPARAIVKMAKADTKTKSSTSTQKRTTKAKKDPDAPKRPLSAYMFFSQDQRERVKNANPEAGFGEVGRLLGAKWKEMSEAEKKPYNDMANRDKARAEAEKAAYNKRR

SEQ ID NO: 533 - protein, 142 aa, Oryza sativa Japonica Group
MAPRNAAEAVAVAVAEGGGAGMEPRFRGVRKRPWGRYAAEIRDPARKARVWLGTFDTAEAAARAYDSAALHFRGPKAKTNFPVAFAQAHHQAPPPPLPKAAALAVVSPTSSTVESSSRDTPAAAPVAAAGQGPGARLGLGSI

SEQ ID NO: 534 - protein, 341 aa, Arabidopsis thaliana
  misc_feature (76)..(76): Xaa can be any naturally occurring amino acid
PFKNFVGVLRYQTSFKSVKLSCGEGGCGACVVLLSKGTKRKIEIEKRLTKQQRSVACSKRRPTLFSKAADLCLLSXSQHSRFVTSPDENSDVVYSFSGYSHASEIVDCYLNGKSPPKTTINPESSKFWWEDPNLYGDCDDLSELRIIEDRLMRTKKHLMDCLEKKEKSYSVSKSDQNPKNNGGSSSSSSSSSSQIASDFGQNPSTSSPFFDHHSYSSLEPSSQVTTCFDQNPIFSVGSESSSDQFRYLVNEDAGFVDCLFETEEEKNRMIVPQETQTQPMFSEEDQSFWENLDVDDVFGLFNDDTNLEVPLQDHSSTNEEDEFMIDISEYLSEEAMEWPMF

SEQ ID NO: 535 - protein, 328 aa, Oryza sativa
  misc_feature (209)..(209): Xaa can be any naturally occurring amino acid
MKEKEVLVEIVEDDELKRSIGRNQLDLNEEVMDVESEEGEVGDDEDDEDEEDDDDDDDGGSTTDVAGSRSSSNNSSTNNVSESKLKGDKDSGGGRLEGINGGEQRVPSVRQYNRSKLPRLRWTPDLHMAFVHAVERLGGQERATPKLVLQMMNVRGLSIAHVKSHLQMYRSKKLDHEGRQIRGAIASVFSPMDFHLKRGDRRFHEMLLXQQAAPLSSLQAREHGGFFLLQKRGGGGRGAQPAGRPTRVVRDLLPTPGRFSRGEKANKMQNIFQIFKKKTANFFRGKTQKKGGGPRFPNPFFTTPPPPPRGKKGGKKQKKKKKKSPPPA

SEQ ID NO: 536 - protein, 679 aa, Arabidopsis thaliana
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRGKMLQKISQSISLCNGDQFKPLIYLAGAPTNFISSPLSVSGKKKSSSLRIKRIQQLQSTLEDRINPPLVCGTVSPRLSVPDHILKPLYVESSKVPEISSELQIPDSIGIVKMKKACELAARVLDYAGTLVRPFVTTDEIDKAVHQMVIEFGAYPSPLGYGGFPKSVCTSVNECMFHGIPDSRPLQNGDIINIDVAVYLDGYHGDTSKTFLCGDVNGSLKQLVKVTEECLEKGISVCKDGASFKQIGKIISEHAAKYGYNMERFIGHGVGTVLHSEPLIYLHSNYDYELEYMIEGQTFTLEPILTIGTTEFVTWPDKWTIVTADGGPAAQFEHTILITTTGAEILTISS

SEQ ID NO: 537 - protein, 352 aa, Oryza sativa Indica Group
MALEAVLLSRGDLFGRRRCAMEGGGGGGGGGGWSSPFSGFEGVMDLDGGNWDAAACSSMLLHGFQELEIPAAAAAAAAMAPPPPPVEPANCAENAGGVGGHQEDQAAATAVQSGRRKRRRARAAKNKEEVESQRMTHIAVERNRRKQMNEYLAVLRSLMPPSYAQRGDQASIVGGAINFVKELEQLLQSLEARKSSRQCAAHDAAAAAAPFASFFTFPQYSMSAAAAAAPVAPVVNEVHGRDDGGAGTAEAEASGSKPSAVADVEVTMVESHANLRVLSRRRPRQLLRLVVALQGHRLTVLHLNMTSAGHMVLYSFSLKVEDDCQLTSVDEIATAAHQIIEKIQEEQGCSLD

SEQ ID NO: 538 - protein, 277 aa, Brassica napus
  misc_feature (22)..(22): Xaa can be any naturally occurring amino acid
  misc_feature (208)..(208): Xaa can be any naturally occurring amino acid
  misc_feature (210)..(210): Xaa can be any naturally occurring amino acid
TKDFTTGNSYEHDKSEIVGLNXMKVPRTNQLGVKTKDGLYYKFIGFRDQDVASLTSFFQSAFGKTPEEKQLSVSGRNWGEVDLNGNNLTFLVGGKQAFEVSLADVSQTQLQGKNDVLLEFHVDDTAGANEKDSLTEISFHIPNSNTQFVGDETRPPAQVLHDRIMAVADVGAGVEEAVVTFEGIAILTPRGRYSVELHLSFLRLQGQXQXTFKIQYSSVVRLFLLPKSNQPHTFVVISLDPPIRKGQTLYPHIVMQFETDSVVESELSISDDLMNTR

SEQ ID NO: 539 - protein, 355 aa, Zea mays
MGTMTLPPGFRFHPTDDELVSYYLKRKVDNLKIELEVIPVVDLYKSEPWELPDKSFLPKRDLEWFFFCPRDRKYPNGSRTNRATATGYWKATGKDRRVACDGGVYGLRKTLVFYRGRAPGGERTDWVMHEYRLCQDLVHGACNFIGAYALCRVIKRHEAGLLLPPPASRAKAAGSARGHMMSEVSSGEQLSASSSPSPFTPANSSPTRPTLDAAGAVTCAMAPEPGNAFQLAHDASAALPVPSLALPPPPLLLPSPHEDDTFFVSEGLPAAAADWFGGDMGGVSESEQELKWDALFPCTGTFPSVGGDTWNAAAASPTTMLCRQASDGIDDLAAFFFSEDNRICCDHDWGFCSSS

SEQ ID NO: 540 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHQHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 541 - protein, 320 aa, Oryza sativa Indica Group
MGRGKVQLKRIENKINRQVTFSKRRNGLLKKAHEISVLCDAEVAAIVFSPKGKLYEYATDSSLTILLIIKESVNTYTYGYRIMGRMDKILERYERYSYAEKALISAESESEITLPQLTTCTASRSTHGICFQYCLMSKTLGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICSYPPVMMGERNDAAAAAAVAAQGQVQLRIGGLPPWMLSHLNA

SEQ ID NO: 542 - protein, 376 aa, Zea mays
  misc_feature (273)..(273): Xaa can be any naturally occurring amino acid
MDSTSCLLDDASSGASTGKNKPAPVPAPAAVTGKPLQRVGSSGASAVMDAAEPGAEADSDGARRAPGGVGGKLPSSKYKGVVPQPNGRWGAQIYERHQRVWLGTFTGEAEAARAYDVAAQRFRGRDAVTNFRPLAESDLDPDAAAELRFLASRSKAEVVDMLRKHTYGEELAQNRRAFAAAAASLASPQLPPAKNTSPAAAREHLFDKTVTPSDVGKLNRLVIPKQHAERHFPLRRVQGGRAPILSFEDAAGKAWRFRYSYWNSSQSYVLTKXGWSRFVKEKGLHAGDAVGFYRSAAAGRQLFIDCKLRPKAVRLFGVDLLTEPPRSAAAVAQPEPEQEEIAVSKNKRARDAIAASATPVHIAFKKQRVDVALTTT

SEQ ID NO: 543 - protein, 459 aa, Medicago truncatula
MAKTISNNDENVEVDIDSSKDDVDARTGMKKGPWTPHEDMILTEYVNKHGEGNWNFVQKNSGLLRCGKSCRLRWANHLRPNLKKGSFSEEEEKIIIELHAKLGNKWARMATQLPGRTDNEIKNFWNTRMKRRQRAGLPLYPPEIQAEAIAYNDKLLQLQHQPLSSSSLSFSLLLSSCYPKKIDDPNHYDYNLLENNSGSANNHNTNPCPQFNFSNDENIEINETLALQKSPSLSPYPSSSSNLFNQNFTPPSDSHDYQYSENLSFEHHGFNAGSLYDSKTPASSYASGVDGNFMGNSSMVNDYYEVAPLSHDGKNSGLLDDLVMEGRSISCNKGDVSHKRKNMEGEEYEDEEGIVPLVSTMKKKKSIDESQKKDFSSSQLSTGKKPAQEDQTEELNTMYDDDLDCLLNNFPSEIPMPEWYCRGKSQSLGTEIPTDESGPTNQEFAWTLGSNWNNMPGIC

SEQ ID NO: 544 - protein, 622 aa, Vigna radiata
MMMMMFDEMGFCNDLDTVTATLGEENITTGQADPEAIVEDDFSDEEIGVDELEHRMWKDKMLLKRLKEQSKSKEGIDAVKQRQSQEQARRKKMSRAQDGILKYMLKMMEVCKAQGFVYGIIPEKGKPVTGASDNLREWWKDKVRFDRNGPAAITKYQADNAIPGRNDGCNSIGPTPHTLQELQDTTLGSLLSALMQHCDPPQRRFPLEKGIPPPWWPTGNEVWWPQIGLPKDQSPPPYKKPHDLKKAWKVGVLTAVIKHMSPDIAKIRKLVRQSKCLQDKMTAKESATWLAIINQEEALARELYPDYIPPLASGGGSGSLVVNDGNEYDVEGGEDEPNFDVEERKQENIHMSNLGMERMRGTMGVQQPSFSIKGEAVTTNLDLLRKRKASNDFNMMDLKIYTCEQPQCPYSQVQLGFPDRISRDNHRLICAFRGPSDFGGPNFHVNEVKPVIYTQSFVPPKSTAQSANIAPSVIDLTGLEVSEDGKKRISDLMTNYDTNVQGNKNMSSCNRVAGEVLNFPQHGMQQHQQDNFIRGRGITMEGNVFDEATMSNNHHTFARDECQFDRFKALNSPFETNHNNNNNFHSMFGSFCDLASFDFKEDMQGVGMDALQKQTDFSVWYQ

SEQ ID NO: 545 - protein, 399 aa, Arabidopsis thaliana
MYEESSCFDPNSMVDNNGGFCAAETTFTVSHQFQPPLGSTTNSFDDDLKLPTMDEFSVFPSVISLPNSETQNQNISNNNHLINQMIQESNWGVSEDNSNFFMNTSHPNTTTTPIPDLLSLLHLPRCSMSLPSSDIMAGSCFTYDPLFHLNLPPQPPLIPSNDYSGYLLGIDTNTTTQRDESNVGDENNNAQFDSGIIEFSKEIRRKGRGKRKNKPFTTERERRCHLNERYEALKLLIPSPSKGDRASILQDGIDYINELRRRVSELKYLVERKRCGGRHKNNEVDDNNNNKNLDDHGNEDDDDDDENMEKKPESDVIDQCSSNNSLRCSWLQRKSKVTEVDVRIVDDEVTIKVVQKKKINCLLLVSKVLDQLQLDLHHVAGGQIGEHYSFLFNTKVSDQ

SEQ ID NO: 546 - protein, 247 aa, Ipomoea nil
MGRGRVQLKRIENKINRQVTFSKRRTGLLKKAHEISVLCDAEVALIVFSTKGKLFEYATESCMEKILERYERYSYAERQLNSTDQNSQGSWTLEHAKLKARMEVLQRNQRHYEGEDLDSLSLKELQNLERNLIQHSNIRSKRNQLMYESILCSEKDKHCRTKYQLSKKIKEREKEMATQQQQQQEVQWEQPNDDINSSYVVPPPLVHLSSEGEYQGEGEYGETEGTQRQQQNNTSAMPQWMLSHLQG

SEQ ID NO: 547 - protein, 255 aa, Petunia integrifolia
MSTSNASTSGVRKGAWTEEEDLLLRECIDKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNNFSCWNGKRCNKNTIDKNEGDTEIIKFSDENQKREETIDDGLQWWANLLANNIEIEELVSYNSPTLLHEETAPSVNVESSLTQEGGSGLSDFSVDIDDIWDLLG

SEQ ID NO: 548 - protein, 255 aa, Petunia integrifolia
MSTSNASTSGVRKGAWTEEEDLLLRECIDKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAVKITENNIIKPRPRTFSRPAMNNFSCWNGKSCNKNTIDKNEGDTEIIKFSDENQKREESIDDGLQWWANLLANNIEIEELVSYNSPTLLHEETAPSVNAESSLTQEGGSGLSDFSVDIDDIWDLLG

SEQ ID NO: 549 - protein, 340 aa, Medicago sativa
MELGLSLGDSSKPLIGLMEKHPHQASKELGLGFNTTLSIGPIISTTQRDQLQQQQQEEEKTQRDINNNSNRTENPNPVLHQLDLLPQLSFPWNPPSQNGNLLSTEFGGSSRGLDVNVVPPATVVVMANDEMALSSSRIVQHLLFRRDLCMYSRGGSGGRSLSGSGGNKREFSDGEGYDQRNSSRVSDEDDNCGVGNGNTRKKLRLSKDQSAFLEESFKEHHTLNPKQKLALAKQLNLRPRQVEVWFQNRRARTKLKQTEVDCEYLKRCCETLTEENRRLHKELQELRALKTSNPFNMQLPATTLTMCPSCERVATNSTATSSVTNTSATINGNNNNKINQ

SEQ ID NO: 550 - protein, 255 aa, Petunia integrifolia
MSTSNASTSGVRKGAWTEEEDLLLRECIDKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAVKITENNIIKPRPRTFSRPAMNNFSCWNGKSCNKNTIDKNEGDTEIIKFSDEKQKPEESIDDGLQWWANLLANNIEIEELVSCNSPTLLHEETAPSVNAESSLTQEGGSGLSDFSVDIDDIWDLLG

SEQ ID NO: 551 - protein, 255 aa, Petunia integrifolia
MSTFNASTSGVRKGAWTEEEDLLLRECIEKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNNFSCWNGKSCNKNTIDKNEGDTEIIKLSDENQKREETIDDGLQWWANLLANNIEIEELVSYNSPTLLHEETAPSVNVESSLTQEGGSGLSDFSVDIDDIWDLLG

SEQ ID NO: 552 - protein, 369 aa, Oryza sativa
MDAQYNPRTVEEVFRDFKGRRAGLVRALTADVEDFFRQCDPEKENLCLYGFPNEHWEVNLPAEEVPPELPEPALGINFARDGMQEKDWLSMVAVHSDAWLLSVAFYFGARFGFDKNDRKRLFGMINDLPTIFEVVSGKSKAKPPSANNHSNSKSKSSNKTKSSEPRAKQPKPQPQPPVKNEGREEEGGPDDEEGGGGGGGGGREEEHGETLCGACGESYGADEFWICCDICEKWFHGKCVKITPAKAEHIKQYKCPSCSGGNGGGGGVSGNGKQLKICSTKREAIISQYLVRDERSKNTSTHARSPLISDNPYEVISDIRIMLAEQYTTNAREDDFDAKPNDKDNQGEGNVAWGGINKELYSLQVTIQN

SEQ ID NO: 553 - protein, 129 aa, Papaver rhoeas
PRDRRMRLSVDIARKFFDLQDMLGVDKASKTLEWLLNKSKPAIKEIMKINTIWKSVNDGAAKESNISTAWELLSEAERMAPEHHQNRTFPEEKPSKHGHKEKQITQQSCKATFRPLARELRVKARARAR

SEQ ID NO: 554 - protein, 311 aa, Vitis vinifera
MRNASSASAPPSSSSKTPCCIKVGLKRGPWTPEEDEVLANYIKKEGEGRWRTLPKRAGLLRCGKSCRLRWMNYLRPSVKRGQIAPDEEDLILRLHRLLGNRWALIAGRIPGRTDNEIKNYWNTHLSKKLISQGIDPRTHKPLNPNSSSVDVKASSSKAKAVMNPNPNPNPSPSEKAAANKEAGNFKSDNQYQIGAAGNDGSANIQNSDGSGTGLRSSNNEEDDDLNCGTDDVFSSFLNSLINEDVFPGQHHLQQQHHGGLIAPGSDALISTSSVQSFGFGTSWEAAAMTSTSVFSQIDHSKRFNDQPDKRF

SEQ ID NO: 555 - protein, 260 aa, Zea mays
MTLLVTASFAQCSSLMEEERALSPASDASTTCSSSGGTGPNSPITSSQSVDDTCGGAGSSSSRKRPRRELKHPTYRGVRMRAWGKWVSEIREPRKKSRIWLGTFDTPEMAARAHDVAALAIKGRAAHLNFPEMSHELPRAASAAPEDVRAAAALAAAMEMESVAPPTSSESRDGARNDENEGPAASSSSGNDADNAQTEERAAPSEHSMLADGDGHILNLAVFELPDVLLEFGFALPLPPPSTSCGYDLSWDEPLLLWEH

SEQ ID NO: 556 - protein, 475 aa, Picea abies
MSKDCVIVCLSGDDRIHGHADEKGFDPGFKLFGKTIPVRPVEEMKQEEPVSVQQPGAHKEQSPEGEEEVQQETGSSSEDGKDESMNEGKSGGQKTVLKKPDKLLPCPRCQSMDTKFCYYNNYNVNQPRHFCKNCQRYWTAGGTLRNVPVGAGRRKNKHSVAASTISSHYRQVISAASECGLGVRTDDQESGVDQVMIPCAALPASCVRPLKVAGSRIQVVPMDVLDSAASTGTVLNFGSEVRNKIQLGGDSDPSIEKSTMESSSGSGKEAAGHMNPVAPRPQMDPPPNWANGAAGAAYFGGAWSYGWNFGNPAWNAAAALPPGWPGFSWPMVPGSYFGPSPPPPPGWGPGPWVSGPWAAAAVAASNNPTAAAVASNNPTAVDSGSPTLGKRPQSEDGCLWVPKTLRIDDPGEAAKSSIWTTLGLGDKPESAITSGGIFKAFQPKTQGAKDSRKASQALQANPAAFSRSISFHESS

SEQ ID NO: 557 - protein, 387 aa, Anabaena variabilis ATCC 29413
MRLNLIPLFSLGLCGVMVLISPPQVNANTPLNRAEVQSIRNFVQLIQRASRNKRPAQKLDAIIPGDGLSTGRASLADLRFNDGSLARVGEQAVFQFMPRTRNFRLSNGTVLLLIPPGRGQTRIQTPSATAAIRGSALFIRYDQKTDTTIIGALTNSGIAVSNKDASQTQPLKAGQLLVLVKGEIQSLYDFDLQNFYETSDLAEGLDLTGKNSSATPDPAIAGVRAEIMAALATQSPLVGKGVMENPAFLELSTTSSEVIDEDTDEDDFITDNFLVDSLVETGEILFQNAQQLGDNADGNLNNINNIQPDPPLPDNPDPPPPPPDPPPPPPPDPPPPPPPDPPPPPPPDPPPPPPPDPPPPPPPDPPPPPPPDPPPPPPPDPPPPPPP

SEQ ID NO: 558 - protein, 170 aa, Zea mays
MVFSKIQYKVVSSKIQTPTLVRVETTHETNMEKKRRRRELQGDVVDAAPAAVVAAAGEAESSEGEVAPPPPAVPRQPIRSTYIQRRSKDTSVDVRIVEEDVNIKLTKRRRDGCLAAASRALDDLRLDLVHLSGGKIGDCQIYMFNTKIHKGSSVFASAVAGRLMEVVDEY

SEQ ID NO: 559 - protein, 242 aa, Arabidopsis thaliana
MNSRSSGEVVPSDLWAWRKYGQKPIKGSPFPRGYYRCSSSKGCSARKQVERSRTDPNMLVITYTSEHNHPWPIQRNALAGSTRSSTSSSSNPNPSKPSTANVNSSSNGLPKQHLTWASSTTPPPPPPTLSSSAIKDERGDDMELENVDDDDDNQIAPYRPELHDHQHQPDDFFADLEELEGDSLSMLLSHAVTATGRIKRPRPMGSAISSGGREIIIIIITTTKTQGRYSIVLITGKQIILN

SEQ ID NO: 560 - protein, 309 aa, Triticum aestivum
MGAPKQKWTAEEEAALKAGIGKHGAGKWRTILKDPEFSNILRYRSNVDLKDKWRNMNVTVNASGTRDKVRTTTTTTPTAKKPRSAPKQESHSTAITTITSDGDDDVIDVKPIIKPIVTFTTGSGNKSLSRLENIILEAVKTLNEPTGSYKTAVANYIEEQYWPPADFDHVLSAKLNELTSSGKLMKVNRKYRIAPSSSFLEGRSSKMLLLDDIKKEPTKVEKVERDGFTAHTKSQVDAELARMRNMSAEEAAAAAARAVAEADAIMAEAEAAVREAEAAEADAVAAQAFAEAAMLTLKNRSSAKLIIRG

SEQ ID NO: 561 - protein, 339 aa, Cleome spinosa
MKELGLCLGVESGSDQRRGDSSGHGLRVTAIDSNSDYEDGILDLNASDNRNEESESGRVVDGSGLPPIRDSFFGEEAVVADEELEWEEVHEAITWTYEPVQVRGFAIPEEEGELSSSSRDDHEHDLDWQVLLAVNNVVNYIEQAEGISLTADDVDANYYLYLANIDEYDENHGDHDAIFRQMFDNETGIGGNPPAAKRVVKDLPLVEFTVEKLGKGEVVCSVCKDKIAIEEKVRRLPCRHYYHGDCILPWLGIRNTCPVCRYELPTDDPDHERTRRQQRSDRLGKRVIDTDCYSHAPVNNSICNAWTGDHHHVKTFMSCDEDTKDMVGCYYKLFGMVPP

SEQ ID NO: 562 - protein, 609 aa, Vigna radiata
MMMFEDIGFCGDLDLLSCPLGDEDVVAVRHTDPDPVVEDDYSDEEIDVDELEKRMWRDKVRHKRLKEQQKAKEGTDAVKQRQSQEQARRKKMSRAQDGILKYMLKMMEVCKAQGFVYGIIPEKGKPVTGASDNLREWWKDKVRFDRNGPAAIAKYQADNAIPGKNDGCNSIGPTPHTLQELQDTTLGSLLSALMQHCDPPQRRFPLEKGVPPPWWPTGNEVWWPQIGLPKDQGPPPYKKPHDLKKAWKVGVLTAVIKHMSPDIAKIRKLVRQSKCLQDKMTAKESATWLAIINQEEALARELYPDYCPPFSSGAGNGSMVINDCSEYDVDGAEEEPNFDVEDRKPDPLHPSNLGMERITGRLPLQISHPFKGDVVTNLDFIRKRKIPGDFNLMMDPKIYTCEHPQCPYNEPRLGFPDRSARDNHQLNCPYRNSSSDYGGGSNFHDSEVKPVIFPQSFVQPNTTSQAANVVQPSFAVSGLGVPEDGQKMINDLMTIYDTNIIGNNNLSSNNFVAAENQNFSQTMLQQQQQDSRRDNYFTGQGMMTEGNFFAREEGQFERFKAMNMNAPFDTNHMLFSPQCDLSSFDFKDIQGGGMDTGHRQQQEVSIWFE

SEQ ID NO: 563 - protein, 244 aa, Triticum aestivum
MGRGKVQLKRIENKINRQVTFSKRRSGLLKKAHEISVLCDAEVGLIIFSTRGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHVAQQDQTQPQTSSSSSSFMLRDAPPAANTSIHPAATGERAEDAAVQPQAPPRTGLPPWMVSHING

SEQ ID NO: 564 - protein, 388 aa, Brassica napus
  misc_feature (333)..(333): Xaa can be any naturally occurring amino acid
MMMNKDMLYHHQQQHGEENMSNLTSASGDHASVSSGNRTETSGSNFHYNTNPNQQQEEQCLAPQPSQKKKRNQPGNPDPEAEVLALSPKTLMATNRFICEICNKGFQRDQNLQLHKRGHNLPWKLKQRSNKDVIRKKVYVCPEPNCVHHHPSRALGDLTGIKKHFFRKHGEKKWKCDKCSKKYAVQSDWKAHAKTCGTKEYKCDCGTLFSRRDSFITHRAFCDALAEESARAIPNPILIQSSSPHQTQHNINFSSSSQNITSHNNNPHGHDELPMKQEEPHHHFHNIPPWLISSNPNPNGNNANYFPLASSSANFHHPSPAMSATALLQKAAXMGPSKSTTTPEEDEKSSYNKLITTTMAASMMTSPSEPGFGFQDYYMMNHHAHHHD

SEQ ID NO: 565 - protein, 312 aa, Brassica napus
  misc_feature (226)..(226): Xaa can be any naturally occurring amino acid
MTRRCSHCNQNGHNSRTCPNRGVKLFGVRLTEGSIRKSASMGNLSHHSGSGLSGLVSGSPGDGPDHDGYASEDFVPGSSSSRERKKGNPWREEEHRMFLLGLQKLGKGDWRGISRNYVKTRTPTQVASHAQKYFIRQSNVSRRKRRSSLFDIIPDEATDSVPAAPLILETEECESMKSTNSVGVEAPEDSIQTQLQPPPPGSFPVLYPAYFSPFYSFPFPVWPAAXYDTEQVKEETHEILRPTAVHSKAAPINVDQLLGMSKLSLKESSLNGVSEQSLSLKLIGGSVSRQSAFHPNPASGGGSDMNTVIHAV

SEQ ID NO: 566 - protein, 171 aa, Brassica napus
  misc_feature (12)..(12): Xaa can be any naturally occurring amino acid
TSELHERFINAXTQLGGPDKATPKTIMRTMGVKGLTLYHLKSHLQKFRQGRQLCKESTENSKDVSCAAESQDTGSSSTSSLRLAAQEQNEYSYQVTEALRAQMEVQRRLHEQLEYGQVQRRLQLRIEAQGKYLQSVLEKACKAIEDQAVAFAGLEAAREELSELAIKVSNG

SEQ ID NO: 567 - protein, 162 aa, Physcomitrella patens subsp. patens
SGSFDLVEMDASEILAEHTHFCEICGKGFKRDTNLRMHMRGHGDEYKTSAALARPDKDSPDTTVTRLRRYSCPCVGCKRNKKHGKFQPLKTILCVKNHYRRSHCPKVLTCQKCMTKKFSVVADLKTHEKHCGRDKWQCSCGTRFSRKDKLFGHIGLFAGHVP

SEQ ID NO: 568 - protein, 354 aa, Glycine max
  misc_feature (264)..(264): Xaa can be any naturally occurring amino acid
  misc_feature (299)..(299): Xaa can be any naturally occurring amino acid
  misc_feature (305)..(305): Xaa can be any naturally occurring amino acid
  misc_feature (307)..(307): Xaa can be any naturally occurring amino acid
  misc_feature (328)..(328): Xaa can be any naturally occurring amino acid
  misc_feature (333)..(333): Xaa can be any naturally occurring amino acid
MGAPKQKWTAEEEAALKAGVVKHGAGKWRTILTDPEFSSILRMRSNVDLKDKWRNINVTAIWGSRQKAKLALKKNLLPSTKIDNNHLALSTVVQRDKEVANPKPLAVSSGTSPNSKEKISKLQNFQLDNLILDSIIKLKEPRGSDQAAIAAYIEDQYCSTPTLRKLLSTKLKHMVASGKLMKVKHKYRIATNLTISEKRRCSSLLLLEGRPKDSPKAEKTGVNILSKSEIDAELSKMKGVTPQEAAAAAAKAVAEAEAAIAEAXAAAREADAAEAEAEAARVFAKAAMKALKCKTLRIXWCQLLXAXHEEYIWLEIIILLLDFLHVFXITVHXFRLVNLEYAGFIHETFCQESL

SEQ ID NO: 569 - protein, 331 aa, Zea mays
MDPRFPLPAAAAPSTGGGGGARGHHRRAHSETFLSFHDADLLLDPDGDFFSDLDFPSLSDDSPAASDPTPPPHPQQQPPQASPAPRPPGGTHTRSLSLDAAFFEGLAFQGPSGSAGGGGGPGHKRSGSMDGDTSPFEGESALSSGLPDYAKKAMPAERIAELALIDPKRAKRILANRQSAARSKERKIMYTSELEKKVQTLQTEATTLSAQLTLLQRDTTGLTAENRELKLRLQSMEEQAKLRDALNEALREEVQRLKIAAGQVGNMNGNPFNGGLQQQIPSYFVQQQQMPYFGGHQAQHHSQNQNHRHQISSNVGQTLSGQSLNDSMDFM

SEQ ID NO: 570 - protein, 365 aa, Oryza sativa Japonica Group
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 571 - protein, 345 aa, Oryza sativa Indica Group
MDFSGDIDDLISLQLLHDQLLGVEADACLPVAVHHDGVAAFAEHQQGFHPAAFLPQQPMTMTPAGYVDMANDQYLGAHAAAGEAEAVYRAAAAEPVMIRFGGEVSPVSDPRRPPLTISLPPTSHAWAAAEAVHPAALLQAQAAAAAADPNDFRKYRGVRQRPWGKFAAEIRDPKKRGSRVWLGTYDTAIEAARAYDRAAFRMRGAKAILNFPNEVGSRGADFLAPPPPPPPPTTSTHGKRKRHETAAADPDVEVIGESSKSVKTETYTSPASSSLASTTTSTVTSSSTSPSPSSEAAACGGGGGGELFVPPMPSSWSWDQLEGFFGILSPLSPHPQMGFPEVAVN

SEQ ID NO: 572 - protein, 410 aa, Oryza sativa Japonica Group
MAICSTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQVSGPYASGPQVAQQNQIPKASASTVLPNSGAEQPPTSDGI

SEQ ID NO: 573 - protein, 473 aa, Oryza sativa
MMQFTHTAPPPPPLHPNGHGLGLGLYLDVGATRGGGGARPWSSSSSTTTLGGSGYFPSSAAASKISLGNLNSTGCMEQLLVHCANAIEANDATLTQQILWVLNNIAPADGDSNQRLTAAFLCALVSRASRTGACKAVTAAVADAVESAALHVHRFTAVELASFIDLTPWHRFGYTAANAAIVEAVEGFPVVHIVDLSTTHCMQIPTLIDMLAGRAEGPPILRLTVADVAPSAPPPALDMPYEELGAKLVNFARSRNMSMDFRVVPTSPADALTSLVDQLRVQQLVSDGGEALVVNCHMLLHTVPDETAGSVSLTTAQPPVSLRTMLLKSLRALDPTLVVVVDEDADFTAGDVVGRLRAAFNFLWIPYDAVDTFLPKGSEQRRWYEAEVGWKVENVLAQEGVERLERQEDRTRWGQRMRAAGFRAAAFGEEAAGEVKAMLNDHAAGWGMKREDDDLVLTWKGHNVVFASAWAPS

SEQ ID NO: 574 - protein, 288 aa, Ostreococcus tauri
MDSASLLSAFDVCFPEGEGPAEFGLALPSFSDIVFPQDDDDQMSKMAMEIFDFDCDCDWGTELAGDEETVPEQLRHRHSKDRAVMMKKKAQIAPKGSSRSSKWKGVTKHKITSRWEAHLWDATFERRKSSKSGRQRGRQVYLGGWQSELDAARAYDLASLRYFGTRSPLNFPRENYADELKIMQEYTCADWVAEIRRKSSGFSRGRSRFRGVTSHKGKNSKGKWEARIGRVMGNKYLYLGTFPSERAAAEAYDLAALRFRDSKAVTNFDRSNYSEEDIKNAANDAKIV

SEQ ID NO: 575 - protein, 223 aa, Oryza sativa Japonica Group
NIQRSEYHNLFNFINGKHLKIMNLGDGQGATGGVTAVLRDTDDDAVDPHLERIKNQAGDEESDEEDEDFVADKDDSGSPTDDSGGEDSDASESGGEKEKLSKKEASSSKPPVKRKPKGRDEEGSDKRKPKKKKDPNAPKRAMTPFMYFSMAERGNMKNNNPDLPTTEIAKKLGEMWQKMTGEEKQPYIQQSQVDKKRYEKESAVYRGAAAMDVDSGSGGNESD

SEQ ID NO: 576 - protein, 356 aa, Zea mays
MDTFSHVPPGFRFHPTDEELVDYYLRNKVASNKIDLDVIKDVDLYKIEPWDLQEKCKIGTEEQNEWYFFSHKDKKYPTGTRTNRATTAGFWKATGRDKPIYTKSCLVGMRKTLVFYRGRAPNGHKSDWIMHEYRLETTENVTAAPEEGWVVCRVFIKKRVEAVRRMADGAPPWFDGHVPGGFMAPAGLGSPRQLMHHHPNPAAAAPLLYSGQQLYHCKPELEYHHLLQPSQEALLQQLPQLVESPKPPPPAFIDQGSCSLQSPDEASGYNTTPQQPPPMTTEAAYMDDDSVTDWRVLDKFVASQLFSHGDGMAKEDGYPNPGQALFQAENKQPEEALDYASTSASGGGGGEANMWK

SEQ ID NO: 577 - protein, 408 aa, Zea mays
MEAGGASGGDEGDGQLHGLKFGKKIYFEDAGGSSSSGGSGSASATAPPATQQPSPPAASPRAAPGGGRRGRAAAGGAGPSLPPAPPRCLVDGCNADLTDAKTYYCRHKVCEMHSKEPRVVVNGLELRFCQQCSRFHNLAEFDQQKKSCRKRLAGHNERRRRPPPGPLASRYGRLAAPLGEEPGGRFRSFMLDFSYPRVPSAMRDGFPAVRPGGERVPGSNIQWQAASLDPPPPHHQSAAAGYGAHSYGSPGSSSSSRPPVFPAGPELPPGGGCLAGVPTDSSCALSLLSTQPWDAAGHSAGHGHGHAASLPATAGFDGNPVAMASSYIAPPSPWTDSRAHEGGRRNVPQLPPDVPLGDVHSGPGTHHGQFSGELELALQGNRPAPAPRNGQGSAGAFDQAGSTTEWSL

SEQ ID NO: 578 - protein, 286 aa, Zea mays
EEVLSAKRRVKLANRWWSVPGHLGLPEQPSGGPNPKTEPPAMKDPEPSSPAVGAPGDHGADETNESGGAVVAAPSRRPRGRPPGSKNKPKPPIFVTRDSPNALRSHVMEVAGGADVADAIAQFSRRRQRGVCVLSGAGTVANVALRQPSAPTAVVALRGRFEILSLTGTFLPGPAPPGSTGLTVYLAGGQGQVVGGSVVGTLIAAGPVMVIASTFANATYERLPLEEEDEGPAPPMASGGGADPLMGGGLGIADPSALPMFNLPPSNGQLGGGDGFPSWAHPRPPY

SEQ ID NO: 579 - protein, 212 aa, Oryza sativa Japonica Group
SSSSSSISHGFRPSIIRARSGAMDGEEDSEWMMMDVGGKGGKGGGGGGAADRKKRFSEEQIKSLESMFATQTKLEPRQKLQLARELGLQPRQVAIWFQNKRARWKSKQLEREYSALRDDYDALLCSYESLKKEKLALIKQLEKLAEMLQEPRGKYGDNAGDDARSGGVAGMKKEEFVGAGGAATLYSSAEGGGTSSTEQTCSSTPWWEFESE

SEQ ID NO: 580 - protein, 610 aa, Vitis vinifera
  misc_feature (126)..(126): Xaa can be any naturally occurring amino acid
  misc_feature (135)..(135): Xaa can be any naturally occurring amino acid
  misc_feature (371)..(371): Xaa can be any naturally occurring amino acid
  misc_feature (479)..(479): Xaa can be any naturally occurring amino acid
MVKSEPKIQSEPLKPMSSPSSSSSTSSSSSCRKKKYKGVRMRSWGSWVSEIRAPNQKTRIWLGSYSTPEAAARAYDAALLCLKGASANLNFPTITSSYHLPDTLLSPKSIQRVAAAAANSFADNAXAAATTTTSXPTTPTTPPSPPPPSSSSSISSASTSSSPSDQLDDDVSVLMSSMANEPMSMMASWYDNFDSLQSPKYMDQMFSNCALFNPVPTIEDDYEEVEMMESQSVIYDLSRSICFGQILSPAKALNYWAQELQIDFTKYEHPAVLTVEAQEKYVGHLGGGLSKNLFLKDKKHRFYIVSALKDTKVDLKVLSQRLGLGKGGLRMAPEEALGEILQVSLGCVTPFALVNESARHVSLFLDQGFKXKDFCFFHPLSNDMSIAIKACDLDKFLKSIGKDPSYVDLEANPTVGKDQPPDLAGLVPSDAIVLQDPPEKSVSSGPTEKHASVDNKSSVAAAKTVKPSNNVQKVKEKPXISVHQLSSFTDPGHFVEEILDKTSAIVLSEITEDAIKQHGEHLGAVLSDSIRKRLSLDLKNLAGSKLELENVIIYCSFQSRENGDELYAYCPSLNLLKTRGLSFAYSGAQDDEICYLQGAFKLDFQLSFAR

SEQ ID NO: 581 - protein, 409 aa, Vitis vinifera
MSLSPPRERNNGDRTYQFYWCYQCNRSVRIASDNPSQIICPRCLGQFLQEIDTTRPRAFNEIITWDPFPEARLLEALSLVLDPPLRGLNNGVGRGDEAETEAARNRGRRWLRRRSHSREHWEAEADTGVPGRRRNNELGGRLGWPFGNGLGAQGRTWIVLRPTGPPGQNGPFPQSENMRPPRFELRDFFSGPGLNELIEELTQNDRPGPPPAPDSAINAMPTVKITPTHLINDSHCPVCKEEFKVGEEVRELPCNHVYHSDCIVPWLQLHNSCPVCRHEVPVPSDESDESHEGEDRRVRCMRLRQLASLWPFRSRYRRINPQDRDVTPHRALLMMNVLCLQQLTYSGLLALFFSPLMLLLLRSIRDLYHRPCHTWEIKLKRIAKTLVKQVTEDTMLRQIRADAYPKSGP

SEQ ID NO: 582 - protein, 375 aa, Populus tremula x Populus alba
MGRAPCCEKNGLKRGPWTPDEDQKLIGYIQKHGYGNWRTLPKNAELQRCGKSCRLRWTNYLRPDIKRGRFSFEEEETIIQLHGILGNKWSAIAARLPGRTDNEIKNYWNTHIRKRLLRMGIDPVTHSPRLDLLDLSSILNSPLYDSSRMNMSRILGVQPLGDPELLRLATSLLSSQRDQTQDFAIPNGHQENHLSSPQVHQNQNQSIIHQANQFQPAGQEMPACTALTTTPCVTFSNEAQQMDPNGDQYHLSTITTFSSPNSQVSTHDQWQSNRMGSNLSEDYYVPAVSSYNSADNCRGTDLVDPSSEASTFISNNSNQTFGFASVLSTPSSSPAPLNSNSTYINCSSTEDERDSYCSNFLKFEIPDILDVSNFM

SEQ ID NO: 583 - protein, 228 aa, Physcomitrella patens subsp. patens
MSAGSHQSNGSAAVHGGGQLPIAESPTGPEPRKRGAGRAGSKEPSPRKSIDTFGQRTSVYRGVTRHRWTGRYEAHLWDNSCRKEGQTRKGRQVYLGGYDKEEKAARAYDLAALKYWGPNTTINFPLSTYEAELEEMKNMSRQEYVASLRRKSSGFSRGASMYRGVTRHHQHGRWQARIGRVAGNKDLYLGTYSTQEEAAEAYDLAAIKFRGINAVTNFDISRYDAGRI

SEQ ID NO: 584 - protein, 246 aa, Triticum aestivum
  misc_feature (73)..(73): Xaa can be any naturally occurring amino acid
MSEASVLNQAEVEDAAAAAGLDLPPGFRFHPTDEEIISHYLTPKALDHRFCSGVIGEVDLNKCEPWHLPGKAXMGEKEWYFFCHKDRKYPTGTRTNRATESGYWKATGKDKEIFRGRGVLVGMKKTLVFYLGRAPRGEKTGWVMHEFRLEGKLPHPLPRSAKDEWAVSKVFNKELTATNGAMAAAEAGIERVSSLGFIGDFLDSGELPPLMDPPLGGDSTNHRFQSTLPTHGAIRIKLRWTHIRRT

SEQ ID NO: 585 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHHHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 586 - protein, 177 aa, Zea mays
  misc_feature (33)..(33): Xaa can be any naturally occurring amino acid
TSVSPPSVAYDGKLQTSPTDNNEPCSEAPQNIXQNKVQSSSTRSCKKVHKQGSALGRSIDLTKFACYDELIAELDQMFDFDGELKSPCRNWLVVYTDNEGDMMLVGDDPWNEFCDMVHKIFIYTREEVERMNPGALNARLEDCLSDSLGRGLASKEPRSGPSTSAVDFENRANLSSQ

SEQ ID NO: 587 - protein, 138 aa, Oryza rufipogon
SDDKALKRHLLRKYSGYLGGLRKELSKKRKKGKLPKEARQKLLTWWELHYRWPYPSEMEKIALAESTGLEQKQINNWFINQRKRHWKPTEETQFAVMEAYHHQSTDAAAAFYVDVDARLVGATAVAPASAVYTARPDH

SEQ ID NO: 588 - protein, 392 aa, Populus trichocarpa
MVKSSESGVAPFLKKCYEMVDDESTNSIISWSQTNDSFVIWDMTEFSVHLLPKYFKHSNSSSFVRQLNIYGFRKIDTDQWEFANDGFIRGQKHLLKNICRRKNSQGTDNRKSVQQQDNSIEHCENVENVGLWKEVESLKTGRNAVTQELVKLRQHQETADNKLLLLRDRLQGMEKNQQQMLSFLVMAMQSPGFLAQLLNKKENNWRIAEPGSIVEQGADDAEQLASEGMIVRYQPPVDEMFEPVHAPPIGPENPRESNPSSDGMKDFFVSPDFMELLMDENLGFENHTSFGLPELADDGSWEQLLLANPFIENIKDTKPGSEESTDTETDTGTTIVGTQLERSQSFEYLIEMMEKSNDLENKATDEGPHFEKSQKLEILTEQMGLLASEPNH

SEQ ID NO: 589 - protein, 304 aa, Arabidopsis thaliana
MPLEAVVYPQDPFGYLSNCKDFMFHDLYSQEEFVAQDTKNNIDKLGHEQSFVEQGKEDDHQWRDYHQYPLLIPSLGEELGLTAIDVESHPPPQHRRKRRRTRNCKNKEEIENQRMTHIAVERNRRKQMNEYLAVLRSLMPSSYAQRGDQASIVGGAINYVKELEHILQSMEPKRTRTHDPKGDKTSTSSLVGPFTDFFSFPQYSTKSSSDVPESSSSPAEIEVTVAESHANIKIMTKKKPRQLLKLITSLQSLRLTLLHLNVTTLHNSILYSISVRVEEGSQLNTVDDIATALNQTIRRIQEET

SEQ ID NO: 590 - protein, 400 aa, Oryza sativa Japonica Group
MATGGSGGGGGGGGGGDDVHGLKFGKKIYFEQDAAASASAAAVESSSTSSGGGGKKGKGLAAAAAPPPPLPPRCQVEGCGVDLSGVKPYYCRHKVCYMHAKEPIVVVAGLEQRFCQQCSRCSVHMVRFHQLPEFDQEKKSCRRRLAGHNERRRKPTPGPLSSRYGRLAASFHEEPGRSRSFVVDFSYPRVPSSVRDAWPAIQPSDRMSGSIQWQGGHELHPHRSAVAGYSDHHAFSSHGGSAAGAPMLHHPAFELTSGGCLAGVATDSSCALSLLSTQPWDTTQSTSSHNRSPPMSSTASAFGGGNNPVSPSVMASNYMAASPGWNSSSRGHDGARNVHLPPPHGVVLNEVPPGSVHHGHFSGELELALQGGAPSNRPEAEHGSGSGAFSHSTNAMNWSL

SEQ ID NO: 591 - protein, 256 aa, Brassica oleracea var. botrytis
MGRGRVQLKRIENKINRQVTFSKRRAGLFKKAHEISVLCDAEVALVVFSHKGKLFEYSTDPCMEKILERYERYSYAERQLIAPESDVNTNWSMEYNRLKAKIELLERNQRHYLGEDLQAMSPKELQNLEQQLDTALKHIRSRKNQLMYESINELQRKEKAIQEQNSMLSKQIKERENVLRAQQEQWDEQNHGHNMPPPPPPQQHQIQHPYMLSHQPSPFLNMGGLYQEEDQMAMRRNDLDLSLEPVYNCNLGSFAA

SEQ ID NO: 592 - protein, 170 aa, Calceolaria arachnoidea
MLGFDKPSKTLEWLLTKSKSAIKETKEKCTSSSPSECVSAGNGEFLDSKGKSKGSGKEALNLAKESRDKERARARERTREKMNLKKLDESNQVFDHFPSSSTAEDLIRESILVKRMMRHPSIFGFQQNDTVSRHSNFNNFQSHNVNENWDLSNLNSQSNLSDILDQHKFI

SEQ ID NO: 593 - protein, 406 aa, Solanum lycopersicum
MPFPWKKVKKTSISQLVKDHVNSQSGSPLMVETGFPTSLVDFVVKNRRRFKKSSKKKMVDDPLFVPNPPSSVTLPSTSQFMIDDNEVPPLIRVPEVEGDKPESRKMNDEKEWGYGCLSMNQGLVAVLKMFLVAALVLGMNNLVVGVTMSAFLLFFLEYLGERLYGFFYKAPLELSKDGCSDFRFQIQEIEAAKGTNVEKIEEESIWDGKGKCVGLDVIEKGEESRYDLCESKEKKSHRAKMKSKMKKLVPKKFRKKKGSALERPMLLDDIDYVIEGKKETEGSSEQKMPSNSIVSSVASSIDDKTDIVEVVGSAGVASEVLTDASIEESFNGTDDKATIVGEEELTGREHSSMYIALLLVVLVGLIGGRVLALVFTLSCCLMLKRGEGIGRFTKLPVMRRFTKKFC

SEQ ID NO: 594 - protein, 302 aa, Triticum aestivum
  misc_feature (96)..(96): Xaa can be any naturally occurring amino acid
  misc_feature (115)..(115): Xaa can be any naturally occurring amino acid
  misc_feature (125)..(125): Xaa can be any naturally occurring amino acid
  misc_feature (195)..(195): Xaa can be any naturally occurring amino acid
  misc_feature (210)..(210): Xaa can be any naturally occurring amino acid
  misc_feature (277)..(277): Xaa can be any naturally occurring amino acid
MGAEAKCDRIKGPWSPEEDEALRRLVERHGARNWTAIGRGIPGRSGKSCRLRWCNQLSPQVERRPFTAEEDAAILRAHARLGNRWAAIARLLPGRXTDNAVKNHWNSSLKRKLAXTATGGGAAWXEKANNSRDSPRAVQEPEAGGPGNPPGYRTGGELSHGSGQVFRPVPRPGGFDAISADVRPPPPRQDEDPIXSLSLSLPGLEHGFHXDSARSHFQELSPSPRSPSPPTGPAPQPSSSYPVSGDLVGGIQEMIAPEVCKYMSAVGLPAGWGPGPXGRGVHPQLLKGVIPPPPNGSAFNPP

SEQ ID NO: 595 - protein, 61 aa, Saccharomyces cerevisiae
NENRDIVRSENPDVTFGQVGRILGERWKALTAEEKQPYESKAQADKKRYESEKELYNATRA

SEQ ID NO: 596 - protein, 477 aa, Musa acuminata
MENGGPLVDIGSAAETVAAVEEEEVASVAPLHQIESLCMRCGENGTTRLLLTRIPHFREIVLMAFECPHCNERYCTNNEVQFAGELQPRGCCYRLEVPAGRSEILNRQVVKSDSATIRVPELDFEIPPESQRGRLSTVEGILVCAADELESLQEERKKVDPVTAEAIDEFLTKLRSLVSGNAAFTFILDDPAGNSFIENPTKEQQASLGFLVESSPEEETERQVDRDALAEENNVNVVQREPHGSVGALAGRRAIAQGKAEDVAAALCRYSAPEEVDTLPSTCGACAAGCVTRFYSTKIPYFREVVVMATTCDMCGYRSSELKAGGEIPEKGKRITVYVQNIEDLSRDVIKSDMASVKVPELDLELASGTLGGIVTTVEDLERVHGFSLGDSSDDWKRKKWLDFKSSLGKLTSLEEPWTLIIDDALASSFVSFTTDSVEDDKRLVVEEYERTWEQNEELGLNDMDTSSADNAYSRTE

SEQ ID NO: 597 - protein, 301 aa, Oryza sativa Indica Group
MAATFYGVGSIALAMHEDDEEEGSGRVFGFAAGDLVRPAVVTQQLFPMTAAAAAVVPESTEQRHVAAAAEQWARPPSRKTRRGPRSRSSQYRGVTFYRRTGRWESHIWDCGKQVYLGGFDTAQAAARAYDQAAIKFRGVEADINFTLDDYKEDIKKMNNFSKEEFVQVLRRQGVGFVRGSSRFRGVTLHKCGKWEARIGQLMGKKYVYLGLYDTEMEAAKAYDKAAIKCCGKEAVTNFDTQSYEDELNLQSWDSELDLELSLGCSGGERAAGEVLHSAPSNQRTSLTWCSYIDLPEITGPE

SEQ ID NO: 598 - protein, 196 aa, Arabidopsis thaliana
PRVRDISAQRFAMNGRSMRLPPGFRFDPDDEDLVFEYLAKKVLHRPMDFDLPELRSCNVDPWDLLGEKNKEVYYFVKKEERERKGRETLSGYWEECEEEEVMEAGGRDCIHLEGRRKTFAFFIGKKPRGTITPWIMYEFRLLSSRATRWSSSPLPRGEVGKWRAVKVVVKEENDEEMVEDEHESDESDGEEVIQSR

SEQ ID NO: 599 - protein, 641 aa, Oryza sativa Japonica Group
MMGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGIGGSNGGVFEDVNGMMQQPQQTTPAQQQFFIRDDTPFGNQMGDINGASEFRFGSGFNMSGAVEYPGAMQGQQKNDGSNWYY

SEQ ID NO: 600 - protein, 178 aa, Glycine max
GIRHEAEISISLNVLQHYFTGSLKDAAKSLGVCPTTMKRICRQHGISRWPSLKIKKVNHSLSKLKCVIESVHGAEGAFGLNSLSTGSLPIAAGSFSDPFTSNKFHRQTTLTIRPSEPKINENDFDASGASETKRQVAMEDQFLGLEARTRSPEKVINDKGVSIQEIGTKGTNKFRTGS

SEQ ID NO: 601 - protein, 359 aa, Solanum lycopersicum
FISPDIAKIRKLVRQSKCLQDKMTAKESATWLAIINQEEVLARELYPDRCPPLSSGGSSGTFTMNDSSEYDVEGAIDDPIFDVQEQKPNHLSLLNVNVEMFKEKLPLLQQSQPMKGDIFANLDFTRKRKPADDLTFLMDPKTYTCECLHCPHSELRNGFPDRSSRDNHQLTCLFRNTSQFVVPNFHMEEVKPVVFPQQYVEPKRASLPVNPAPPSFDTSGLGVPADGQRVINELMSFYESNVQGNKSSMAGNSVMSKEQPLQQPSIQQNNYLQSQGNVLEGSIFGDTNISASNSMFVQGDRFDQSKVLTSPFNASSTDDFNFMFGSPFNMQSTDLSECLSGISHDDVKQQDVPVITSEF

SEQ ID NO: 602 - protein, 228 aa, Brassica napus
MRKGRGSSAIPPALPVTANGSVKEPRYRGVRKRPWGRFAAEIRDPLKKSRVWLGTFDSAVEAARAYDQAARNLRGPKAKTNFPIDCSPSSPLQPLYHQNHQNLRSANQSQIDPFMDHRLYGGGGEQQIISRPASSSMSSTVKSFSGQRPSSSVAKPLPAAKRYPRTPPVAPEDCHSDCDSSSSVIDDGDDIVSSSTRRKPPFQFDLNFSPLDGVDLFDDDLHCTDLRL

SEQ ID NO: 603 - protein, 936 aa, Arabidopsis thaliana
MEGGRGGGDGNFLPNSNFGVFSDSAMDMDFMDELLFDGCWLETTDGKSLKQTMGQQVSDSTTMNDNNNNSYLYGYQYAENLSQDHISNEETGRNSAQAEKFLLEESEGGRRYWIAPRTSQGPSSSVKERLVQAIEGLNEEVQDKDFLIQIWLPIQQEGKNFLTTSEQPHFFNPKYSSLKRYRDVSVAYNFLADEDSKESVGLPGRVFLKKLPEWTPDVRFFRSEEYPRIKEAEQCDVRGSLALPVFERGSGTCLGVVEIVTTTQKMNYRPELDNICKALESVNLRSSRSLNPPSREFLQVYNEFYYAALPEVSEFLTLVCRVYDLPLALTWAPCARQGKVGSRHSDENFSECVSTVDDACIVPDHQSRHFLEACSEHHLLQGEGIVGKAFNATKLFFVPEVTTFSKTNYPLAHHAKISGLHAALAVPLKNKFNSSVEFVLEFFFPKACLDTEAQQDMLKSLSATLQQDFRSLNLFIDKELELEVVFPVREEVVFAENPLINAGTGEDMKPLPLEEISQEDSSWISHMIKANEKGKGVSLSWEYQKEEPKEEFMLTSGWDNNQIGSGHNNFLSEAEQFQKVTNSGLRIDMDPSFESASFGVGQTLLGSRRPGEKRRTKTEKTIGLEVLRQYFAGSLKDAAKSIGVCPTTLKRICRQHGITRWPSRKIKKVGHSLKKLQLVIDSVQGVQGSIQLDSFYTSFPELSSPHMSGTGTSFKNPNAQTENGVSAQGTAAAPKSPPSSSCSHSSGSSTCCSTGANQSTNTGTTSNTVTTLMAENASAILKRARSEVRLHTMNQDETKSLSRTLSHKTFSEHPLFENPPRLPENSSRKLKAGGASKVKATFGEAKVRFTLLPTWGFRELQHEIARRFNIDNIAPFDLKYLDDDKEWVLLTCEADLEECIDIYRSSQSRTIKISVHEASQVKLGGSFGSIGLGPSL

SEQ ID NO: 604 - protein, 124 aa, Brassica napus
GRRRFTGGNTGRRLIPYENHAKKKRKIFPANHTVSSSSEAIDSDGVVRRCTHCETTKTPQWREGPNGPKTLCNACGVRFRSGRLVPEYRPASSPTFVPSVHSNSHRKIIEMRSREGDQFGKRAV

SEQ ID NO: 605 - protein, 684 aa, Oryza sativa Japonica Group
MDLGFLPDAVDAVNGALKLNWKIEWNPLSFEAKMENGLESSVSFEAKLENRLESSNPGQFKVYSGGLAWKRQGGGKTIEIEKSDLTSVTWMKVPRAYQLGVRTKDGLFYKFIGFREQDVSSLTNFMQKNMGLSPDEKQLSVSGQNWGGIDINVTLSIVGNMLTFMVGSKQAFEVSLADVSQTQMQGKTDVLLEFHVDDTTGGNEKDSLMDLSFHVPTSNTQFLGDENRTAAQVLWETIMGVADVDSSEEAVVTFEGIAILTPRGRYSVELHLSFLRLQGQANDFKIQYSSIVRLFLLPKSNNPHTFVVVTLDPPIRKGQTLYPHIVIQFETEAVVERNLALTKEVLAEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRSEYHNLFNFINGKHLKIMNLGDGQGATGGVTAVLRDTDDDAVDPHLERIKNQAGDEESDEEDEDFVADKDDSGSPTDDSGGEDSDASESGGEKEKLSKKEASSSKPPVKRKPKGRDEEGSDKRKPKKKKDPNAPKRAMTPFMYFSMAERGNMKNNNPDLPTTEIAKKLGEMWQKMTGEEKQPYIQQSQVDKKRYEKESAVYRGAAAMDVDSGSGGNESD

SEQ ID NO: 606 - protein, 314 aa, Helianthus annuus
MALGFSDRNTEMSPYSQQSNTSAVPMDSSKKRKTRSRKEAPEKVAATLAKWIEYNKANEDGKAKTRKAPAKGSKKGCMKGKGGPENSRTNFRGVRQRTWGKWVAEIREPNRGRRLWLGTFGSAVEAALAYDEAARAMYGTSARLNLPNCRSKNDILPLLVTNPASSCDSTTTCSYSEVDATHDSKPGPAVFPSVKHEESVQVKHEPEIVAKEEHCVDNNDLGFDIGDEMFDLEELLGAVEDSNPEAGSGDGYDGRFVNGADANENMQMYMQPDPCVSGQDYSFDFLQPGRPEDCSFTLEELGLGLDAELDLYSN

SEQ ID NO: 607 - protein, 222 aa, Zea mays
MAPRNALPAASAVANGMLMEPRFRGVRKRPWGRFAAEIRDPARKARVWLGTFDTAEAAARAYDAAALHFRGPKAKTNFPVAFAALPPPPPPKKPAAVTVSPSSSSTVESSSSSSRDSPATPPRPASPSQQAPSLDLSLGGTPAMVAAQPFLFLDPRLAVTVAVPAPVPYRPTAVAAGANKHAAASCREEEQSDTGSSSSVVDASPAVGVGFDLNMPPPAEVA

SEQ ID NO: 608 - protein, 232 aa, Antirrhinum majus
MGRSPCCEKAHTNKGAWTKEEDDRLVAYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDGTASQDQVTTISFSNANSKEEDTKHKVAVDIMIKEENSPVQERCPDLNLDLKISPPCQQQINYHQENLKTGGRNGSSTLCFVCRLGIQNSKDCSCSDGVGN

SEQ ID NO: 609 - protein, 250 aa, Crocus sativus
MGRGRVQLKRIENTINRQVTFSKRRAGLLKKANEISVLCDAEVALIIFSTKGKLSEYSTDARMESILERYDRYSSAERAIVAPDPDSQESWRDEYGRLKAKLEALQTSQRHLMGAQLDMLSVKELQQLEQQLENALKNIRTRKNQLMFDSISELQKKEKTLVSQNKDLEKKLIEKEKGKAMAQQGHWDQQGQQYTESSSPPSLLIQDPFPSLTIGINPASGSSEEDYEARPLPPANSNRLPPWMIRSANE

SEQ ID NO: 610 - protein, 220 aa, Vitis vinifera
MSGYRSGPWLVFHGQIPVEALFSGGTGRGGNVGDLFLGPGLEELIEQLTMNDRRGPPPATRSSIDAMPTIKITQRHLRSDSHCPVCKDKFELGSEARQMPCDHIYHSDCIVPWLVQHNSCPVCRQELPPQVSGNVRGQQSSNGGNRSSRSENRSSSNGSSASGSENGGQSQGRRNLFSSLWPFGSSNPNAHHYDETGGSSSRTPHGENHEMDYSGWPSDY

SEQ ID NO: 611 - protein, 246 aa, Crocus sativus
MGRGRVQLKRIENTINRQVTFSKRRGGLLKKANEISVLCDVDVALIIFSTKGKLSEYSTDARMETILERYERYSFAESAIAVPEAESQGSWLNEYGRLKARIESLQTSQRHLTGVQLDMLNVKEMQELEQKLESAMKNIRSRKSQLLFNSISDLQTKEKALVDRNNDLKKKIAEKERKRTSAQQGHQDQQGQQYVDPTSPLSFPVQDPPSLTMGINPARSTSDEDRPLPQVNSSKLLPWMIRSVNG

SEQ ID NO: 612 - protein, 643 aa, Zea mays
MMGGGLLVDQSVVFPGVHNFVDLLQQNGDKNLGFGSLMPQTSSGDQCVMGEGDLVDPPPDSFPDAGEDDSDDDVEDIEELERRMWRDRMKLKRLRELQQTGGKDSLASGVGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCEPPQRRFPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLRLNPGARPPASTGGIASAISFNTSSSEYDVDIIDECKGDEAGNQRTAVTDPTAFNLGAAILSDKFLVPTPMKEETADVEFIQKRNAPAAAEPELMLNNRVYTCNNVQCPRSDYSYGFLDRNARNSHQYTCKHKDPTPQSTENKPPSAPPQPQAFQPAFSQPNQALNSVDFSLPMDGQRSIAELMNMYDNNFVPNKNPSSDSVAVMERPNAMPQQRIQMDEGFFVQGNGAFDDVNSMMQQQQQQHQAPVQQQQQFFIRDDTPFVSQMGDIAASAPEFRFGHGFNMSSGVDYPGAAQRNDGTNWFY

SEQ ID NO: 613 - protein, 232 aa, Zea mays
  misc_feature (121)..(121): Xaa can be any naturally occurring amino acid
MVKGAHFQDAAVDGGAGGNAEAAMQGGAKRQYKGVRMRSWGSWVSEVRAPSQKTRIWLGSYSTAEAAARAYDAALLCLKGSAAADLNFPVHLPFHVPAAAAMSPKSIQRVAAAAAAASGGXHMQPAGATPPCSYGDASSSSGVSSPETGRNAGLCYGTTHYDDMDMDLAGDADADLAALADIEAFFQSPKCMEYAMMDPCSTFFAPAPVATDAASEWAEEGEIDLWSFSSLN

SEQ ID NO: 614 - protein, 375 aa, Musa acuminata
MAGIGLELRLCASRTVGGFVKQVAAVVESTDRGVAKLEESVRSLEEERRKIDAFKRELPLCMLLLTDVIEGLKKELERCRGQKLANAFEEFIPIRRKCEEEAGVKLEADYEDKKNWMSSAQLWSVNSSENNDEDDKSITDERNGRPDCDAEKESLNLESKNLSAGGAFVQFKGISALAMKPKEEVKPLPDLSLRSPAVKSNSCPVSAVTEHQAGGVSGSKGVGRAPPAMTGAHLSLQVMQQTPRKARRCWSPELHRRFVLALYQLGGVRVATPKQIRELMKVDGLTNDEVKSHLQKYRLHSRKLPNASASFSRPPMVLGGLWVPPENHTVSPQQSDSQSGSPQSSLRLAGCDGTISAAAGASCEEEGKSESCNGR

SEQ ID NO: 615 - protein, 164 aa, Brassica napus
  misc_feature (119)..(119): Xaa can be any naturally occurring amino acid
  misc_feature (126)..(126): Xaa can be any naturally occurring amino acid
GLKCMDGREAMSFPSHYYLPRGAFTNLSPSQVASGLHAPMPSPNVHHPQANNPGPHFSMADHRHSDFGHSIHMGMASSAAVQPPPPLPQPLPPPMEQPLVKKKRGRPRKYAPDGQVSLXLSPVPCXLPGSNKAKDSSAVTDPNAPKRARGRPPGTGRKQRLANL

SEQ ID NO: 616 - protein, 1039 aa, Oryza sativa Indica Group
MPPPTVPFFLTSTTLAAAAAKPQRPGPPSPPAQQQQPREARDGSRDACASYTARMRLNPQLALRLFDHLLRSGADPDHVAYALALGRCARGRDHRAAAQLHSHAAKRGAASHRRVCNGLIHAYAVCGSLLDARKVFDRGHEGDAVAWNSLLRGYAAAGDVNALREFFVGMQARDTVSWNTIIAWCVENGEYEEAIAVFREMLASMECLPDRVTLFPGKGIEVEERLSSALINMYSKCACIEGAVHVFENLGAQMNVDTWNAMLAGFTANGCSEKALELFARMEITGLVPNKITFNTVLNACSHGGFVEEGMGCFERMTKVYGIEPDIAHYGCMVDLFCRAGLFDKAEKMIQMMPMKPDAAVWKALVGACKTHRNFELGRKAGHMLIEAAPNDHAGYVLLSNIYALDGNWTGVHKVRKLMLDRGVQKVPGSSSIEIDGVIHEFISGDKSHSSKEDIYEMLSEMCQQLKVAGYVPDTSHVLLDIDDEDVKESSLALHSEKLAIAFGLISTAPGTPIRIAKNLRVCGDCHNAVKLLSKIYGRNPLLLLAPDGPLPTARLLEKASSRADKQMPVRVGCVRDANMLCSAGYYYALGIRSLEPRLGDSMDMSESSEKGMESNASSGPGNGIPVEWQSQFSSAFACQPSVAAQHQQHAMMDSFAAASAGLWASSDVVSAMSSAAPPRGAGFLAPVPGFLQQGLGHFPVDSGFIERAARSTCFGGGMMAGGPYGAADQAMGDAFGGTAEGLMDHHRNVGNDKAEEFAGNGHDEVPSSEVAGGDCSSKGSDSKKRRRPNEVMGTDQVHSSNLPSDSANESVHSKDKGEESSPATTNGGKSKGKGAKETYESQKEEYIHVRARRGQATNSHSLAERLRREKISERMKLLQDLVPGCSKVTGKAVMLDEIINYVQSLQRQVEFLSMKLATVNPRLDLNIEGLLSKDLLRFPGVPSSSIGFSPEMMHPQLQLSQPGLIHGGTAGMANPDVFRRIIQAQLGAKDGSQASHQLPNIRIKFSQNHQNSQSISPTSLQIHLRITSDILHSENPVH

SEQ ID NO: 617 - protein, 412 aa, Arabidopsis thaliana
MDLRLQQAAESGSINELYALIDENPYILENIDAVPFVSTPLHVAAVFGNIEFAMEMLNLKPSFARKLNTSGYSPLHLAVEKEQSDFVSHMLWHDGGLSRVKGRNDVNVDRQNALHLAVMNDRFEVLQVLTGWIQRMSQKDAYYIENRVLNKRDFDFNTALHLAAYKNDQQALKLLLKCRLVEPNLVNIDDLTFVDILRTQGENAGGGNLDLEQAVIKTGCVEAASMPKFKEESDLLKSPINFMTYYSTSMKRMKSSTSDQDRGAFLIVCTLIITATYQMALQPPGGVHQSENANANAGSVVMKQTFFILLWISNTVGFCCAVFYTFCLIPLGQLFTIWFFYIGTCLCISYALAMAVISPHPLVFLSATFALFLVFALYLLLEAFVDTWRKHRTVVPKSRFSWFWKVLQYYYI

SEQ ID NO: 618 - protein, 314 aa, Oryza sativa Japonica Group
MQGGDHGGMEMGVGSFTGGGGGGECSSSSATAAAAAAAAAAAAAAEAEERQLLKGEIAVHPLCEQLVAAHVGCLRVATPIDHLPLIDAQLAQSSGLLHSYAAHHRPFLSPHDKQELDSFLAQYMMLLCSFREQLQQHVRVHAVEAVMACREIEQSLQDLTGATLEEGTGATMSEDEDETAPMLEGPMDMGSDGHDLMGFGPLMPTDSERSLMERVRQELKIELKQGFKSRIEDVREEILRKRRAGKLPGDTTTILKQWWQQHSKWPYPTEDDKAKLVEETGLQLKQINNWFINQRKRNWHNNSQTSTLKSKRKR

SEQ ID NO: 619 - protein, 282 aa, Craterostigma plantagineum
MKTQNTSETLGALISICPNTTDEERVSNVETSAMFGLDDECFASEKKRRLSNEQVKALEKYFEVENKLEPERKVKLAQELGLQPRQVAVWFQNRRARSKTKNLERDYGVLKSNYNALKHDFETLKRDNESLLKEIHELKSKLNEDDDSKSVEEEPFVEALELDANSDDVEPDSNQLFGSSDSDSSAILNEDNNNSRSSFLDDHRRKLSKIHGGSSPPSSAKIASEKNGSDESCKRAAAYKPQFVKIEEQHNLFREEDESCTTTFFSDEQAPTLNWYTPDEWN

SEQ ID NO: 620 - protein, 297 aa, Glycine max
MVEPLNQSTPRTKKMKHKRNPIHDSKMTRKLRIICNDPDATDSSSDEDEYFGNVRKMIEPLEPLERLEVPVNPVVADETSTESTNNDELNQTKRVLGKTPTVKRQSCGKYKGVRMRKWGKWAAEIRDPFKGARIWLGTFSTAEEASQAYNARRLEFEAMAKALSDEKSNNGSNSSSNNNVVASAETVAATENNSSNYCLEMLEMPDLSMLNVPSPSAVAATAAAPSEFELDLLAFVDSEYGFHDEHDFDDDLAALEDFHICGFDDNEPSELPDYDFDDFGADEFAGWIEEPLNIPCV

SEQ ID NO: 621 - protein, 444 aa, Populus trichocarpa
MICIKSSANAVGGKTARACDSCIKKRARWYCAADDAFLCQACDSSVHSANPLARRHERVRLKTASLKSLDLCSKENSVPSWHGGFTRKARTPRHGKPVSQSKIAETIRNIPIPLVPEVGSDEISHEDNEEEHLLYRVPIFDPFVADLCASTTISNEAGAIVPAGGNDGTDQRVADSNGVESKILIGAIERRDVESLPGFLPSDMDLAEFAADMESLLGRGLENESFGMEELGLMDCKEEKEFEVKGFPLWNGKVKVEDEENASVERKAVRKCYAGIETDMAKDPIFELSFDYNSSATCGEEDEKVGIEEGDLKNTRGEYEDDDGAKRKILLSLDYEAVMTAWASQGSPWTNGNRPDFDPDECWPDCMGICGAQLHHPYGDMISGLGAHPAMVDGGREARVSRYREKRRTRLFSKKIRYEVRKLNAEKRPRMKGRFVKRTTLAGK

SEQ ID NO: 622 - protein, 329 aa, Coffea canephora
MCGGAILEGLIPPRNNNDGTRRLSSADLWPSAADFWPNSHLAKPSRSNPTDAPHKATHETCHDPHDEAGGKQQVLPKGAKRQRKNLYRGIRQRPWGKWAAEIRDPRKGVRVWLGTFNTAEEAARAYDKEARKIRGKKAKVNFPNEDSTSYPTCIPSQTQYQQVHIPSPPTFCGPSSSNCKFNQLRVGSSDCSASDCYHANSIDDCARFTNMMGFRNPSEEVSGSGSSDNECFLGHLKQVAKAAAEEEAASVITENDTKDNNKAAESEEYQVEKLSEELLAYESFMKFYQIPYIDGQSAAASANPAQELATSIQLWSFDDVSPANRPMPL

SEQ ID NO: 623 - protein, 365 aa, Glycine max
MPEGYEIHDNEETSSGCSSSFDLNEELACSEDNSDTEECCELTTTNEKAKDEGTSANGSSISSREGNERRGTVRQYVRSKMPRLRWTPELHHSFVHAVERLGGQERATPKLVLQLMNVRGLSIAHVKSHLQMYRSKKLDEVGQVLSQTSKSNQEVARRPLILHQCIIPQQHLMMGNGGIILASNFNKHNHFPSLLHPSFSLSRSQTNDSDSRHQHWYTNHQDFSIPIASSQIQPKDTRGRIAPMRPSQLLEEKRWPPLEILNNHQSMLKRLPAIVAPKNGSQAVQPAEWSFVNNTSIRDYLSNNSNEPLNNSNSLKLEFDPPFRIKKDEQQLPDLQLGLSHTVGTDGKIDHYKETPEISTKLSLS

SEQ ID NO: 624 - protein, 534 aa, Cryptococcus neoformans var. neoformans JEC21
MPDPAPFWLCHECGAQMRPVTIDGTPHCASCNGEFIEILDPEVNPDPDYELPPPPPTRPGQQTPSRFDPHFLSNFPPPQSEGSSSPARQRDTNNTGNFLSSLFSMLGTGSRQGSEETPRRPPPSFHGEPSASQRNGQSQNTDRPGMRTYAFNFGNARGSVTIGSFGSNLGRQGYRMNNDPTSPSGNLFNDPDPFRADPFDARFRPPGDGNRDINGDMPLPLGANEALQLIAALLDGNPPPNMGNLGDFATSDADFMRILQETFMEAAGPQGPVPANETVIEGLPRFTFDSGSLAKSQFRDCPVCKDDFEIGNEVMLIPCGHIYHPDCLVPWLRQNGTCPVCRFSLVSEDEQPNNQRTPNVGTEHTRNAEEERPATPTIPAAVSNFFRNLFGGSESQPSTPRAAAGGGHGSNASQDPHSSVNVVSESTISADASSRHSPTIHGATRREQVQPCDEVASEGSSNDSLVRVYPEHSSGETHGDGATDGEAGRIAEQEQQVASRDRLADRVNRDFNERWQRLRREREEDDTVYHPDLD

SEQ ID NO: 625 - protein, 456 aa, Zea mays
MMQFTHTAPPPPPLHPNGHAGGLGLGLFLDVGAPRAARPWPGSFPTPASKISLGNLNSTSCMEQLLVHCANAIEANDATLTQQILWVLNNIAPPDGDSNQRLTAAFLCALVARASRTGACKAVTAAVAAAVESAALHVHRFTAVELASFVDLTPWHRFGYTAANAAILEFVEGFPAVHVVELGTTHCMQIPMLIDMLASRPEGPPILRLTVAHVAPGAPPPALDMSYEELGAKLTNFARSRNMSMDFRVVPTTPADAFTSLVDQLRVQQLVMDGTEALVLNFHMLLHTVPDETAGSVSLTHPVSLRTMLLKSLRTLDPNLVVVVEEDADFTADDVVGRLRAAFNFLWIPYDAVDTFLPKGSEQRRWYEAEIGWKVENVLAQEGVERVERQEDRGRWGQRMRSAGFRAVSFGEEAAGEVKAMLNEHAAGWGMKREDDDLVLTWKGHNVVFASAWAPS

SEQ ID NO: 626 - protein, 274 aa, Antirrhinum majus
MGRSPCCEKAHTNKGAWTKEEDQRLINYIRAHGEGCWRSLPKAAGLLRCGKSCRLRWINYLRPDLKRGNFTEEEDEIIIKLHSLLGNKWSLIAGALPGRTDNEIKNYWNTHIKRKLVSRGIDPQTHRSLNSATTTATATPTVNNSCLDFRTSPSNSKNICMPTTDNNNNSSSSTDDTKCNSSTTEESQSLITPPPKEEEKSVPLVDLELSLGLPSQSQCNKSVSLNSSSSGFYDLFRPPAKVAQRMCVCKWTLGLQKGEQFCNCQSFNGFYRYC

SEQ ID NO: 627 - protein, 309 aa, Oryza sativa Indica Group
MASSSQTTVSMEVAMKVEGSGGGGGGGEEGEVVAKKEEEVAAAAAAMELDLLGALRAEEVMPAEKGKAAVVMVGEAVAPSVEERASAVAAAAANGGGGGGGGGGEARRRLFKCNYCQRKFYTSQALGGHQNAHKRERSLAKRGAAVAAAAAAAGRGLYGFGDPFVPHHLRFRSLWPYPAAAGAARTTPFLGRGSASAAAAAAAPAAPFYGAVHHGWSAQPPSSLQGIAARHAAAERPVYPADAFGYGAGSSSSRATGAPASAGLRWAEGGGSGTIHSAAAAAAGEQHTAAEVKAQEEMSSSKIDLTLKL

SEQ ID NO: 628 - protein, 136 aa, Solanum lycopersicum
METNKWEGKRSITEAEKEEDEHGSVEEDSKRKRVLTLSGRKLVGEGSAHPSCQVDQCTADMADAKPYHRRHKVCEFHSKSPIVLISGLQKRFCQQCSRFHLLAEFDDAKRSCRRRLAGHNERRRKITYDSHGENLG

SEQ ID NO: 629 - protein, 297 aa, Glycine max
MEDKDRAASSDPTADAEFAGDTSWTLAADDSDGAYLFPGDRERSILREFVWNLEPDQPNRIGTDDGLWKPVQSSLTDSIEPVAAAPSRSNNQSISSSSSEDPPEKSTVSDDKPPEIPSKGKNKGQKRIRQPRFAFMTKSEVDHLEDGYRWRKYGQKAVKNSPFPRSYYRCTNSKCTVKKRVERSSEDPTIVITTYEGQHCHHTVGFPRGGIFFHEAAFAGQLAPTMSQFYYPIQLPSRENDDNNNNTLSTISQPCQAQDETGEGSSVMMPADGSSPSQPPTDEGLLGDIVPPGMRIR

SEQ ID NO: 630 - protein, 331 aa, Oryza sativa Japonica Group
MSTGGNGGGVGVRRRRWNLYWCYVCRRALRVVVPSATSDVYCPRCFGRFLHEIDLPVPRVSPPAEDQFFQPPFLPYDGPRRWVLYTGGGGGGDYGGADVTARRRRLPSPPPAPGTRRQDGAGDGDPPPPAPAIDPGEYFAGPDLNALIDALTQDDRPGPPPAPESAIESLPTVHISPDHLPADGGSECPVCKEEFELGEAARELPCKHAYHSDCIVPWLRLHNSCPVCRQEVPPPPEPDGESPGIDGGCDDGVGGGGEPAEPPRPAMAGWDPIALLAIALRPDLNGWENSHGRSESEADDDEVAGGGVSTTAMIHSFFVVAACFLFISFLV

SEQ ID NO: 631 - protein, 400 aa, Arabidopsis thaliana
MYYHNQHQGKSILSSSRMPISSERHPFLRGNGTGDSGLILSTDAKPRLKWTPDLHERFVEAVNQLGGGDKATPKTIMKVMGIPGLTLYHLKSHLQKYRLSKNLNGQANSSLNKTSVMTMVEENPPEVDESHSESLSIGPQPSMNLPISDALQMQIEVQRRLHEQLERHLQLRIEAQGKYLQSILEKAQETLGRQNLGAAGIEATKAQLSELVSKVSADYPDSSFLEPKELQNLHHQQMQKTYPPNSSLDSCLTSSEGTQKAPKMLDNRLGLRTYIGDSTSEQKEIMEEPFFHRMELTWAEEESLRENHNRPYLSTMVNNAEPRISSSRRSPGRLSIGVGLHEHRGRSSNNSEYTEERFNENNEDCKLETHTRTALDLNTHDENYGTTRPKQFDLNGFSWN

SEQ ID NO: 632 - protein, 521 aa, Chlamydomonas reinhardtii
MASELLRAASYPGVIGVEFLDCELPAESEAQAASTSGAPVEPKDAAAQRSHGGVGLGDLTYAHGGLSARALRPGASRFTCGGQVLMATSGNGVSALASAAPETWVPTMTCAPRPSDSCLPASAAELREPVTSTIGRSTSPFDAERPSCPHLPAMGHLTPHQAPAGLAPTWGESSFGIHGLAGGECGGGSMWDCEPVAPAGPSAEGLDALSFAFMQSQQPHDQLISRPGLSVTEHPCTLLRAPSGGYSLINTASIAAAAPLDAAAVILPQPAAAAVPAAAATPACSESRTSPTPSTDQQQPDATSAQTSSGATSSCGGSDMPENAAAEVQQRAPEAPPAPLPLPQDAQASAVPSVAVEVVVEEEEELRPVAVQQVGPPGTAALAAMRASGRMALAAVPARVGQKRRAAATAAAVVLEAARDDEDDDEDYDEREEAGGAAGRGNTKRMKRVGVPRTTTNKPKTGVTCRNCRATETPQWRCGPEGPRTLCNACGVRYKKGQTLEYMAKKAAAAAARGRNGGGDY

SEQ ID NO: 633 - protein, 362 aa, Zea mays
  misc_feature (181)..(181): Xaa can be any naturally occurring amino acid
  misc_feature (191)..(191): Xaa can be any naturally occurring amino acid
MNSMESCVPPGFRFHPTDEELVGYYLRKKVAAQKIDLHVIRDIDLYRIEPWDLQGHCGIGYEEQNEWYFFSYKDRKYPTGTRTNRATMAGFWKATGRDKAVHDKSRIIGMRKTLVFYKGRAPNGHKTDWIMHEYRLETDENAPPQEEGWVVCRAFKKRTAYPARMAWGDPSYAYREISAMXAAAAAFVDPXRASYAQIRRQQSNKSARFKQEAELDGGAAAALLQYSSSHLVELPQLESPSAPANKSQAASASDEVVDAADSGRRPGKKARADEVATDWRALDKFVASQLSPAAECGLEAAAASSTAAASNVGSQLDHVEDDDMAALLFLNSDGRDEAERWTGLLGPAAGDDGDFGLCVFDK

SEQ ID NO: 634 - protein, 693 aa, Ustilago maydis 521
MADSPASISHPANLGTADANAPIHVYPHDSATMRPTSSGSNLHLNISGLSVKSEGEQHQQHQQYQQHQQPHLANSLNFAGTAASSPPSNLASPADASASFSIGAAAASTSPHLHPDSIATSDAHLGAPNVSSPLRAEYNMSTETAPLTAAMRSYSSTSIKSATGSQNAESPTSGFGGGAGNQSVGDVSVDDPNVTSQSDADLAAEKRQSSKFVYKLFRMVSDPDYQHLISWNRNGTSVMVCNFDEFAKEVLGKHFKHSNFSSFIRQLNMYGFYKVNKTPRGHRQSADAQIWEFSHPKFLRGRPDLLDDIRRKALDSEHARVEARDLQYSVSVGQMQLRQQVDEMQFRLEELAEQNMALRTFTTQLRDVLGMVLEHVKKTSGGNLGFDVRVPTLDIPSPMPPQGLWTPQGHDGPPIFVTEPEFGPGVGPGGLRMGAGATHLSRGMHGTSSAFGVSMEGYGMAATPISRRVSVSSAHSESMLTMNGSPMHSSMHGDGAMMAMGANMTPQRSASFGEGQMPPPQFNIGRGDGPGANRAGLAGLAIDTSGATAGMFAPGMHPGVSPTSAGLSAGNAGLGVMSMPPSPLTPQHQAMMTAINTPLPPSPAPGSMAGGQFKSFEGSPFIASNGFAPQFGQNVISMADQSFFGPDGSEGPNAKAMRTPLKRTASNSGPSGQSTPVLMHSTSPGLAKRKSPV

SEQ ID NO: 635 - protein, 223 aa, Zea mays
  misc_feature (23)..(23): Xaa can be any naturally occurring amino acid
MVTVREETRKGPWTEQEDLQLGXNRTGKSCRLRWVNYLHPGLKRGRMSPHEERLILELHARWGNRWSRIARRLPGRTDNEIKNYWRTHMRKKAQERKRNMSPSSSSSSLTYQSGYPDTPSTIGVEGQELHGGSGCITSILKGTPPDMDGYPMDQIWMEIEAPQMPSEESFVGGNHNVCSSLATPLPPPTVWEYYPEACWKVDDEIKMAPQFQFGYSEGVGPCF

SEQ ID NO: 636 - protein, 248 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDVLTNEYENQQHRTTVSIGMDPELDQFMEAYCEMLTKYHEEL

SEQ ID NO: 637 - protein, 168 aa, Brassica napus
METFCGFQKEEEQMDLPPGFRFHPTDEELISHYLHKKVLDISFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKLSAHNLPKTAKNEWVICRVFQKSA

SEQ ID NO: 638 - protein, 213 aa, Oryza sativa
MAKTRQPQKRVLESFTIKGPDGVIKPGDTVLMMAPDSSKKPYVARVEEIEATGPQASQVKFKSADTIEGKCYVHTFRDYTKLRSVSAEDFFCRFEYKSATGSFVPDRIAVFCKCEMPYNPDNLMIQCEDCSDWFHPSCVEITIKEAKKLEHFYCKSCIAENGKDLQKSHGATAQSEENVPSQRRRRYSLERIYSSRDVIRATSYISDFFLREV

SEQ ID NO: 639 - protein, 227 aa, Vitis vinifera
  misc_feature (16)..(16): Xaa can be any naturally occurring amino acid
MSFHRFYASWFDHLNXLVHQLTLAPKPTTPQDNPALLQLVQKVISHYSQYYRAKSVAAQNDAVSLFAAPWSSSLERSLHWVAGWRPTIVFHLIYTETSARFESHIADILHGVRTGDLGDLSTAQLHRVSELQCETVREENEITSELAKWQEGAVELVEAGGDGNVEEKIGGLMSVLVKADELRMRTIWRVAEMLTPQQAVEFLIAAAELQFGVRVLGLNHDNQRENV

SEQ ID NO: 640 - protein, 505 aa, Arabidopsis thaliana
MSSTFNPAASSPDEEETGEVKIEDQCVENKQSTPASCSSVSEGSAGSSHKSPTIASPATVSPTHRYLGRTSGPIRRAKGGWTPEEDETLRQAVDTFKGKSWKNIAKSFPDRTEVQCLHRWQKVLNPDLIKGPWTHEEDEKIVELVEKYGPAKWSIIAQSLPGRIGKQCRERWHNHLNPDINKDAWTTEEEVALMNAHRSHGNKWAEIAKVLPGRTDNAIKNHRNSSLKKKSEFYLLTGRLPPPTTTRNGVPDSVTKRSSSAQKRVFGSVAQTSSVTTDVNNLAEDGNGQINSSVPVEEVVAASRMTSLNEYARSPQLPNPEPLPENGGAANNGYHLYYTPQIDYYRASEVDTQRMYGNECGCSPSASPVSFFTPPPCRNVHSNGSTPRSPESYLREAGRTYPNTPSIFRKRRPRVVVQDNNNAKKTDEAKEVDQKVNDGKDSSEIQNNGSNAYNLSPPYRIRSKRTAVFKSRQLEFISREEEKADDETKSSEKDMLIDGDSQLLG

SEQ ID NO: 641 - protein, 229 aa, Oryza sativa Japonica Group
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEGQSSESVMTALHSGSSQSQDNDDGSDVSLKLGCTATQQKR

SEQ ID NO: 642 - protein, 159 aa, Physcomitrella patens subsp. patens
SRKPRGRPPGSKNKPKPPVIITRENGNAMRPHILEVASGHDVWESVADFARRRQRGICVMGGSGTVTNVTLRQSTTPGATVTIHGRFEIISLSGSYLPPPSPTPPAGLTTGLTISFAGASGQVLGGCVVGALMAASPVLVVATSFTGATYDRLPLAEDE

SEQ ID NO: 643 - protein, 173 aa, Brassica napus
MALEAVVYLQDPLSYSSCKDFPFHDLYFQQGEDRDPLDTKNNIKLGQEQRQGFGSINYNGKGGDNSVDYSYNDQVDLQWPPHELPYGSTVDTRNHPPPSDMAATGGERRKRRRTRSNKNKEEIENQRMTHIAVERNRRKQMNEYLAVLRSLMPPCYSQRGDQASIGGGAINYL

SEQ ID NO: 644 - protein, 694 aa, Physcomitrella patens subsp. patens
MDLGDGHPRHGHGKFSFGTHDRSPLVLRRSLPADSPRGPKPVKAHAALRITDASSCPTTCMPSYPKTNDETKYMNETCQYGCTEKLAGVLNHAVERATAHWVGASSQRNRPRGGLKSRFRSHAPSGGGRMLVEAGKDSCSKAVKLAALEHIEMSRRCSHCGLNGHNSRTCPDRGVRLFGVRLTDGISSMNMRKSVSMNNLSHYTSTHNSPSPSEHSESGAAPDGYVSDGLVQTSNNARERKKGVPWTEDEHRLFLLGLQKLGKGDWRGISRNFVTTRTPTQVASHAQKYFIRQSNMNKRKRRSSLFDIVSTSGGGVVVMIGWSQSVGMRVEVGWDMIRDVGREWNGMVVGGGTCDLRWGGLWSMAGRSFDCGRVDMHGRRGADEPTAPVELGAEPHVPVGGVVRAKFGGGIRSIGGRIRGAEAHESSGDGNGRGWGDGGGGDGVQGGAFGEEWNGGGGDELRHGEEWNGERGCGRGGSSRGGSVAGRVSGSRKDPVLVHVVGWRRGGFGVDGAGAGSGAGTAGIEQQRRGVIRSEPGDRETDGEGGRCEQRSDEDGGGWSGHSAAEAGAVTAGAISVDGKAVGGAVEAFISVPREHVVRWEQHTTRSERDQRGVKRQRWISYILVSVQNSYPIYRCFEVLHVGLHNCLLCSHSVLQNRYLSHSRIGYYGLAAIGSNEAEHCGHGDESDLSTRLR

SEQ ID NO: 645 - protein, 336 aa, Solanum tuberosum
MENVHHHHDHDNIGNFIQRPNFPLQLLEKRDQVDHTTICSSQVHPYNSTSLHMMTTSSSDAPCVDHNQKSKNEDKKQQQPQAKKPTTTKDRHTKVDGRGRRIRMPATCAARVFQLTRELGHKSDGETIEWLLQQAEPAVIAATGTGTIPANFSSLNISLRSSRHHSSATNYLAHNNNFGHVYPDRNYFNGVGLFSSENNSFFPSGNLNMLQAKEELCDDDDNDNDNNNNNTGRIKRRSEDQDLLQNNYHMSNMLQSSPYGSIPASHQVGQIPATTLYMMTNNNNSSHHDPSNCSMWGSSSNNNNNIENSNIRFINQFWGHVAVAAAGRRRKGNGGC

SEQ ID NO: 646 - protein, 262 aa, Capsicum annuum
MNTAIIAKSSGVRKGAWTEEEDFLLRKCIQNYGEGKWHLVPIRAGLNRCRKSCRLRWLNYLRPHIKRGDFGWDEIDLILRLHKLLGNRWSLIAGRLPGRTANDVKNYWNSHLQKKLITAPHRQEKKYNTALKITTKNVLRPRPRTFSSSAKNNISWCTNKSTVITNTLDKDERDKEIGLNICQKLTSETSSTIDDGVQWWTSLLENCKEIEEDVAAVGIFEEKNKLVPSLLHDEINSLTMQQGQSDGWDDFSADIDLWNLLN

SEQ ID NO: 647 - protein, 208 aa, Glycine max
MTRKKIPIKKIDNINARQVTFSKRRKGLFKKAQELSTLCDAEIALIVFSATGKLFEYASSSMQQTLERRNQHSGIQGLDNPSIGQQLGSDSFGMLPLRKEIEDKTNELSQLNEEELQGLKIKELQKLEDILQRRWTTISKTKDEKVIQEINHLKTKEAKLMEENQKLKQSFLQEQRQSYESFTCSSSEFPPDNGSSDTSLKLGLSLFE

SEQ ID NO: 648 - protein, 657 aa, Physcomitrella patens subsp. patens
MSSDRWFHATGGNISVSRRIKHFPPPPPTLRLVVRFARCRRVTSSRSKAQEKDWVVMRIGSRRILGKSVGFRFQRVDFWSSTRWFERAGGVEGGIGTNSVEAQGGTEHCGDKGEFDQVVGFASVLEIEALEEHEMSRRCSHCNLNGHNSRTCSDRGVRLFGVRLTDSVSSMNMRKSVSMNNLSHYTSAHNPPSPPEHSESGAAPDGYVSDGLVQTSNNARERKKAFLCASFRKIIHLGQKCSQVKRRVQTHGNIPNHSVGVPWTEDEHRLFLLGLQKLGKGDWRGISRNFVTTRTPTQVASHAQKYFIRQSNMNKRKRRSSLFDIVSTSGGGVVVMIGWSQSVGMRVEVGWDMIRDVGREWNGMVVGGGTCDLRWGGLWSMAGRSFDCGRVDMHGRRGADEPTAPVELGAEPHVPVGGVVRAKFGGGIRSIGGRIRGAEAHESSDGVTVDVGGKRDGNGRGWGDGGGGDGVQGGAFGEEWNGGGGDELRHGEEWNGERGCGRGGSSRGGSVAGRVSGSRKDPVLVHVVGWRRGGFGVDGAGAGSGAGTAGIEQQRRGVIRSEPGDRETDGEGGRCEQRSDEDGGGWSGHSAAEAGAVTAGAISVDGKAVGGAVEAFISVPREHVVRWEQHTTRSERDQRGVKRQRCDDGAKCVALSK

SEQ ID NO: 649 - protein, 286 aa, Dendrobium grex Madame Thong-In
MDEMYSIPPDSTFAAADDLHGLIAASGYGAAAAAAAAEEEMKARIASHPRYPHLLEAYIDCQKVGAPPDIASLLEEIRRENAGGERLASSSVILGSDPELDEFMEMYCDVLVKYRRDLERPFDEATAFLNTMEVQLSDLCKPTCRAALGPYVSDEAVGSSDEELSGGEGEAPESHLKGEERDLKEKLLRKYSGYLSSLKQEFSKKKKKGKLPKEARQILFEWWTAHYKWPYPTEADKIALAEATGLDQKQINNWFINQRKRHWKPAENMHFSVMDNSSTSSLFADD

SEQ ID NO: 650 - protein, 283 aa, Glycine max
IKQFPVCTTTLKRICRQHGIKRWPSRKIKKVGHSLQKLQLVINSVQGASGAFQIGSFYSNFPDLASPNLSGTGFFSTLNQSDYPNSTSTQPDHGSLSPEGASKSPSSSCSQSSISSHSCSSMSELQQHRTANGAGNKVSTTVSEDSAGVVLKRISSEAELKSLSQDRAKLLPRSQSQETLGEHPKTQYQQPLLKTSSSKVDSHRVKVAYGDEKTRFRMPKSWGYEDLLQEIARRFNVSDMSKFDVKYLDDDCEWVLLTCDADLEECIDVCQSSESGTIKPDAW

SEQ ID NO: 651 - protein, 466 aa, Glycine max
MEMQDQIESTRSTIFGSASNIHSNAEKQAENVAPKVRKPYTITKQREKWTEEEHQKFLEALKLYGRGWRQIEEHIGTKTAVQIRSHAQKFFSKVVRESEVSDEGSIQPINIPPPRPKRKPLHPYPRKSVNSFRGPTIPNETEISPSTNLLVAEKDTPSPTSVLSTVGSEAFGSQFSEQTNRCLSPNSCTTDIHSVSLSPVEKENDCMTSKESEEEEKASPASRPLSTVSNPKMCMKPEFSSKEIEDATDMPQTTSIKLFGRTVSMVGNQKSLKIDDDGKPITVKSDEVDDVENEKLGQSGESKQVDTQLSLGVVSGNWPITPDADGANVTSIEPPKENQCFSESAPDAFFPQWSLSQGLPPFYLRPCNQVLNPLPLRPSSLKVRTREEESCCTGSNTESVCDMENQGKNSDAVDSKFQKYHEEGAAPQKKPARGFVPYKRCLAERDGHSFIVAMEEREGQRARVCS

SEQ ID NO: 652 - protein, 151 aa, Brassica napus
MADDHGEAHHFLHPQPPPPSSMRHRAASDEIVEVQGGHIVRSTGRKDRHSKVCTAKGPRDRRVRLSAHTAIQFYDVQDRLGFDRPSKAVDWLIRKAQTSIDELAQLPPGSPADAVRNAAANAKPRRTAAKTKISPSPPPPQRGQLQLGGAR

SEQ ID NO: 653 - protein, 433 aa, Medicago truncatula
MELDPSCAEKIPYLHRDFPKDLRVKPEIPKVIPSQPCSTLSPPPSHYTTYLYQNHRNQFKEHALNRSNNQSSFPTMIPSFRDPISMIPMPSYNDAHNNGSQREFLSARNPMIFTSNNNKIEAMHGCLHTGEGIWDLSKKNIFRYGETSQSMVSPDLSPSLVYDAHRSVSIKPKLQGDTFFYGGLRNEPQENDGPVLTGQRRQKRIQNNSEIQHKDLNIIKGQWTTDEDRILIQLVDRFGLRKWSKIAKYMNGRIGKQCRERWNNHLCPDIKKESWTEEEDKILIEAHKIVGNKWAEIARRLPGRTENSVKNHWNTTKRRQKAKKKNRGNSSKGTLLLKYIMEVTSAKKVEKEMMNNSPSMMNIGNQPNYESSESDFFSEGLTTPEDGIGGYVPMMFNDDDGMASGFRSNGMEFFPEIPIKQEIDLMEKIYSNP

SEQ ID NO: 654 - protein, 230 aa, Triticum aestivum
  misc_feature (37)..(37): Xaa can be any naturally occurring amino acid
  misc_feature (46)..(46): Xaa can be any naturally occurring amino acid
MARERREIKRIESAAARQVTFSKRRRGLFKKAEELSXVLCDADVAXLFVFPSTGKLSQFASSSMNEIIDKYSTHSKNLGKTDQPALDLNLEHSKYANLNDQLAEASLRLRQMRGEELEGLSVDELQQLEKNLETGLHRVLQTKDQQFLEQINELHRKSSQLAEENMKLRNQVGQIPTAGKLVVADTENIVAEDGQSSESVMTALHSGSSQDNDDGSDVSLKLGLPCLPWK

SEQ ID NO: 655 - protein, 324 aa, Picea sitchensis
MREIGRMGCKSGPNSAQINLPPGFRFYPTDEELMVHYLCKRVASQPFPIPIIAEIDLYKFDPWQLPEKALFGEKEWYFFSPRDRKYPNGSRPNRAAGSGYWKATGTDKPVTAGLNRMKVGVKKALVFYKGKAPRGIKTNWIMHEYRLADSASKAAKRKGSIRLDDWVLCRIYEKHYASQKAVPKESNELSSCVDPEEDQYMAPVASNSPPDMDDNKLLINLPRINSLNRINSLLKFPSREIMKMPDPNYNQTEQQYSRAEADAGSNSGGQAIEYGQNSPFWRNQQFGYNYDQMAQNPFPQQLEHMPSLGANSSAFFASLAAELL

SEQ ID NO: 656 - protein, 229 aa, Glycine max
MEKVSFVKNGELRLPPGFRFHPTDEELVLQYLKRKVFSCPLPASIIPEVDVCKSDPWDLPGDLEQERYFFSTKEAKYPNGNRSNRATNSGYWKATGLDKQIVTSKGNQVVGMKKTLVFYRGKPPHGSRTDWIMHEYRLNILNASQSHVPMENWVLCRIFLKKRSGAKNGEESNKVRNSKVVFYDFLAQNKTDSSSSAASGITHEHESDEHDHEESSSSNTFPYTIRTKP

SEQ ID NO: 657 - protein, 297 aa, Arabidopsis thaliana
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 658 - protein, 644 aa, Nicotiana tabacum
MEAIFQEQLFPGADAFIFRHPSSILVDPREDHVVQNGTIVNRHSFEDYSHVHSNVSDPIVRDGDSSPKEEGEGEGDHSDAMYKYISQMLMEEEDLEYKPCMFHDCMALQAAEKYFSDVLHGSDNITNSPQFSAIIPQDKVSSSCPDFSNTSSDSIESLQWDLNFESPVSVKSLSGSLLTSFRSPSGLREKKNHHRQDDDQQRSNKQLATFAADESEPLEMYDNVLLLCPNNPCVLPNEVKKPIKVGRPRSGGKKHSSSKKEIVDLRGLLTQCAQAMSSYDTRTANELLMRIRQHSSSHGDGTERLAHYLANALEARLSSTGTASYTVFASSRISAAHILKAYKAFITACPFKLMSNIFANKYIKKLITGGAPRTIHIIDFGILYGFQWPCLIQSLSALRRGEPIKLRITGVELPQPGFRPAERVEDTGRRLKKYCDRFHVPFEFNAIAKKWESITLEELAIDRDEVLVVNSLYRLGNIPDETVVPTSPRDVVLDLIRRIRPDMFIHGVVNGTYNTPFFLTRFREALFHFSTLFDMFEATMPREDEDRKLFEEEVFARDAMNVIACEGTERVERPETYKQWQLRCARAGFKQLPLDQEIVNFVSNKVRREYHKDFSVDEDSQWMLQGWKGRVVYALSCWKPAEQL

SEQ ID NO: 659 - protein, 244 aa, Oryza sativa Japonica Group
MAGGGGGGGRGEGEGRAATGKRERIAIRRIDNLAARQVTFSKRRRGLFKKAEELSILCDAEVGLVVFSATGKLFQFASTSMEQIIDRYNSHSKTLQRAEPSQLDLQGEDSSTCARLKEELAETSLRLRQMRGEELHRLNVEQLQELEKSLESGLGSVLKTKSKKILDEIDGLERKRMQLIEENLRLKEQVSRMSRMEEMQPGPDSEIVYEEGQSSESVTNASYPRPPPDNDYSSDTSLKLGLHS

SEQ ID NO: 660 - protein, 495 aa, Glycine max
MDANREQIVDVGSVVEAVSADDGDAPLYSLESLCMRCGENGTSRFLLTLIPNFRKILLSAFECPHCGERNNEVQFAGEIQPRGCCYSLEIPSCEQKMLNRQVVKAESATIKIPELDFEIPPEAQRGSLSTVEGILMRAADELQALQEERKKVAPETAEAIDQFLVKLRACAKGESAFTFILDDPAGNSFIENPFAPSSDPSLTIKFYERTPEQQASLGYLVGSTHIEGTHDQAPERGEVTADQVRREPHGSIGATAGHRAIAQSNSSEIAEALFRYTAPEEVMTFPTSCGACAARCETRMFVTNIPYFQEVIVMASTCDSCGYRNSELKPGGRIPEKGKKITLNVKNVNDLSRDVIKSDTASVKVPELDLELASGTLGGIVTTVEGLITKISESLERVHGFTFGDSLDEQRKNKWIDFKARLNKLLSLEEAWTLILDDALANSFVAPATDDLKEDNQLSFEEYERSWEQNEELGLNDIDTSSADAAYESTNTTKT

SEQ ID NO: 661 - protein, 210 aa, Didymocarpus citrinus
MLGFDKPSKTLDWLLTKSKVAIKDLLHTKKSSSARSTSSPSECVGLNGKDFEYGSRLLPADSKRKSELMNANKCKGAKDPTQSASTLSKESRAKARARARERTKEKMCIKKLNESRNLNSLFEVHRPSSSNSQPILHCPISNEATAATVAATEHLIQESNVVKRMLRHHYYHPSFFGFHCSFPSPNENWDVSSLTSQTNFCDILDQHKFI

SEQ ID NO: 662 - protein, 376 aa, Zea mays
MGSSGADTPSKEQQPPATSGAAIPPVYPDWSSFQAYPPIPPHGFFPSPVASSPQGHPFMWGAQAMIPPYGTPPPYVMYPPGVYAHPSMPPGAHPFTPYAITSPNGNADATGTTVAAGNTDGKPSEGKDKSPTKRSKGSLGSLNMLTGKNPSEHGKSSGASGNGVTSQSGESGSDSSSEGSEGNSHNDSHHKESGQEHDGDVRSSRNGVSRLQSEGKLNQAMAILPIPSSGPATDPTTNLNIGMDYWANTASSAPAIHGKATSTTVPGAVVPAEQWTQDEHELKKQRRKQSNRESARRSRLRKQAECEELAQRADVLKQENASLRDEVNRIRKEYEELLSRNNSLKEKLEGKQHKTDEAGLNNKLQHSGDDSQKKGN

SEQ ID NO: 663 - protein, 263 aa, Triticum aestivum
MDAGAGAGAGAPYASRTAEEVFRDFRGRRAGMIKALTQEVDKFYQLCDPEKENLCLYGYPNETWEVTLPAEEVPPEIPEPALGINFARDGMNEKDWLALVAVHSDSWLLAVSFYFAARFGFDKEARRRLFNMINNLPTIFEVVTGAAKKQIKEKAPNSTHKSNNKPSMKTYSKPESQSKAPKIAAPPKDEDESGEDYGEEEEEERDNTLCGTCGTNDGKDEFWICCDNCERWYHGKCVKITPARAEHIKHYKCPDCSNKRARA

SEQ ID NO: 664 - protein, 335 aa, Zea mays
MDNHIHSQPAANLYYQFGMGTEQQYPPPFASPPSTNIPHMDWNPATMLDNLTFIEEKIQQVKDVIRTMVDNAGQVQVQCHHQAGELLAQKQKQQVVNADLTCLIVQLISTAGSLLPSLKNSSFLSHPHPAGHVDMANHVGPSSSLVPNAMTVSEDYEELFKGWTDGGIEVDDDGVLVEEQEITKDGDSLSYELLQLEEDEILAPHTHFCTICGKGFKRDANLRMHMRGHGDEYKSPAALAKPPRDPGAEQEPAKRRYSCPFAGCKRNKLHKSFQPLKTILCVKNHYRRSHCEKSHTCGRCHAKKFSIVADLRTHEKHCGRSRVSLEGPKLTRTQL

SEQ ID NO: 665 - protein, 301 aa, Oryza sativa Japonica Group
MGMEAECDRIKGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRKLATATDGGEIDRPCKRVSPGPGSPTGSERSELSHGGCGSGSGGGQVFRPVPRPGGFDAISAADVVRPPRRRDDNDDDGDDDPLTSLSLSLSLPGFHHDSARSQFQELPSPSRSPSPPPSPPAASPSAYPFNADLVSAMQEMIRTEVRNYMAGVGLRAGCGPGAVAESFMPQLVDGVMGAAAERVGVVTRQ

SEQ ID NO: 666 - protein, 328 aa, Arabidopsis thaliana
MSSSRNTHWCHRCQRAVRLHGQEPVCFYCGGGFVEELDMAQASPFDMFRSHRGVVERDQTFDLMDAFSVFMRNRLAERSHDREIRGRTISSGPENFPGLAPLLIFGGQVPYRLTGDNAVEALFNGGSPGIGITRGNTGDYFFGPGLEELFEQLSAGTTRRGPPPAPRSAIDALPTIKIAQRHLRSSDSNCPVCKDEFELGSEAKQMPCNHIYHSDCIVPWLVQHNSCPVCRQELPSASGPSSSQNRTTPTRNYRSSSSSSSSNSRENGNERRNPFSSFWPFRSSGSSSSSTQNRGGTRNSDTSDENHNYHQQQHQQSYMGYSGWPFDY

SEQ ID NO: 667 - protein, 392 aa, Oryza sativa Japonica Group
MERHLFLHGGNTQGDSGLVLSTDAKPRLKWTPELHQRFVDAVNQLGGAEKATPKTVMRLMGIPGLTLYHLKSHLQKYRLSKNLQGQANVGTTKNALGCTGVADRIPGTSALAMASASAIPQAEKTIQIGEALQMQIEVQRQLNEQLEVQRHLQLRIEAQGKYLQAVLEQAQETLGKQNLGPASLEDAKIKISELVSQVSNECLSNAVTEIRESSSIHRLEPRQIQFVESSANNCLTAAEGFKEHRLQNHGVLKAYDDSTLFCRKQSQDQESQYSLNRSLSERRMGHLYSGKQYHKSEGSDSDTEVLHEYITPQKNGGGSTTSSTSGSKEINVEKLYLDEPSCKRQTVDYQRESKLLDFDQQSSGKNLDLNTHNIDDNDQGYRHFDLNGFSWS

SEQ ID NO: 668 - protein, 268 aa, Glyptostrobus lineatus
VEHRPFSAAEDAAIIEAHLRHGNKWATIARLLPGRTDNAIKNHWNSTLRRRSLQQQSQNLSRKRSGIFSEGDYEVESRGLKRLNLVQSPADSGNPSDFNLNVSLPGSASPGSSLHRQSAFKSYESLKTPEDASSPWSSASGSPSALCSSDPPTLLSLSLPGSTSSSENNSGECHEQNVCSSPVKLQVNQQPFVPVNGGYLKAEDAISMMSAAVKMAVAQALPLMFQSSAGEGTSSDFGSGALSVMREMVAKEVRSYMNGLSAFAPVLK

SEQ ID NO: 669 - protein, 264 aa, Festuca arundinacea
MSRKKKVRRRSTGPDSVAEIIKKWKEQNQKLQEENGSRKAPAKGSKKGCMAGKGGPENSNCKYRGVRQRTWGKWVAEIREPNRGNRLWLGSFPTAVEAAHAYDEAARAMYGATARVNFSERSPDANSGCTSAPPVLMSNGPTAVSYPSDEKDESESPPSLMSDAPTATLHRSDAKDEPESAGTLVHEVKTEVSNDSRSIREERKTVEVFQPEGKALHKEEKVSYDYFNVEEVLDMIIVELSADRKMEVHEEYQDGDDGFSLFSY

SEQ ID NO: 670 - protein, 382 aa, Acetabularia acetabulum
MNDMDFAALFNQHEGNNPDNLQPNAPPYMLSPQQNAAATMPKSHCSGDNTLMLSDMGEQVIMHPLYPDLVKAIMDCRKVGGMDESRHHIQIRTEQVLEDLHRKREQYQITGRMPALDPELDQFLRQYIQVLDELHAELLNINREADNILHMFTTQIAEVINMPMDPRSMHARNAFNAQSNIDMTWFEIRNEQEQRVLLKQKYRQELLALKEEFSKRKKRGKLPTHSIEVLKSWWKEHIAWPYPTDSAKRSLASQTNLTSIQINNWFINQRKRHWHKLFPEGVPNSQEEALRSLKARGMLGMDSSGPMRLMSMDIESQETQEVEQETEDIQTPNEFQFQSAFLNEHEQMMDEAGFTSRPNVQLPDAISQFQSQLGQIRKDSDE

SEQ ID NO: 671 - protein, 165 aa, Vitis vinifera
MAAIEALNDKSGSSKSFISKHIESAHGDLPAAHSTLLMHHLNRRKQNGDPVMVRNHCMKPDPNAPPRKGRGRPPEPEFPLPPGTVLAPPRPRCHPLKPRDPFALVSPPKKASSGSGKPRGRPPEKPKVGTSSAPAPATGASRPRGWPPKAKPAVVPVGWRFKQRC

SEQ ID NO: 672 - protein, 433 aa, Medicago truncatula
MELDPGCAEKIPCLHWNFPKDLCVKPEIPKVIPSQPCSTLSPPPSHYTTYLYQNHRNQFKEHALNRSNNQSSFPTMIPSSRHPISGISMASYNDAHNNGSQREFLSTQNPMIFTPNNNKIEAMHGCLNTREGIWDLSKKNIFRYGETSQPRVSPDLSPSLVYDAHPSVSIKPKLQGDIFFYGGFGNEPQENNGPVLTSQRLQKRIQNNIEIQHKDLNIIKGQWTTDEDRILIQLVDRFGLRNWSKIAKYMNGRIGKQCRERWNNHLCLDIKKEAWTEEEDKILVEAHKIVGNKWAEISRRLSGRTENSVKNHWNATKRCLKAKKKNRGNSSKGTLLLKYIMEVTCAKKVEKEMMTNSLSMMNIGNQPNYESSESDFFSEGLTTPEDEIGGYVPMMFNDDDGMASGFGSNGMEFFPEIPKKQEIDLMEKIYRNP

SEQ ID NO: 673 - protein, 62 aa, Taraxacum officinale
KERKPSLNISIPFPPPLVAPVKVEELEERKHYRGVRQRPWGKFAAEIRDPNKKGTRVWLGTF

SEQ ID NO: 674 - protein, 156 aa, Zea mays
MSPAEMESHKMVEVEAAADPEERTASGDPKACDDCNTTKTPLWRGGPNGPKSLCNACGIRYRKRRRVAMGLDPEAKRKPKRDDAILSKAEASSTKEEEEEDNKASTNKIKTKTTTHTVELHMVGFAKDAVPKQRRRMRMRRRKPSCLGEEERAAIL

SEQ ID NO: 675 - protein, 381 aa, Medicago truncatula
MGRHSCCYKQKLRKGLWSPEEDEKLLNYITKHGHGCWSSVPKLAGLQRCGKSCRLRWINYLRPDLKRGAFSEQEENSIIELHALLGNRWSQIAAQLPGRTDNEIKNLWNSSLKKKLKQKGIDPNTHQPFSENNDNDTPNIQIQKTSVGSNEVKNLFDDTPNPNSIPMDNCNYPLEINSKINNSVNCFIPCDNMVGLGGGSYLNFQQLNYGINNMTLSPPNSNSNTSLCFIPSTSGSTSTCSQMMSELNSSTMFHSMYTNHPSNSISSGEVDGIQNWEFGASKSSNGSSINNYLDHQVVEDIKWSDYINSTPFFLGNNNTFQQTTTSTHSSIYEVKQEMGGFINTNESIQSSSSTWHPHFEADIYSNKDLQRFSLAFGQTLN

SEQ ID NO: 676 - protein, 388 aa, Zea mays
MQTAIEHACSVVECAATARAAMDMSHYIPDWSSSMGDTFAPLGGEDDDGLIELMWRNGHVVMQAQAPRKPPRPDDDEAAAAQAQAWFQYPVEERADLFSELFGEAQAAVGGARGEAARQSIRMMPPPPPPPRPAQAPREEKACPGDGGTATATDGAGSSVLTVVSSLCGSNGNHVQATAPGDVARARDVLMVTSSSTTRSRSCTTKSEQPGPGPGAARRSGKRKHNDATDAEDVGLECEPAQRTTTAKRRRAAQVHNLSERRRRDRINEKMKALQELIPHCNKADKASMLDEAIEYLKSLQLQLQVVWMGGGIAAAGVHQRTMVAAPGRPPHVASLPASAPDLYTRYLAVDHLPPPPLVPPPRTVELSKPLNIDEFYLYIIYAGILGC

SEQ ID NO: 677 - protein, 138 aa, Oryza glaberrima
SDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPAAAVYTARPDH

SEQ ID NO: 678 - protein, 275 aa, Glycine max
  misc_feature (42)..(42): Xaa can be any naturally occurring amino acid
  misc_feature (66)..(66): Xaa can be any naturally occurring amino acid
QLVSATHRTIRRRCLDFEMANVQRKNSDENSNTGSSTSESDXRNVANEKQWLPAKRMGNLQRGILXGIGLHLNALAALKEYNGTQVEKLSSGRQLSLPSSTSLQITTSQEHQHLSLVPVSSEREWDPSDIGVHPAEDCSQPSAYMAGEDFNQNSPRMKRRKSETPGDTEGCKRCNCKKSKCLKLYGGCLAAGVYCIEPCSCQDGFNKPIHEDTVLQTRKQIESRNPLAFAPKVIRNSDSVPEIGDDPNKTPASARHKRGCNCKKSSCLKKYCECY

SEQ ID NO: 679 - protein, 299 aa, Cucumis melo
MALEAVVFSQDPLCYNGSKDLYSLLGGGIWANGSFEYPEIPHDFPENQTENFPFEDWNSSSSVFVPNPSPEAADSRNGLLKPPLEAESITPHPIRPRKRRPKSRKNKEEIENQRMTHIAVERNRRKQMNEYLSVLRSLMPESYVQRGDQASIIGGAINFVKELEQQVQVLSTIETKGKINNSAEGCCNSNSNSNSKIPFAEFFSFPQFKAMEGCSLVSENETQCSSTVADIEVTMVENHANLKIRSKRRPKQILKIVAGLHSLSLSVLHLNISTINQIVLYCLSVKVCFSSFFEMGICV

SEQ ID NO: 680 - protein, 222 aa, Glycine max
MRKGRGGGASAAAVDVNGSILKEPRYRGVRKRPWGRFAAEIRDPLKKARVWLGTFNSAEDAARAYDAAARTLRGPKAKTNFPPLSPFCYPHPTTDPFFYTGFHDQHHHHNNNNLNNPQRPTSSGMSSTVESFSGPRPPTTTTTTTTTTATPFLTATRRYPRTPPLVPEDCHSDCDSSSSVVDDGDDNIVSSSFRPPLPFDLNALPFDDAAADDDLRRTALCL

SEQ ID NO: 681 - protein, 220 aa, Ceratopteris richardii
MGRGKIEMKRIENRTTRQVTFCKRRAGLVKKARELSVLCDADVALIVFSSSGRLFEYAGSRSMREIIQAYVDAHEDSSSLLQLRSEEACVSQDLRAELTELRKEVESLRQEKRRKDGDIHDLKLLSADELDSLEGEVETSLCSIRKRQKQLYREKMNETFRKEEELRKENEKLRKQVEELQCARWEICCAQGFEASATSMCTSHGMTSERSDSFLDLRLN

SEQ ID NO: 682 - protein, 479 aa, Oryza sativa Japonica Group
MSSQSVVAVKQITAPDKIVETCPSTKHSAHKLFDVKPDFQGLIDDNLSSSSQSSSIKIELIRSSSLPNILPFQKRSSEPEPESPLSHVSHPNVSEPVYSNSSTFCTSLFSSSSMETEPCRQLGTLPFLPHPPKCEQQVSAGHSSSSSLLVPGGDGDIGNAHDEPEQSDDLKDFLNLSGGDASDGSFHGENNAMAFAEQMEFQFLSEQLGIAITDNEESPRLDDIYGTPPQLSSLPVSSCSNQSVQKAGSPVKVQLSSPRSSSGSATTNKARLRWTLELHERFVEAVNKLDGPEKATPKGVLKLMKVEGLTIYHVKSHLQKYRLAKYLPETKEDKKASSEDKKSQSGSSGNDSVKKKNLQVAEALRMQMEVQKQLHEQLEVQRQLQLRIEEHARYLQRILEEQHKVSISSNSLSLKPPAESQPESPKPTSEKKEAESEAGAATSAQPSSEDKSPDAECKSSPPVGSKRARVHVGDEHQCS

SEQ ID NO: 683 - protein, 145 aa, Brassica napus
MDNSCIDDSTSNTSGSLSTSTPSAKKKLSPPPPPATMRLYRMGSGGSSVVLDSENGVETESRKLPSSKFKGVVPQPNGRWGAQIYEKHQRVWLGTFNEEEEAAASYDIAARRFRGRDAVTNFKSPALDGTDAESAFLEAHSKAEI

SEQ ID NO: 684 - protein, 268 aa, Gossypium raimondii
GAWTKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNMPTSVSKSSSIKNPSLDFNYNEFQFKSNTDSLEEPNCTASSGMTTDEEQQEQLHKQQQYDPSNGQDLNLELSIGIVSADSSRVSSANSAESKPKVDNNNFQFLEQAMVAKAVCLCWQLGFGTSEICRNCQNSNS

SEQ ID NO: 685 - protein, 376 aa, Zea mays
MGSSGADTPSKEQQPPATSGAAIPPVYPDWSSFQAYPPIPPHGFFPSPVASSPQGHPFMWGAQAMIPPYGTPPPYVMYPPGVYAHPSMPPGAHPFTPYAITSPNGNADATGTTAAAGNTDGKPSEGKDKSPTKRSKGSLGSLNMLTGKNPSEHGKSSGASGNGVTSQSGESGSDSSSEGSEGNSHNDSHHKESGQEHDGDVRSSRNGVSRLQSEGKLNQAMAILPIPSSGPATDPTTNLNIGMDYWANTASSAPAIHGKATSTTVPGAVVPAEQWTQDEHELKKQRRKQSNRESARRSRLRKQAECEELAQRADVLKQENASLRDEVNRIRKEYEELLSRNNSLKEKLEGKQHKTDEAGLNNKLQHSGDDSQKKGN

SEQ ID NO: 686 - protein, 265 aa, Gossypium herbaceum
TKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNSPTSVSKSSSIKNPSLDFNYNEFQFKSNTDSLEEPNCTASSGMTTDEEQQEQLHKKQQYGPSNGQDINLELSIGIVSADSSRVSSANSAESKPKVDNNNFQFLEQAMVAKAVCLCWQLGFGTSEICRNCQNSNS

SEQ ID NO: 687 - protein, 176 aa, Arabidopsis thaliana
MIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 688 - protein, 303 aa, Elaeis guineensis
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRLDDWVLCRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 689 - protein, 268 aa, Taxodium distichum
VEHRPFSAAEDAAIIEAHLRHGNKWATIARLLPGRTDNAIKNHWNSTLRRRSLQQQSQNLSRKRSGIFSEGDYEVESRGLKRLNLVQSPADSGNPSDFNLNVSLPGSVSPGSSLHRQSAFKSYESLKTPEDASSPWSSASGSPSALCSSDPPTLLSLSLPGSTSSSENNGGECQEQNVCSSPVKLQVNQQPSVTVNGGYLKAEDAISMMSAAVKLAVAQALPLMFQSSAGEGTSSDFGSGALSVMREMVAKEVRSYMNGLSAFAPVFK

SEQ ID NO: 690 - protein, 263 aa, Gossypioides kirkii
AWTKEEDQRLIDYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNTPTSVSKSSSIKNPNFNYNEFQFKSNTDSLEEPNCTASSGMTTDEEQQEQLHKKQQHDPCNGQDLNLELSIGIVSADSSRVSSANSAESKPKLDNNNFQFLEQAMVAKAVCLCWQLGFRTSEICRNCQNS

SEQ ID NO: 691 - protein, 180 aa, Glycine max
MPHIVETTEPQEPFGGQLLERAGSSKDLRNLCPSADAVLEDQVPEAYKMNPQCSDLPQMQHMDNLNNTLTPFAVRKEVKSVTIKATYKEDIIRFKVSMDCGIVELKEEIAKRLKLEAGTFDIKYLDDDHEWVLIACDADLQECMDISRSSGSNVIRLVVHDILPILGSSCESSGDWKGCI

SEQ ID NO: 692 - protein, 335 aa, Elaeis guineensis
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRVCHRQSEIHKFFGFLGFFMNIDSDEKIHEFMQLDDWVLCRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 693 - protein, 268 aa, Metasequoia glyptostroboides
VEHRPFSAAEDAAIIEAHLRHGNKWATIARLFPGRTDNAIKNHWNSTLRRRSLQQQSHNLGRKRSGIFCEGEYEVESRGLKRLNLIQSPAGSDDSSDFNFNVSFPGSNSAGSSLHRQSAFKSYDSQRTPEDASSPWSSSSGSPSVPCSSDPPTLLSLSLPGSASPSENNGGERQEQNCSPSPVILQANQQPSVPVSGDYLKAEDAISMMSAAVKMAVTQALPLMFQNSAGVGTSSDFGGGALSVMREMIAKEVRSYMNGLNAFAPVLK

SEQ ID NO: 694 - protein, 362 aa, Zea mays
MGSNDPNTPSKASKASEQDQPPATTTSSGTASVYPEWPSFQAYSAIPPHAFFPPTVAANPQAHPYMWGAQPIVPPYGTPPPPPYVMYPPGTVYAHPSTPPAMHPFGHYPMPTNGHVETHGAAPSAPEMNGKSEPGRTSAPSANGITSHSESGSESESEGSDDNSQNDSHSKDNDGKEDGNSQNGMSYSGSQGVVNQTMAMLPMQPGAMVGGVPSSTAANLNIGVDYWAAPGSAAVPAAHGKAPAGSARGDQWDERELKKQKRKQSNRESARRSRLRKQAECEELGQRAEALRSENSSLRAELERIRKEYEQLLSQNASLKEKLGAASSDSLPDMNEQNDQNDGDGGYRKQPDSDGHQPGSES

SEQ ID NO: 695 - protein, 298 aa, Lathyrus aphaca
SEEPTTVAVEQPIVEEPEAVDTVPPVVNEAEEPTAKPKKAPKAPKEPKAKKAPAKPRTHPTYEEMVKEAIVALKEKSGSSQYAIAKFIEEKHKQLPSNFKKLLLVQLKKLVASGKLVKVKASYKLPAKSTAAKPAKKPAGSKPKAKPKAKAATKSKAKPAAKAKPAAKAKPAAKAKPAAKAKPAAKAKPAAKAKPAAKPAKAVAAKPAAKAKPAAKPKAAAKAKPAAKAKPAAKAKPAAKPAKAARTSTRTSPAAKAPAPKVAVKKAAPVKKTPVKAAAKAKTAKSPAKKAAAKRGKK

SEQ ID NO: 696 - protein, 268 aa, Sequoia sempervirens
VEHRPFSPAEDAAIIEAHLRHGNKWATIARLLPGRTDNAIKNHWNSTLRRRSLQQQSHNLGRKRSGVFSEEDYEVESRGLKRPNLIQSPSGSDNSSDFNLNVSFPGSTSAGSSLHRQSAFKSYESQKTPEDASSPWSPSSGSPSVLCSSDPPTLLSLSLPGSTSSSENNGGECQEQNCSPSPVILQANQQPPVPVSGDYLKAEDAMSMMSAAVKMAVTQALPLMFQSSTGVGTSSDFGGGALSVMREMIAKEVRSYMNGLNAFAPVLK

SEQ ID NO: 697 - protein, 295 aa, Pisum sativum subsp. abyssinicum
SEEPTTVAVEQPIVEEPEAVDTLPPVVNESEEPTAKPKKAPKEPKAKKAPAKPRTHPTYEEMVKEAIVALKERNGSSQYAIAKFIEEKHKQLPSNFKKLLLVQIKKLVASGKLVKVKASYKLPAKSSAAKPAKKPAAAKSKAKPKAKAATKSKAKPAAKAKPAAKAKPAAKAKPAAKAKPAAKAKPAAKAKPAAKPVKTAAAKPAAKAKPAAKPKAAAKAKPAAKAKPAAKAKPAAKPAKAARTSTRTSPAAAAAAPKPAAKKAAPVKKTPVKAAAKAKTAKSPAKKAAAKRGKK

SEQ ID NO: 698 - protein, 285 aa, Chamaecyparis pisifera
VEHRPFSAAEDSTIIEAHLRHGNKWATIARLLPGRTDNAIKNHWNSTLRRRSLQQQSQNLSRKRSGIFSEGDYEVESGGLKRLNLTQSPAGSENPCDFNLNLAQSPAGCENLSDFNLNVSLPGSNSAGSSLHRQSAFKSYESQKTPEDSSSPWSSSSGSPSALCSSDPPTLLSLSLPGSTSSSENNGGECQEQNCSSSPVRLQAIQQPSVPVNGGYLKAEDAVSMMSAAVKMAVAQALPLMFQSSAGEGASSDFGSGALSIMREMVAKEVRSYMNGLSAFAPVLK

SEQ ID NO: 699 - protein, 285 aa, Thujopsis dolabrata
VEHRPFSAAEDSTIIEAHLRHGNKWATIARLLPGRTDNAIKNHWNSTLRRRSLQQQSQNLSRKRSGIFSEGDYEVESRGLKRLNLAQSPAGSENPGDFNLNLAQSPVSCENLSDFNLNVSLPGSTSAGSSLHRQSAFKIYESQKTPDDASSPWSSSSGSPSALCSSDPPTLLSLSLPGSASPSENNGGEFQEQNCSSSPVRLQAIQQPSVPVNGGYLKAEDVISMMSAAVKMAVAQALPLMFQSSAGEGTSSDLSSGALSIMREMVAKEVRSYMNGLSAFAPVLK

SEQ ID NO: 700 - protein, 369 aa, Zea mays
MVVASSGGAGGVEGGSGCGVSASVPPVVSSSGGAGEVEGGDGGSAAVSGSRRRVKGSWTPEEDELLRRAITRHGPRNWTVISSEIPGRSGKSCRLRWCNQLSPSVERRAFTPEEDAIIVAAHAQHGNRWATIARMLHGRTDNSVKNHWNSTLLRQRRAAAAHASAAGCALQLRPATTASVPLRHLLDRPKEAAASVSFRRLDPKAEEEEDEDMDEGGSSSEDSAHRHRSLSPAPVEPLTLNLFSDGAHGLPTPAPAPAPQGTAARTEGAAMRRKAKLEQDPWLSGGVHGAPAPAPQSAAARTEGAVVTRMKTKLEHDPWLVTLVRQMISVEVERQMHGVGPQARSSAGGGGGADGDGVNGQDTSMDVDP

SEQ ID NO: 701 - protein, 223 aa, Arabidopsis lyrata
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSLPSLFITAATTSCHHQQENVYENIAKRFDGVVSASYEDKPKQELAQNDVLMATTNDPSHYYGNNALWVHDDDFELSSLFTRNDEFCFW

SEQ ID NO: 702 - protein, 355 aa, Oryza sativa Japonica Group
MDQSFGNLGGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGAHGGGAGSARLLLADGKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFPPQNAAALYMDGPFMADGMYRLGS

SEQ ID NO: 703 - protein, 383 aa, Oryza sativa Indica Group
MTRDGAPPASGGGGAAEGPRRCSQCGHHGHNARTCTARGPVKLFGVRIGDKPPTAAAGGGGGMRKSASMGSLAQLAEGGGGGGGREEGYGSDGNDDKRRKRGEAWSEEEHKKFLLGLSKLGKGDWRGISRNYVGSRTPTQVASHAQKYFIRQTNVHRRKRRSSLFDMVIDDSDDQPLSRTSSQEVEVEENLEDGHPVTAPVIPPAPVPMLSSSLVPPPVPAMAPVAPGPVLTSASATLPVSAVAPQTDEKEQVASGSNTTETGAAIPEVMPPYGYPMMLPPYYPPAFVPMPYYGYVPVFYAPPGAVQAQHEVVKPVAVHSKPPVHIDELYSMSELSLKGEAGVKNGTPNSPLPPRPIGRPDRQSAFHGKGPSDGSSNGLIPAK

SEQ ID NO: 704 - protein, 213 aa, Brassica napus
  misc_feature (196)..(196): Xaa can be any naturally occurring amino acid
MWDLNDSPHQTVRQEESEEFCYSSPGKRVGSFSTSSSSAVVIEDGSDDDEPNRVRPNNPLITHQFFPEMESSVGDNGGGGTGPGFPRSHWFGVQFSQSDLATGSSVGKPATVGAVVEPTQPLKKSRRGPRSRSSQYRGVTFYRRTGRWESHIWDCGKQVYLGGFDTAHAAARAYDRAAIKFRGVEADINFNIEDYXYDMKQMTNLTKEEFVHV

SEQ ID NO: 705 - protein, 228 aa, Zea mays
MARERREIKRIESAAARQVTFSKRRRGLFKKAEELSVLCDADVALIVFSSTGKLSQFASSSMNEIIDKYSTHSKNLGKAEQPSLDLNLEHSKYANLNEQLVEASLRLRQMRGEELEGLSVEELQQLEKNLESGLHRVLQTKDQQFLEQISDLEKKSTQLAEENRQLRNQVSHIPPVGKQSVADTENVIAEDGQSSESVMTALHSGSSQDNDDGSDVSLKLGLPCVAWK

SEQ ID NO: 706 - protein, 66 aa, Triticum timopheevii subsp. armeniacum
EEDLKQMRNWTKEEFVHILRRQSTGFARGSSKYRGVTLHKCGRWEARMGQLLGKKYIYLGLFDSEV

SEQ ID NO: 707 - protein, 276 aa, Triticum aestivum
  misc_feature (236)..(236): Xaa can be any naturally occurring amino acid
  misc_feature (251)..(251): Xaa can be any naturally occurring amino acid
  misc_feature (268)..(268): Xaa can be any naturally occurring amino acid
LYRTSLYKKAGWYRSGIPGISSTHASAPPKASKPPEQEQPPATTSGTTAPVYPEWPGFQGYPAMPPHGFFPPPVAAGQAHPYMWGAQGVHPFHYPMQTNGNLEPAGAAPGAAETNGKNEPGKTSGPSANGVTSNSESGSDSESEGSDANSQNDSHSKENDVNENGSAQNGVSHSSSHGTFNKPMPLVPVQSGAVIGGVAGPATNLNIGMDYWGATGSSPVPAMRGKAPSGSARGEXWDERELKKQKKKLSXRGSARKSRLRKQAECEXLGQRPEAL

SEQ ID NO: 708 - protein, 318 aa, Arabidopsis thaliana
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKFAIDNLSKTAKNECVISRVFHTRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 709 - protein, 146 aa, Cucumis sativus
MKGGKSKGAPKKTDTKLKSKSAGASKKSAKAAKDPNKPKRPASAFFVFMEEFRKQYKKEHPNNKSVAAVGKAGGDKWKSMSDAEKAPYINKAEKRKTEYNKSMQAYNKRIAEGGNGAEEEESDKSKSEVNDDDEDDDESGEDEDDE

SEQ ID NO: 710 - protein, 138 aa, Oryza glaberrima
SDDKALKRHLLRKYTGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPAAAVYTARPDH

SEQ ID NO: 711 - protein, 363 aa, Lupinus nanus
MFPSTYISSGPYPYFSSSSSPYHPFAFFNPENSSSNNTFSHDLLSFPYNIQPTHHYHAPTQETLSNFADYAASAAMFKTDVSGNSNFGFSNFLAKKPASKKDRHSKIHTSQGLRDRRVRLSIEIARKFFDLQDMLGFDKASNTLEWLFNKSKKAMKELARSKISSSGVVANSFSSSDSEFEVVSMINPDSIDATPEGVVVDSKDRKLKRAKIKESREKARARARERTNKKMLSSMKKKYPAIENPQMFNILRLPFHHPENLAKSPNNKSILSHHHNPHLVCSETPRDDFNLFEESIVIKRKLKQSHAIPKESNFNNNTEHHSFPILSPNLDANNGANGRSNFCAVTNMNLSTGLQIFGKSWEE

SEQ ID NO: 712 - protein, 202 aa, Brassica napus
PTNLSERSAVSPTLDTETPHPDDVANPGNIVDNNHLELIPYHQEITVDEEEPSTDPKALVPLPALEAEALAIVPLNQKPKRTELAQRRTRRPFSVTEVEALVQAVEELGTGRWRDVKLRAFEDADHRTYVDLKDKWKTLVHTRTRGPQQRRGEPVPQELLDRVLRAYGYWSQHQGKHQGRGAAAHKDLDMNIGRALESGVSV

SEQ ID NO: 713 - protein, 684 aa, Zea mays
MVFQKRSSSELEASGGGQVAEMPRVPKSARGKRSVRKKEAQNPPQMSAFDLLATVAGKLLDEGVGSLGNMSAGAPALTACAKDVRVKKEQCDEEMKQFKHEVTDQDSCNESAILPHIVFQRAVNNARNEDPKAKSEAQDKESSMISCTKAELGCNFGVIADRWSPESVESGAFTGDAVASLMPPAPAGFHKNAPEMYNLLDSMDVDVKPPPLVSSDSTGEMPLYGDKVHRSTSLPRVSKGVGFFAVDRDDDDDKSSGCTHPSTTTNKDFRSNCTAEYSRVRKLLTSKYRKVAPARVYKSDLSYSDVDRKPSFRNKKMHYTRQRTQRSTFKRRKLFDRHSVLASEFGTAHGKGNTKKVTGRDSHAVSLEANKGTSSTPFQKSRGSNDCHVKLKIKSFKVPELLVEIPESATVGSLKKTVLEAVTAILGGGLRVGVLHHGKKVRDDNKTLIQAGIGQEDMLDNLGFSLEPNCTQNPQVQAPEDISFLETIDTAEPLARIAPADSSSKHGEVDLSQEFALTPLAMNYQGSDHDSVHSPGGVSSPDKVSTNSRALVPVPAADPNAGAIVPANKSKRSPEQGQRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPPLLAEARLLT

SEQ ID NO: 714 - protein, 303 aa, Elaeis guineensis
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRLDDWVLYRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 715 - protein, 157 aa, Gossypium raimondii
NKGSWTAEEDRRLAKYIEIHGAKRWKTIAIKSGLNRCGKSCRLRWLNYLRPNIKRGNISDEEEDLIIRLHKLLGNRWSLIAGRLPGRTDNEIKNYWNSHLSKKMINHDVRTEQTSSLEQIVPYKAWETVQMEEEEVVKGSDEIENSEFSIDVDEFFD

SEQ ID NO: 716 - protein, 285 aa, Thuja standishii
VEHRPFSAAEDSTIIEAHLRHGNKWATIARLLPGRTDNAIKNHWNSTLRRRSLQQQSQNLSRKRSGIFSEGDYEVESRGLKRLNLAQSPAGSENPSDFNLNLAQSPASCENLSDFNLNVSLPGSTSAGSSLHRQSAFKIYESQKTPDDASSPWSSSSGSPSALCSSDPPTLLSLSLPGSASPSENNGGEFQEQNCSSSPVRLQAIQQPSVPVNGGYLKAEDAISMMSAAVKMAVAQALPLMFQSSAGEGTSSDFSSGALSIMREMVAKEVRSYMNGLSAFAPVLK

SEQ ID NO: 717 - protein, 157 aa, Gossypioides kirkii
NKGSWTAEEDRRLAKYIEIHGAKRWKTIAIRSGLNRCGKSCRLRWLNYLRPNIKRGNISDEEEDLIIRLHKLLGNRWSLIAGRLPGRTDNEIKNYWNSRLSKKIINHDVRTEQTSSSEQFVPHKAWETFQMEEEEVVKGSGEIENSELSIDVEDFFD

SEQ ID NO: 718 - protein, 320 aa, Arabidopsis thaliana
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 719 - protein, 286 aa, Juniperus rigida
VEHRPFSAAEDSTIIEAHVRHGNKWATIARLLRGRTDNAIKNHWNSTLRRRSLQQQSQNLSRKRSGIFSEEDYEVESRGLKRLNLVQSAGSENPGDFNLTLAQSPVSCENLSDFNLNVSLPGSNSPGSSLHRQSAFKSYESQKTPEDSSSPSPWSSSSGSPSGLCSSDPPTLLSLSLPGSASSSENNGGEFQEQNCSSSPVRSQAIQQPSVPLNGGYLKAEDAISMMSAAVKMAVAQALPMMFQSAAGEGTSSDFGTGALSIMREMVAKEVRSYMNGLSAFAPVLK

SEQ ID NO: 720 - protein, 181 aa, Gossypioides kirkii
NKGAWTAEEDRKLAEVIAVHGAKRWKTIPTIAGLNRCGKSCRLRWMNYLRPNIKRGNISDQEEDLILRLHKLLGNRWSLIAGRLPGRTDNEIKNYWNSHLSKKVNQKEKHSGASAGQVCKFAQKRLVENAKEQVREENTSTGVEESNISFDVNDFFDFSNVDTRNFEWVNRFLEVDEGFKF

SEQ ID NO: 721 - protein, 324 aa, Oryza sativa Japonica Group
MDRHEEEAGESPCVPPGFRFHPTEEELVGYYLARKVASQKIDLDIIQELDLYRIEPWDLQERCKYGGHGGDEQTEWYFFSYKDRKYPSGTRTNRATAAGFWKATGRDKPVLSSPSTRVIGMRKTLVFYKGRAPNGRKTDWIIHEYRLQSNEHAPTQEEGWVVCRAFQKPMPNQQQHRLSYGCIPGSYGAGAYAAVPDNYSLLLHHDNPSFAGRPLMSAAASALFANNNNNSVVDHSNILSSESKLHFSDMMPPLESPTIVDGEGYVSQASSCVDVDQQAGIVDWNLLTSLLPPPAHQLFHHLPSASSSKNSNNISSSGFIDDRD

SEQ ID NO: 722 - protein, 947 aa, Vitis vinifera
  misc_feature (42)..(42): Xaa can be any naturally occurring amino acid
  misc_feature (50)..(50): Xaa can be any naturally occurring amino acid
  misc_feature (174)..(175): Xaa can be any naturally occurring amino acid
MEDGSFTPNSVFGGPSDSAMDLNFMDELLFEGCWLETTDGFXFLQPGASXSSALNDSSHHSLTFENPNTPQKSYGDDGQRSSLPENPPPFYPQAEGLVGTQSDNWKTFEAATASGQSESFLVERTELNRRLWIGPSANPGPVSSVKNRLILAIRNLREFTKERDVLIQIWVPIXXGGKNVLTTNDQPFSLDPDCQSLANYRNVSENYHFPAEEDSKEQVGLPGRVFLGKVPEWTPDVRFFKSEEYPRINYAQRYNVRGSLALPVFERGSGVCLGVIEIVTTTQKINYRPELENVCKALEAVDLRSSEVLIPPVKACNELYQAALPEILKVLARVCRTHRLPLAQTWAPCIQQGKGGCRHSDKNYALFLSTVDHAYYVTDPKFKGFNEACFDHHLFRGQGVVGRALTTNQPCFESDITAFSKTEYPLSHHARMFGLRAAVAIRLKSIYNGSADFILEFFLPTDCQETEEQKQVLNSLSIVIQQTCQIFRVVTEKDLEKESILPVGEILVASDERVKQEGSVKLLSPPIKEPSREESSWIAHMMEAQKKGKGVSVSLEYQKEEPEEEFKVTTNWDNTEVELHHGQVFSEFGQPQQNSGAKGSVEGGGDSSFGGQHSSGSRKAREKRRTKTEKTISLQVLSQYFAGSLKDAAKSIGVCPTTLKRICRQHGITRWPSRKIKKVGHSLRKLQLVIDSVQGTQGAIQIGSFYTNFPELSSPNVPGTVPFSSSRMTDDSKQLNPQSEVLFSPGVTTSKSPSSSCSQSSSSSFCCSTGAKQQSTTVNASVSGDVLMAEDPVLLKRTRSDAELHVSNPDEPKLLVRSQSHKSFGEHPCVEPLPPLPKSNSRALRDGGGFRIKATFGEENVRFSLQLNWSFKDLQQEIARRFGIDNMNSIDLKYLDDDCEWVLLTCDADLEECIDVYRSCQSRKIKLSLHHSSRLKLKSSAFSSGPS

SEQ ID NO: 723 - protein, 222 aa, Oryza sativa Japonica Group
KLLVECKEELSRPLQEAEEFLRTVESELNSINSGPPLTALISESKAGLDSSDDDEHEDGSGMEMMEAAEDEDLGIIDPRSDDKALKRHLLRKYSGYLGGLRKELSKKRKKGKLPKEARQKLLTWWELHYRWPNPSEMEKIALAESTGLEQKQINNCFINQRKRHWKPTEEMEFAVMEAYHHQSTDAAAAFYVDVDARLVGATAAAPASAVYTARPDHGVWRA

SEQ ID NO: 724 - protein, 285 aa, Chamaecyparis obtusa
VEHRPFSAAEDSTIIEAHLRHGNKWATIARLLPGRTDNAIKNHWNSTLRRRSLQQQSQNLSRKRSGIFSEGDYEVESGGLKRLNLAQSPAGSENPCDFNLNLAQSPAGCENLSDFNLNVSLPGSNSAGSSFHRQSAFKSYESQKTPEDASSPWSSSSGSPSALCSSDPPTLLSLSLPGSTSSSENNGGECQEQNCSSSPVRLQAIQQPSVPVNGGYLKAEDAVSMMSAAVKMAVAQALPLMFQSSAGEGTSSDFGSGALSIMREMVAKEVRSYMNGLSAFAPVLK

SEQ ID NO: 725 - protein, 138 aa, Oryza sativa Japonica Group
EDQCSGETDMLDIGQEQSSRLADHELKEMLLKKYSGCLSRLRSEFLKKRKKGKLPKDARSALLEWWNTHYRWPYPTEEDKLRLAARTGLDPKQINNWFINQRKRHWKPSDGMRFALMEGVAGGSSGTTLYFDTGTIGP

SEQ ID NO: 726 - protein, 267 aa, Chamaecyparis pisifera
VEHRPFSAAEDAAIIEAHLRHGNKWATIARLLPGRTDNAIKNHWNSTLRRRSLQQQSQNLSRKRSGIFSEGDYEVETRGLKRLNLVQSPADSGNPSDFNLNVSLPGSASPGSSLHRQSAFKSYESLKTPEDASSPWSSASGSPSALCSSDPPTLLSLSLPGSTSSSENNGGECQEQNVCSSPVKLQVNQQPSVPVSGGYLKAEDAISMMSAAVKMAVAQALPLMFQSSAGEGSSSDFGSGALSVMREMVAKEVRSYMNGLSAFAPVL

SEQ ID NO: 727 - protein, 263 aa, Triticum aestivum
  misc_feature (36)..(36): Xaa can be any naturally occurring amino acid
MLGLMAAPCQSPQGENELYDDCDPTVYGARALLPRXTTSAPPAGPPELSTTSSSTGSGRTATEARALKVHSEAERRRRVRINAHLTALRRMIPDTKQMDKAALLARVVDQVRHLKRRASEAAQAQQMPAVPPEADEVSVEFCCTGDTDDDNRRLYMKASVSCDDRPDLVAGFIQALHGLRLRTVRAEVTSLGGRVRHVFTLCKEEEEEGSAAAGRAGLNSLKEAVRHALSKVASPELVCGGSPFQFQSKRQRILESHYSIMSI

SEQ ID NO: 728 - protein, 305 aa, Vitis vinifera
MDDNDNPDPGNDFSGDSSWTLGAESDSVYFFGSDKESSILSEFGWNLQPEEAHHRSLEPERFGDVERIESSDLAGRLPLAESSGLECSAAAAQIGSAEKAGDASTSNPSVSSSSSEDPPEKSTGSGGGKPPEIPSKGRKKGQKRIRQPRFAFMTKSEVDHLEDGYRWRKYGQKAVKNSPFPRSYYRCTNSKCTVKKRVERSSEDPSIVITTYEGQHCHHTVGFPRGGVISQEVTFDGRMTPPLTSHFYYPDMSFHREVSHSGSMAQSHQVPAQAREARALAEPSPQLPTDEGLLGDMVPPGMRNG

SEQ ID NO: 729 - protein, 61 aa, Physcomitrella patens subsp. patens
KKRKFRGVRQRPWGKWAAEIRDPKKAARVWLGTYDTAEEAAQAYDNAAKEFRGLRAKLNFP

SEQ ID NO: 730 - protein, 317 aa, Arabidopsis thaliana
MFPSFITHIQSPNSHHHYSSPSFPFSSDFLESFDESFLINQFLLQQQDVAANVVESPWKFCKKLELKKKNEKCVDGSTSQEVQWRRTVKKRDRHSKICTAQGPRDRRMRLSLQIARKFFDLQDMLGFDKASKTIEWLFSKSKTSIKQLKERVAASEGGGKDEHLQVDEKEKDETLKLRVSKRRTKTMESSFKTKESRERARKRARERTMAKMKMRLFETSETISDPHQETREIKITNGVQLLEKENKEQEWSNTNDVHMVEYQMDSVSIIEKFLGLTSDSSSSSIFGDSEECYTSLSSVRGTISAAGNSNVLTKNPN

SEQ ID NO: 731 - protein, 102 aa, Physcomitrella patens subsp. patens
KGPWSPEEDAALQQLVEKYGARNWSLISKGIPGRSGKSCRLRWCNQLSPQVQHRPFTTAEDETIIAAHSQHGNKWATIARLLPGRTDNAIKNHWNSTLRRRH

SEQ ID NO: 732 - protein, 278 aa, Musa acuminata
MRCPTAPPSSNKLSAGLQHQQQQQPPPSAHDFTKTIVLASTPFGMVPDGWTGVADGAQIQYPVLGAANVGQENASANSFENSTEKRKAPKSKQESRSSGAEEEGTARGGATSKNKKKASGSDAPKETDYIHVRARRGQATDSHSLAERVRRERISERMKYLQELVPGCSKIMGKASTLDEIINYVQSLQRQVEFLSMKLAAAEPRMHLSSSNFFDREEVHGCSTWDAGLHGFHDGEIHRVSHLCPGNQCKVNNNTSIAVCNQAETAPFALWEVSYPTI

SEQ ID NO: 733 - protein, 271 aa, Triticum aestivum
  misc_feature (107)..(107): Xaa can be any naturally occurring amino acid
  misc_feature (192)..(192): Xaa can be any naturally occurring amino acid
MAPKNALPVAVAAAVNGGMDPRFRGVRKRPWGRYAADIRDPVRKGRVWLGTFDTVEAAGRAYDAVVLHYRGPKAKTNFPVGTVAAYTHIPIPTTKALAVSPSSSTVXSSSRDTPAAAPAAPAVAAPAAPPALDLSLAMPAMVAAQSFLFLDPRVAVTVAVAAPEPEPAPCRSACISGMNKVASHEGEQTDPXSSSSVLDASPAVGLGFDLNLPAAAGDGIGDGPIFVRPMTTRPGSKASSPRGRIYGLEDWGGLLKGLSVRLTARDGPPNG

SEQ ID NO: 734 - protein, 103 aa, Neurospora crassa
MPKAAAKSKTTGKVEKRRAKKDPNAPKRGLSAYMFFANEQRENVREENPGVSFGQVGKILGERWKALSDKQRAPYEAKAAADKKRYEDEKQAYNAEADEEESS

SEQ ID NO: 735 - protein, 144 aa, Glycine max
MCKGAEGEKQHGFCSSFLHKESATRSAICCELCGLQASLYCQADDAYLCKKCDKRVHEANFLALRHIRCFLCNTCQNLTRRYLIGASLEVVLRGTVFSRGTLIPLCLNGKRSFALSEKGFNCKFSKRERFSIPRSSSSSNSSGS

SEQ ID NO: 736 - protein, 61 aa, Physcomitrella patens subsp. patens
HFRGVRQRPRGKFAAEIRDPAKQGARLWLGTFDTAEEAAIAYDRAAVRMRGSRALLNFPLR

SEQ ID NO: 737 - protein, 317 aa, Glycine max
MSTSKSVSSSSEDDNELRRGPWTLEEDNLLSQYISSHGEGRWNLLAKRSGLKRTGKSCRLRWLNYLKPDVKRGNLTPQEQLIILELHSKWGNRWSKIAQNLPGRTDNEIKNYWRTRIQKQARHLKIDTDSREFQELVRRFWMPRLLQKAKESSSSAMSIQNQATPMPFDGVSQHSTVGTIPSHSHTPWQGPCMNEAGPTYMDQHEQNSDSEHNNGSCISLSESANFPKVPQHFGRTTITQYHALNNNDFGTFTYDGYNVSNNVYEMDNFKTPTTRVAEDAQYPTGDCQMVGSNWVNSDFACNMWNMDELWQFSKLQK

SEQ ID NO: 738 - protein, 243 aa, Arachis hypogaea
MGRGRVELKRIENKINRQVTFAKRRNGLLKKAYELSVLCDAEVALIIFSNRGKLYEFCSSSSMLKTLERCQKCNYGAPETNVSTREALELSSQQEYLKPKARYEALQRSQRNLMGEDLGPLSSKELESLERQLDSSLKLIRSTRTQFMLDQLSELQRKEHLLSEANRALRQRQLEGYQINPMQLNPGGVDDMGYARHPPQPQPDPLFQQLDCEPTLQIGYQPDPVSVVTAGPSMGNYMGGWLP

SEQ ID NO: 739 - protein, 258 aa, Zea mays
MKVQCDVCTAEAASVFCCADEAALCDACDRRVHRANKLAGKHRRFSLLHPCSSSSSSAAHKPPLCDICQERRGFLFCKEDRAILCRECDAPVHSASDMTRRHSRFLLTGVRLSSAPVDSAGPSEEEEQENSRGPCNDESCSSGSGAGGATTATASDGSSISEYLTKTLPGWHVEDFLIDDASAGDVGACSDGLYQGQNGQISGVLQEAYLPWTEREQVQTDVADERASWERWVPQMHAEFGGGGKRPRASPSPPCSYW

SEQ ID NO: 740 - protein, 238 aa, Triticum aestivum
  misc_feature (125)..(125): Xaa can be any naturally occurring amino acid
MVTVQDEMRKGPWTEQEDLQLVCTVRLFGDHRWDFVAKVSGLNRTGKSCRLRWVNYLHPGLKHGRMSPQEEHLIIELHARWGNRWSRIARRLPGRTDNEIKNYWRTHMRKKAQERKIDMSPSSSXSSFTYQSCLLETAPIIRMDGGSTHNGTTCFSSVLKSNQSVMDGYSMDEIWKEIEAPAMLPIDDKACSNLPCPLLPSPMGDRYCPPEVVWKMDNGDLKMLAPQFGYGNGERSCY

SEQ ID NO: 741 - protein, 179 aa, Dendrobium grex Madame Thong-In
LTLTKCCMQRGSHFRSRSGSQEARSGSSMSRCNSMDTKFCYYNNYNVNQPRHFCKNCQRYWTAGGSMRNVPVGAGRRKNKHTGSVYRHTVITPDSLASLQVDGPDLVDHKPLSPFKVNGTILKFGPDAPLCESMASILNLGEQNLSSQLDFTAGAENREETSCSSACKPVKKKDITQHN

SEQ ID NO: 742 - protein, 323 aa, Solanum tuberosum
MKETAISVLALLTLFLLEVVSANELSLPFHLPINETIGLEVFQGINNASPPSPSPLPYPQCGMKKGGGKCIKTGECCSIWGWCGTTNAYCSPGYCQKQCPGPYPEGRCGWQANGKSCPTGTGQCCSNGGWCGTTSDYCASKNCQSQCKLPSPPPPPPPPSPPPPSPPSPPPPSPPPPPPPSPPPPSPPPPSPSPPPPPASPPPPPPALPYPQCGIKKGGGKCIKTGECCSIWGWCGTTNAYCSPGYCQKQCPGPYPEGRCGWQANGKSCPTGTGHCCSNAGWCGTTSDYCAPVNCQAQCNTTTLTSPIKNRMRGIESFMLNVV

SEQ ID NO: 743 - protein, 120 aa, Vitis vinifera
MNNKNPDAVSSAESQVNEPKKTCADCGTTKTPLWRGGPAGPKSLCNACGIRSRKKRRAFLGSSNHSHNNGGGNGNNKLGDSLKRRLFALGREVLLQRSTLGEEEQAAVLLMALSYGYVYA

SEQ ID NO: 744 - protein, 244 aa, Arabidopsis thaliana
MSQETAIASFKKFQQSWIEQLRNHLNHLRSAQNHHRNSATGDEERLREAVDRVMEHFREYHRAKWAATDKDVIEVMASPWASALERSLQWVGGWRPTTLFHLVYTESSILFESRIVDILRGFRTGDLSDLSPSQFRVPFVKGRTVSELQCETVKEENAITEELSEWQDDASDLVMGTSSDPDQRIRRLAEIVHRTDDLRLRTITRVVEVLSPLQQAEFLVAAAELRTGVAGWGTSHDRRRSSEV

SEQ ID NO: 745 - protein, 364 aa, Vitis vinifera
MDGSCIDESTTSDSISTSLPALSALPATKSPESLCRVGSGTSVILDSESSIEAESRKLPSSRFKGVVPQPNGRWGAQIYEKHQRVWLGTFNEEEEAAKAYDIAAQRFRGRDAVTNFKPLSETEEDDIEAAFLNSHSKAEIVDMLRKHTYNDELEQSKRNYGLDANGKRSRAEGLMTPFGSDRVTKSREQLFEKTVTPSDVGKLNRLVIPKQHAEKHFPLQTGTTSKGVLLNFEDMGGKVWRFRYSYWNSSQSYVLTKGWSRFVKEKNLKAGDIVSFQRSTGGDKQLYIDWKARNGPTNQINPVEPVEMVRLFGVNIFKVPVNSSVVVANNGSWTGKRMIEMELLSFECSKKQRMYVKGKYDKKI

SEQ ID NO: 746 - protein, 323 aa, Oryza sativa Indica Group
MAFHYQDHALAMDAAAAAAETGGHHHPGFVGAGGVVGGGGGGGWEREKAAIAAHPLYERLLEAHVACLRVATPVDQLPRIDAQIAARPPPLAAATAAAAAAAAGGAPSGGEELDLFMTHYVLLLCSFKEQLQQHVRVHAMEAVMACWELEQTLQSLTVVTLTAGASPGEGSGATMSDDEDNQVDSESNMFDGNDGSDGMGFGPLMLTEGERSLVERVRQELKHELKQGYREKLVDIREEILRKRRAGKLPGDTASTLKAWWQAHSKWPYPTEEDKARLVQETGLQLKQINNWFINQRKRNWHSNPASSSSDKSKRKRYRVVDF

SEQ ID NO: 747 - protein, 805 aa, Candida albicans SC5314
MSHLVSSSLGTTTTATPTSRSPHTNHSTPYNQNSITSNRSSPVPKNSVNSRIIPQTMNPPIDMKSNNILNPEKDTDTSRGDHSESKASSISSASGTTTTNNNNVSNNNSTGKTQIVFIHKLYDMLHDESISHLIWWSPSLDSFYVTPGEEFSRVLSQYFKHTNIASFIRQLNMYGFHKVNEPFLNQDDQQQQQQLQSNRWEFRHSTNQFRKGDTESLKNIKRRSSKTLNAQKEVVNIKSLPPTSHPMEYNTGYSYQNEDSAHYFVHHHSITTMQSPADMRPRSPSTPIPMQPLAQQQQQQQQQQQQQQQQLPSQPVPNGPPVFSGPIPPGAVNQSPQEYLTRPSILNNVQGSFENATNFKFVELTNQINLLRNDFFTMNNRYEILQNELKYQTADSMAVLEILEKLSNDNRIATDIRDLKNVVSQRMQRLNNQFIPQQSNFAPHIPGQQQQQQHGNSVSSNYHLESTNVSRNPSTTNLNVAPQPYPLNPHYTIYANNRASGSSEINNGVFRAREDSNNSKRNLSVYDPLQPVPSRNSSRILIEESTPTHPPTNFNPQQSQSQSQVQLGPAMPPQGFRNRAESTYSPLSHSSNKSQILNKAPTPVNHSPLVQQQQKEAKQELNDSSVAPPSQSSLPVTRPLSRQQQQQQQTLHHPSTTSSRTNSLPNPVAEHPAPQSSYFMQRNSFNTIYEHQKSLRVPSPKRVRYATPPRSIPEQPISSTAPTTMITSTSKTTSTSGAAISRSENHSVVSLTGGALPSVSELDKSIRTGSSVSLPPIKSIKDNDNKNDNGNSDDNGNDHKKRKLE

SEQ ID NO: 748 - protein, 526 aa, Arabidopsis thaliana
MGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALMFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 749 - protein, 223 aa, Physcomitrella patens subsp. patens
MSAGSHQSNGSAAVHGGGQLPIAESPTGPEPRKRGAGRAGSKEPSPRKSIDTFGQRTSVYRGVTRHRWTGRYEAHLWDNSCRKEGQTRKGRQVYLGGYDKEEKAARAYDLAALKYWGPNTTINFPLSTYEAELEEMKNMSRQEYVASLRRKSSGFSRGASMYRGVTRHHQHGRWQARIGRVAGNKDLYLGTYSTQEEAAEAYDLAAIKFRGINAVTNFDISRY

SEQ ID NO: 750 - protein, 98 aa, Physcomitrella patens subsp. patens
MKYNKWCLLRWNDRLRRRKKNVKTLRKPIYAIETRTDVDIMDDGFKWRKYGQKAVKNSPYPRNYYRCTTPQCPVRKRVERSCEDSGLVITTYEGTHTH

SEQ ID NO: 751 - protein, 126 aa, Triticum aestivum
MGRSPCCEKAHTNKGAWTKEEDQRLIAHIKAHGEGCWRSLPKAAGLLRCGKSCRLRWINYLRPDLKRGNFTDEEDELIIKLHEFLGNKWSLIAGRLPGRTDNEIKNYWNTHVKRKLLARGVDPQTH

SEQ ID NO: 752 - protein, 514 aa, Petroselinum crispum
MSSSLGDLLAQPNNDDFGSNWGFENQKTKSFANQSLPFSPPPVSPSSYFSFLDSPIQNNNYTIVSSSGNGTMNAQSFKEENQNFSDFSFPAQTRPASSTSSSFIPANTNLVEDSLKRKQGGWNFEEPAKKNDFLMDNASVTSDIATLQRISPEMTMNHANMQSNAALQSNLNNYAQSSQSSQTNRDQSKLDDGYNWRKYGQKQVKGSENPRSYYKCTYLNCPTKKKVETTFDGHITEIVYKGNHNHPKPQSTKRSSSQSYQNSIGTMPESSLLENGRSEPVTTPENSSLSFGEDDLFEQGSMNKPGDDDENEPDSKRWKGEYESNEPMSSLGSRTVREPRIVVQTTSDIDILDDGYRWRKYGQKVVKGNPNPRSYYKCTQVGCPVRKHVERASHDLRAVITTYEGKHNHDVPAPRGSGSYPAVNRPSDNTTSAPTAIRPTTNYLNPLQNPRAQPANGQAPFTLEMLQRPRSYEFSGFTNTSNTYAINQNQQASGQFSTAKDEPDVDSFFDSFLA

SEQ ID NO: 753 - protein, 54 aa, Triticum timopheevii subsp. armeniacum
EEDLKQMRNWTKEEFVHILRRQSTGFARGSSKYRGVTLHKCGRWEARMGQLLGK

SEQ ID NO: 754 - protein, 328 aa, Oryza sativa Japonica Group
MDGRFPLPPASGGGRGHHRRAHSETFLRLPDADLLLDPEGDFSFSDLDFPSLSDDSPAISDPTPPPPPPMAATPAPAPRPPGGAHMRSLSLDTAFFEGFSLQGGGGGGGGGGSGGSGGHKRSGSMDGVNSPFEGESALSGGLPDYAKKAMPAERIAELALIDPKRAKRILANRQSAARSKERKIKYTSELERKVQTLQTEATTLSAQLTLLQRDTSGLTAENRELKLRLQSMEEQAKLRDALNEALREEVQRLKIAAGQAPNMNGNPFNGGLQQQIPPYYTQQQQQQQQMPYLGGHHAQQRHPSHQQSSSNGGQSLSGQSLNDSMDFM

SEQ ID NO: 755 - protein, 136 aa, Oryza meridionalis
SDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSADAAAAFYVDARLVGATAAAPAAAVYTTRPDH

SEQ ID NO: 756 - protein, 357 aa, Populus trichocarpa
MIKSARGCALDDDVDDEEEFLLKKETPSPIRKGELRVKVDGKSNDQKPDTPRSKHSATEQRRRSKINDRFQMLRELIPRGDQKKDKASFLLEVIEYIQFLQEKVQKYDGSYQGWNHETAKLVPWKNNSRPVESSVDQSRGLNSDAGPALLFAAKLDERNITVSPSINPGGARNPVESDMTSANAMDRHPGCTNKSIPFPISLQPNFNPGRTAGAAAQFPPRLASDAENMASQTQPQSCHARSWSTVEAVASDKLKEKDLTVEGGTISISNAYSQGLVNTLTQALQSSGVDLSRASISVQIELGKTGNSRQTASTSITKDNNVLPSNKGTTRSRVSSGEESGQALKKLKTSKASARVA

SEQ ID NO: 757 - protein, 415 aa, Zea mays
MDFSCFQPHTGICSYLPFDSYMQHDGQYELHLHPADHHPLEVTGDYTSATFDDLGHEFFAEREIEKPIFNRTSSIGRRVGSQLPLPTIKTEVSHLIDSGLVSCKAYEINDRFLARKKTSLKKANVVKGQWTPEEDRKLVKLVEQFGLRKWSYIAQLLPARVGKQCRERWHNHLRPNIKKDIWSDEEDMVLIEAHKEVGNKWAEIAKRLPGRTENSIKNHWNATKRRQFARRRSRTSSKAPKPGTLLQSYIEGLGIVGPSDKSAAPLSEPTLSPEAPGAKSAKTGGTTLPEEHSPPSNMLDSQGVLLPSEELLAPICDELLDGMCGGLFDCTNEDAFFRVCAVDDDIDVSYIFDHAIKVDPEIDMEMMMMWDDDALACTAGPAAGTAHVETVHVKEEMDLMEMVAATQNCGEAENH

SEQ ID NO: 758 - protein, 248 aa, Triticum aestivum
MCTATPQSASARCCLVNMIVGGGYFEGSHDHNLMPGSLIKPDFANERQRREWMNVAFWALRILLPDPKDDRVSNVEDAIEYIHELNRTVKELKILVEQKRHGTNRKKMIKMDEEAASDGENSSTMPVRDEQDNELDWAIRSSWVQRRSQECRVDVHIVENAVNVQLTEWKNANSLPHAAKVLDEFHLEIISVVGQIVGDHRIFIFNTKVSEGCSVYALAVAERLFQAVDAQHQALNILGQALATKLTI

SEQ ID NO: 759 - protein, 336 aa, Arabidopsis thaliana
MVMMIIIYTEPEISLFPLQDRSEELSSNVENGSCNSNEGINPETSSHWIENVVKVRKPYTVTKQREKWSEEEHDRFLEAIKLYGRGWRQIQEHIGTKTAVQIRSHAQKFFSKMAQEADSRSEGSVKAIVIPPPRPKRKPAHPYPRKSPVPYTQSPPPNLSAMEKGTKSPTSVLSSFGSEDQNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRARIC

SEQ ID NO: 760 - protein, 430 aa, Arabidopsis thaliana
MCSVSELLDMENFQGDLTDVVRGIGGHVLSPETPPSNIWPLPLSHPTPSPSDLNINPFGDPFVSMDDPLLQELNSITNSGYFSTVGDNNNNIHNNNGFLVPKVFEEDHIKSQCSIFPRIRISHSNIIHDSSPCNSPAMSAHVVAAAAAASPRGIINVDTNSPRNCLLVDGTTFSSQIQISSPRNLGLKRRKSQAKKVVCIPAPAAMNSRSSGEVVPSDLWAWRKYGQKPIKGSPFPRGYYRCSSSKGCSARKQVERSRTDPNMLVITYTSEHNHPWPIQRKALAGSTRSSTSSSSNPNPSKPSTANVNSSSIGSQNTIYLPSSTTPPPTLSSSAIKDERGDDMELENVDDDDDNQIAPYRPELHDHQHQPDDFFADLEELEGDSLSMLLSHGCGGDGKDKTTASDGISNFFGWSGDNNYNNYDDQDSRSL

SEQ ID NO: 761 - protein, 509 aa, Solanum tuberosum
MSIVTCEKAAASLSSSSNMNNDTNGAFCYTPQHQLVTPQYQNPPQQIKKKRNQPGNPDPEAEVIALSPKTLVAANRFFCEICNKGFQRDQNLQLHRRGHNLPWKLKKRENKEVVRKKVYICPESSCVHHDPSRALGDLTGIKKHFSRKHGEKKWKCEKCSKRYAVQSDCKAHFKTCGTREYKCECGTIFSRRDSFITHRAFCETLAMESARSVINGRNPTIFSPQLNLQFQQPHFFNSHEQIQATTFPMKKEQQSSDFRHIEIPPWLITTNSQPFQLGAINHGPSPRSNFSSSSIFPATTRLDQQYTQSGHKDLNLHHPNPNLRGPTLGYDSTGESGAVSPVHISATRLLQKAAQFGATISNKASAVTATAAYTGTVKIPHNTHVSVTSTDSATKQTHQKLSSREDLTSITGPANISGIMTSFSNGFDGSTMFEDAILFGGFNNLNSKKEDEEEDQQLYFNGSMNEEDHILTKDFLGLKPLSHTDDIFNIAALVNTEPHHFKNHKTWQS

SEQ ID NO: 762 - protein, 233 aa, Oryza sativa Japonica Group
MARGPYRPARRRKKTSHRLRHHQQSRSSRTRRSSPRSSSAAAEQEQLRRRRRRRRHYRGVRQRPWGKWAAEIRDPKKAARVWLGTFDTAEDAAIAYDEAALRFKGTKAKLNFPERVQGRTDLGFLVTRGIPPAATHGGGYYPSSSPAAGACPPPRQQQTVVPYPDLMRYSTSRRSSSSGPAAVTNAIVGLRLGDRGGVVHDVGVVARCMAVRRLGAQEEGFVVVTSLDGSIDA

SEQ ID NO: 763 - protein, 305 aa, Citrus sinensis
MMKGAELELPPGFRFHPTDEELVNHYLCRKCAGLPISVPIIAEIDLYKYDPWELPEMARYGEKEWYFFSPRDRKYPNGSRPNRAAGSGYWKATGADKPIGKPKTLGIKKALVFYAGKAPKGIKTNWIMHEYRPANVHRSPATKNNLRLDDWVLCRLYDKKGRMEKHYPSDQKSIGFPELEEDRKPNINISRQEVALGMPPHQGSPAPMMNDLLHMDTSDSVPRLQTDSSCSEHVLSPEITCDKEVQSMPKWNDLGNALNDDYNQFNFNYMDTNSFQDDPFGPQVQYQMDQLSPYQDLFMILQKPF

SEQ ID NO: 764 - protein, 249 aa, Sasa fortunei
MFPFCDSPSPMDTLLYQQLQLSPPSPKPDQSLFYYPCSPSFAADAFHLGYLGAAAATTPSAAIDSPELLMMHPWMEQPPAPKVDAGNNVQGVGVVLERAARKDRHSKICTAGGMRDRRMRLSLDVARKFFALQDMLGFDKASKTVQWLLNMSKSAIREIMTDEASSECEEDGSSSLSVVDGKHKPPKEVGGRERKGDHSEGKKPARARKAATTPKPSRKLGNAHPVPDKESRAKARERARERTKEKNRM

SEQ ID NO: 765 - protein, 555 aa, Arabidopsis thaliana
MKSFCDNDDNNHSNTTNLLGFSLSSNMMKMGGRGGREAIYSSSTCSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 766 - protein, 349 aa, Arabidopsis thaliana
MYYHNQHQGKSILSSSRMPISSERHPFLRGNGTGDSGLILSTDAKPRLKWTPDLHERFVEAVNQLGGGDKATPKTIMKVMGIPGLTLYHLKSHLQKYRLSKNLNGQANSSLNKTSVMTMVEENPPEVDESHSESLSIGPQPSMNLPISDALQMQIEVQRRLHEQLEVSIIYCTLQSILEKAQETLGRQNLGAAGIEATKAQLSELVSKVSADYPDSSFLEPKELQNLHHQQMQKTYPPNSSLDSCLTSSEGTQKAPKMLDNRLGLRTYIGDSTSEQKEIMEEPFFHRMELTWAEEESLRENHNRPYLSTMVNNAEPRISSSRRSPFYDNHTGNEKPLISFVSLRDSSKN

SEQ ID NO: 767 - protein, 418 aa, Oryza sativa Japonica Group
MAGVGFVEDMLREQSLLEATCGDLFDHIDDLLDFPKEESAADVLLLDAPAPGSPLSSRIIGGHATMAAAPPPPPQMMALPPPPAPAKDDASALFDAAGALGAEVFDRKDAHIGPCDELDMDMAQLEWLSGLFDDGTIPHEPSFPGVNCAAPIKASALTANAGVVLPDKAEEALFRSSSPISVLEHSGFNVATNGGSSSSSSSSASSSSESFSGSGRAWSAPVSPRPEPPVLVIPARARSKRSRPSAFPAVRGAPAATETTILVPTPMYSSTSSHSDPESIAESNPHPPPMKKKKKAKKPAAPAAASDAEADADAADADYEEGGALALPPGTVRRCTHCQIEKTPQWRAGPLGPKTLCNACGVRYKSGRLFPEYRPAASPTFMPSIHSNSHKKVVEMRQKATRTADPSCDLLQYIRRRD

SEQ ID NO: 768 - protein, 186 aa, Populus tremula x Populus alba
DPELDQFMGAYYDMLVKYREELTRPIQEAMDFMRRIETQLNMICHGPLRIFNSDDKSEGVGSSEDDQDNSGGETELPEIDPRAEDRELKNHLLRKYSGYLGSLKQELSKKKKKGKLPKEARQKLLSWWELHYKWPYPSETEKVALAETTGLDQKQINNWFINQRKRHWKPSEDMQFMVMDGLHPQN

SEQ ID NO: 769 - protein, 222 aa, Oryza sativa
  misc_feature (169)..(169): Xaa can be any naturally occurring amino acid
  misc_feature (172)..(172): Xaa can be any naturally occurring amino acid
MASSGEEGRVVVDLRSAAESAGGGGDEEAHAAPLHEIESLCMRCGDNGTTRLLMTMIPHFREVVLMAFECPHCGERNNEVQFAGQLQPKGCCYRLEVPRGQNEILNRQVVKSDSATIKIPELDFEIPPEAQRGSLSTVEGIIMRAVDELQALQDDRKKVDSQKGEGIDXFLXQWRILGIGEAVFTLVWRIRRKWLLENGSAFMDPGTGESLKVVGQAPCFVY

SEQ ID NO: 770 - protein, 306 aa, Glycine max
  misc_feature (249)..(249): Xaa can be any naturally occurring amino acid
MEMSFFYPVKLRIKSFRVPELFIEIPETATVGSLKRTVMEAVTAVLGGGLRVGVILHGKKVRDDSKTLLQTGISHDNHLDALGFALEPNCSRNRPSACATTDSLHIPSADMPQPLIGYPSSPAVIHQRIQGFSNMLAKHQATSSGNLVESDHDSAPSPINTSGEKYLSDSKELITVPEMGMEALAVLPVHQKSKRTEIAQRRIRRPFSVTEVEALVQAVEKLGTGRWRDVKLRAFDNAKHRTYVDLKCXDKWKTLVHTARISAQQRRGEPVPQELLDRVLTAHAYWSQQQTKQQLKHHSTKPCLLL

SEQ ID NO: 771 - protein, 521 aa, Glycine max
MDSNGSLRANTWARSSSLTSPASGLSSDPLSFPGFGLQHNQQKWDVPSNSDFGIRAEAPFKEFNQPSQTQSPLPCNSNNEIEIPGQENCHLSESSQTNTLQDWDPSVMLNNLSFLEEKIHQLQDLVHLIARQKGIGQPNELVTQEQQLVTTDLTSIIIQLISTAGSLLPSARHNLVNTSSLVGQIDQLRGTTIPPGTGASNGCIQPQNNGGKILSDQSMQTDLPNSGEMEQKYNMVEHDLKDEEDVEDGENLAPGSYEILQLEKEEILAPHTHFCTICGKGFKRDANLRMHMRGHGDEYKTPAALAKPHKESASPKPIKRYSCPYPGCKRNKDHKKFQPLKTILCVKNHYKRTHCDKSYTCSRCNTKKFSVMADLKTHEKHCGKDKWLCSCGTTFSRKDKLFGHIALFQGHAPAIPLDDTKGAGVAEAPIHDSKENNSKVQSMNFTFGSNPSNANEVPNAMDVKGDSDDPINYFSSLNFEANFGEFNEFTRPLFDDPEGSFSFVMPGSFKSGGESSSDNLL

SEQ ID NO: 772 - protein, 204 aa, Zea mays
MAKIGLKPDPVNNNAKEIRYRGVRKRPWGRYAAEIRDPGKKTRVWLGTFDTAEEAARAYDAAARDFRGAKAKTNFPNFLELSEKMPAAGGGFERSPSQSSTLDCDSPPAAVTPASAGIVPPQLELRLGGYQIPMARPIYFLDVMGVGNGGRAQPPVASAFRSPVACVAQSDSDSSSVVDFEGVMEKRSQLFDLDLNLSPPSEQA

SEQ ID NO: 773 - protein, 646 aa, Oryza sativa Indica Group
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMAAALPAAARTEQQQQHGHGGHQHHDLLPSDAFSVLQDIVSTVDAAGAPPRAPHMSMAATSLGNSREQSPDRGVGGGVLATLFAKPAAASKLYSPVPLNTWASPSPAVSSVPARAGVSIAHLPMFAAWTDA

SEQ ID NO: 774 - protein, 230 aa, Vitis vinifera
  misc_feature (223)..(223): Xaa can be any naturally occurring amino acid
MDGRFNSNPFVSEQEEQENSPENSGDSPPSPMFNDAKISSSTSSPKRSRRAMQKRVVSVPIKDVEGSRVKGDCAPPSDSWAWRKYGQKPIKGSPYPRGYYRCSSSKGCPARKQVERSRVDPTMLVVTQAEPDPDEKFTDLGEESLITTEDFTWFSDFESPSSTMLESPIFAENNVRDADVAMFFPMREEDESLFADLGELPECSLVFRRGVLEMEEERRRCTXPMCGTTS

SEQ ID NO: 775 - protein, 294 aa, Brassica napus
MYSAIRSLPLDGGEYHGPLDGTNLPGDACLVLTTDPKPRLRWTAELHERFVEAVTELGGPEKATPKTLMRTMGVKGLTLYHLKSHLQKFRQGRQACKDSTDNSNKDASCVGESQDTGSSSPSSLKLAAQEQNESYQVTEALRAQMEVQRRLHEQLEVQRRLQVRIEAQGKYLQTILEKACKAFDEQAAMFTGLETAREELSELAIKVSNNSQGTTVPYFDATKMMMMMPSLSELEVAAIDHKSNITTTNCSVESSLTSNTNGSSVSAASMKKRHRGGNNVGYEGSWTVPSSTIG

SEQ ID NO: 776 - protein, 593 aa, Oryza sativa Indica Group
MPGGASRQDNEYVHGESTTRRHDDSFMVAVIACSSLPSVTAPMRTLDDDVGMWTVEDAASATSSGIRHGWWRMRPPAMSPAWGVAEEDAATGDELRRGTWMAEDVAAPATISGVDRGGCRCRRQALARDVDGGITGDDLWRGSWRMPPPATSSGTRRGRWDHRRRSPAWIVEDAAAGDKLRHKTWTGLFAITTIYRLFFTSPVLSAMESFASLAGGGSSSTTARLPELISPENPDHISPPPLLYQLLAGPESSARQHGHDGHHHGGGGGEAAAAAVQGQVSPAGAEAAVKAEIMSHPQYSALLAAYLGCKKVGAPPDVLTKLTAVPAAQQLDEADGHPRRLHEPQRDDDPDQLDQFMDAYCSMLTRYREELERPIQEAAEFFSRVETQLDSLAESNCEGTGSSEEEQDQDTSCPEAEEIDPSDKQLKHQLLRKYGGSLGDLRQEFSKRTKKGKLPKEARQKLLHWWELHYKWPYPSVRTHHIPFDQFNHIFCTKLTRLKMREIYGVVYEQEMEKMTLAQTTGLDQKQINNWFINQRKRHWKPTPVAGTAFPTMEAAGGGFRHSGHGGGLAAAAALPLYMGRPFVVDGMYRLGS

SEQ ID NO: 777 - protein, 315 aa, Zea mays
MQGGGGDQAGGSLGMGMGVGYAGGGGAECSSSSVAAAAAAAAAAAEAEERQLLKGEIAVHPLCEQLVAAHVGCLRVATPIDHLPLIDAQLAQSSGLLHSYAAHHSPFLSPHDKHDLDSFLAQYLMLLCSFREQLQQHVRVHAVEAVMACREIEQSLQDLTGVTLEEGTGATMSEEDEDEAPMLEVGLVDMGSDGHDMMGFGPLLPTDSERSLMERVRQELKIELKQGFKSRIEDVREEILRKRRAGKLPGDTTSILKQWWQQHSKWPYPTEDDKARLVEETGLQLKQINNWFINQRKRNWHNNSQTSTLKSKRKR

SEQ ID NO: 778 - protein, 395 aa, Oryza sativa Indica Group
MESFASLAGGGSSSTTARLPELIPPENPDRISPPPLLYQLLAGSASSARHGHGHHHGGGGGAAAAAVQGLQVSPAGAEAAMKAEIMSHPQCSALLAAYLGCKKVGAPPDVLTKLTAVPAAQQQLDAADGHPRRRHEPRRDDDVPDHQLDQFMDAYCSMLTRYREELERPILEAAEFFSMVETQLDSIAESNCEGTGSSEEEQDTSCPEAEEIDPSDKQLKHQLLMKYGGSLGDLRQEFSKRTKKGKLPKEARLKLLHWWELHYDKWPYPSVRTHIYASHLINSTTFFCTKLDLMKMRELLGCTCVYEQEMEKMTLAQTTGLDQKQISNWFINQRKRHWKPTPVAGMTFPTVEAAGGGFRHSGHDGGLAAAAAAAALPLYMGSWPFVVDGMYRLGS

SEQ ID NO: 779 - protein, 192 aa, Triticum aestivum
  misc_feature (5)..(5): Xaa can be any naturally occurring amino acid
  misc_feature (10)..(10): Xaa can be any naturally occurring amino acid
  misc_feature (14)..(14): Xaa can be any naturally occurring amino acid
  misc_feature (18)..(18): Xaa can be any naturally occurring amino acid
SAFLXGGTSXEALXEQLXLQTGNRQGPAPASQSAIDSMPVVKITRRHLSDDPVCPVCTDRFEVGSEAREMPCKHLYHASCIIPWLVQHNSCPVCRHPLPPQRGSDSNAARPQPLAHAGEAVSRGVAGAGADPAPVTRNGDDDGGSPFSFLWPFGSSSPGPSSYQYGGGGGGRPAVYDDDPGQITYSEWHYDP

SEQ ID NO: 780 - protein, 892 aa, Coccidioides immitis RS
MADMVDIDTKSSIELGSVDANIPSEAQLDGDQSTAEMQTNRQKVKPETPSDADQSKFVPDASYIRSTDPLSLEYWEKVLAKCVPETRLNAPAPGRRDTFALGNVIIKSDHQSAEPTGDYSFWDENEEAAVNLVAGVLPDVKLPEYYLRTKLRGRDILVRSRIPGVSLEVAWPSLNTDQKASFKEETRDIVRRIHRIKPNELRASYVVDSSSPDESTRLRQDERNILFGDSTAEDGNYGLSHNDLLPSNIIVENGKIVGIVGWSNAGYFGYEKSGNVHRRIRCKDDNGNMIQELWEESSPWHDLYDIARDEEKTFSDTAEVESKNDRPSVKSEELLPNLSAVPYTATSENFDFRTPKKIIDLKQESVSRASSSERSSPATSVKSTKKRAAPAATKKGQAVRKSAAKKRKLNDAESIDGTVGSQRSSATPASRSKPSKQRNRKQTSASIASSPAPDGKRRGKSNDSDEDMEEDEADASELFCICRKPDNHTWMIACDGGCEDWFHGKCVNIKQIDADLIDKYICPNCEEKQGIRTTWKRMCRLPGCRQPARVTAKTPSKYCSDDHGVEFMKRKLRIAESRSTSSHIPSAASRGSLCQTNSRQRHQENGYVESGSLNSNGDQVTNEIVRDADDAGAEREGTEDLMNIGGVLTPREVKAMADGVKSAEEFRKLGESLLSTETQGLQSLREVAESFDPKSEMPGKSIDFDLLADNIEWTPEERKHMDSLKEKRADLLNRSQLLRDRDRFLTLVRQRAKNILERLRQNDPKGWKDICGFDSRLSWSDEEFDEWRQSEVGKKALGDGVLEPEPSVDNAGDTEMADADKNEVDTIAQGVCIKKRCEQHRQWAKVQQQDILFELSIVKDHLSKCGKTATEVIEGVVLRAYGDQNRTVGGAT

SEQ ID NO: 781 - protein, 345 aa, Oryza sativa Japonica Group
MRLARQQQQVVVAATMEHDVHHHRQMMQQQQQQEMDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKDQEWVLCRVFKKSLELAPAAAAAVGRRGAGAGTDVGPSSMPMADDVVGLAPCALPPAHVTCFSNALEGQFLDTPYLLPAADPADHLAMSSASPFLEALQMQYVQDAAAAGGAGMVHELLMGGGWYCNKGERERLSGASQDTGLTSSEVNPGEISSSSRQQRMDHHDASLWAY

SEQ ID NO: 782 - protein, 994 aa, Oryza sativa
MTSDNGKAPEKGGEASGPSSAPQEGEISNEPQRRRPLSGRTTGPTRRSTKGNWTPEEDSILSRAVQTYKGKNWKKIAECFPDRTDVQCLHRWQKVLNPELVKGPWSKEEDDIIVQMVNKLGPKKWSTIAQALPGRIGKQCRERWHNHLNPGINKEAWTQEEEITLIHAHRMYGNKWAELTKFLPGRTDNAIKNHWNSSVKKKVDSYMSSGLLTQVSCLPLNEYSAHCNSSPALTQQNSEDSGSYAVREVENSSVCSQSSLAKVSCSQVHNANVALGCDLQVNANVDNNEAHDSQSSVGHEACYTSVGAVATAIPEVHYHVSSSNFDPDQHLQEEFAQGLNLHMSMDEVPSNSSFADNPTICSIENHERSLEPYDVAMEMPLSMLPSDSGAEQKLHFMSEADFNSPNCLKSELWQDISLQSLLSGPDAVETDSFSRSNHQSDVYSSQADNEFLAPPYLLQTSNSSSVMEATYGQSPQMSVPPSLICSNVMTDVPSDNRSEPKEMTVSQAEMVTQSSSSSGDAEMSANPVSSNGSDIPSMMERIPECADQHVTNAEEPEASIEKEPSVTPSATADEKQDEGALFYEPPRFPSMDVPFVSCDLVTSGDLQEYSPLGIRQLMRSTMNVCTPMRLWGSPTHDESPDILLKSAAKSFICTPSILKKRHRDLVSPIPDKRIEKKSGTEKDCGVSDTSSIGIQTCFINATKDDAVITKSVLRIERSASSKPLEKKLEFSDENKENLDNTIEQAKDGQSAGNYKHIDEQARGERRTATNITTTYDDPPGNLQPAGILIEHNGDDLVSPDYGKNTMKQKQNTNMESLSVCKEGVSAKKPAELIVEKSSACINVDYEYVNILADTPGIKRGLESPSAWKSPWFVDMQFQGSYFVSPANGSYDALGLVKQINVQTAAALAEAREVLASGGQSENINSDKENLENPDAKKEPGATTKLQAKIKTEGKILDFNECATPIRSSDKKAGSSLGRSLSSPIPSSHLLKSFR

SEQ ID NO: 783 - protein, 364 aa, Oryza sativa Japonica Group
MDGSSMSSSSTQQQAQVPPGFRFHPTDEELVDYYLRKKVAARRIDLNVIKDVDLYKIEPWDLQERCRINGGSAAEEQNEWYFFSHKDKKYPTGTRTNRATAAGFWKATGRDKPIYATKQHSLLVGMRKTLVYYRGRAPNGHKSDWIMHEYRLETTETAPPQEEGWVVCRVFKKRLPTTRRDSDHDAPCGSWYVDEDAPGAFMSPMMITRSSILRPHQHHAGITLQEQHLHTTYKHRDLTTKIQQLQVPAAGHHLLNTMPHDLESSTSSFHSLLVSPDHHQINMHHAQADPFFDDMHAVDQATTTDWRVLDKFVASQLSNDATNKPADHYTDEGDILQVSDKQQEVAAADYASTSTSSSQIDPWK

SEQ ID NO: 784 - protein, 250 aa, Oryza sativa
MTSDNGKAPEKGGEASGPSSAPQEGEISNEPQRRRPLSGRTTGPTRRSTKGNWTPEEDSILSRAVQTYKGKNWKKIAECFPDRTDVQCLHRWQKVLNPELVKGPWSKEEDDIIVQMVNKLGPKKWSTIAQALPGRIGKQCRERWHNHLNPGINKEAWTQEEEITLIHAHRMYGNKWAELTKFLPGRTDNAIKNHWNSSVKKKVDSYMSSGLLTQVSCLPLNEYSAHCNSSPALIVDLQACKLGTGRRFTR

SEQ ID NO: 785 - protein, 135 aa, Oryza sativa
MYLYAAECFPYRTEVQCLHRWQKVLNPELIKGPWTQEEDDQIIDLVKKYGPTKWSVIAKALPGRIGKQCRERWHNHLNPEIRKDAWTTEEEQALINAHRIYGNKWAEIAKVLPGRTDNSIKNHWNSSLRKKQDMY

SEQ ID NO: 786 - protein, 351 aa, Triticum sp.
MSDVTAVMDLEVEEPQLALPPGFRFHPTDEEVVTHYLTRKVLRESFSCQVITDVDLNKNEPWELPGLAKMGEKEWFFFAHKGRKYPTGTRTNRATKKGYWKATGKDKEIFRGKGRDAVLVGMKKTLVFYTGRAPSGGKTPWVMHEYRLEGELPHRLPRTAKDDWAVCRVFNKDLAARNAPQMAPAADGGMEDPLAFLDDLLIDTDLFDDADLPMLMDSPSGADDFAGASSSTCSAALPLEPDAELPVLHPQQQQSPNYFFMPATANGNLGGAEYSPYQAMGDQQAAIRRYCKPKAEVASSSALLSPSLGLDTAALAGAETSFLMPSSRSYLDLEELFRGEPLMDYSNMWKI

SEQ ID NO: 787 - protein, 236 aa, Arabidopsis thaliana
MAEEYYSLRSERVTQLLVPNSESDSVSDKSKAEQSEKKTKRGRDSGKHPVYRGVRMRNWGKWVSEIREPRKKSRIWLGTFPTPEMAARAHDVAALSIKGTAAILNFPELADSFPRPVSLSPRDIQTAALKAAHMEPTTSFSSSTSSSSSLSSTSSLESLVLVMDLSRTESEELGEIVELPSLGASYDVDSANLGNEFVFYDSVDYCLYPPPWGQSSEDNYGHGISPNFGHGLSWDL

SEQ ID NO: 788 - protein, 333 aa, Glycine max
MASDAKLSSSESLNGLKFGQKIYFEDVGRGGSVQPAQPPRCQVEGCEVDLSNAKTYYSRHKVCGMHSKSPTVIVAGLQQRFFFWSWDGFLFHQLPEFDQGKRSCRRRLAGHNERRRKPPPSSLLTSRYARLSSSAFDHSGRGGNFLMELASYPKLSLRNSLPTPRSSELAPGNQTSTLSWHGNSETSSDLFLQGSVGGTSFAGPGHPPGESYTGVTTSSCALSLLSNQTWGSRNPAPSLGLNNMVNFHGTPMTQPAASSHGASIHQLPNTPWCFKGIDSGNCSPEGVPDLGLGQISQPLSSQLHGELDLSQQGRRHYMDLEQSRAYESAHWSL

SEQ ID NO: 789 - protein, 514 aa, Capsella rubella
MDNSRTRQNMNGSAAATNWSQQNGRTSTSSLEDLEIPKFRSFAPSSISISPSLVSPSTCFSPSVFLDSPAFVSSSAHVLASPTTGALITNESNTKLINEGEKKDNNINFFDFSFQTQSSGVSAPTTTTTTTNNSSIFQSQEQQRKNQSDQWSQNESRQNNQAVSYNGREQRKGEDGYNWRKYGQKQVKGSENPRSYYKCTFPSCPTKKKVERSLEGQITEIVYKGSHNHPKPQSTRRSSSSSSSTFHSAVYNASLDHHRQASSDQPNSNNSFHHSDSFAMQQDDNTTSDSVGDDEFEQGSSIVSRDEEDCGSEPEAKRWKGENETNGGNGGGSKTGREPRIVVQTTSDIDILDDGYRWRKYGQKVVKGNPNPRSYYKCTTIGCPVRKHVERASHDMRAVITTYEGKHNHDVPAARGSGYATNRAPQDASSVPIRPAAIAGHSNSTTSSPAPYTLQTLHNNNTNSTARSWLRYDNNNNNNNNNPQTLQNCVCGDAFSRATEEPNEETSFFDSFMP

SEQ ID NO: 790 - protein, 292 aa, Vitis vinifera
MKIHCDVCSREEATVFCTADEAALCDACDHRVHHANKLASKHQRFSLLHPSPKQVPLCDVCQEKRAFLFCQQDRAILCRDCDLPIHTANEHTQKHNRFLLTGIKLSATSALYSSTTSSSLKKPESVPPEISHPPSITKTSSPTTAINSINKGGDASLTSEGVSTSSISEYLIEMLPGWHVEDFLDSTSAPSGFCKSAGDDVLPYLLDADLDNNLSSFSSENLGVWVPQAPTPLHPSQYSSFMGGQIGLKESKEATTMKPNSKKWGDDVFTVPQISPPSVGSKRSRSFWQYHH

SEQ ID NO: 791 - protein, 362 aa, Brassica rapa subsp. pekinensis
MNTTSTHFVPPRRFEIYETTLNQVSMWEESFKNNGGIFTPNSIIIPTDAKLDSLSEDTSHGTPHKFDQEASTSRHPDKTQRRLAQNREAARKSRLRKKAYVQQLETSRLKLIHLEQELDRARQQGFYEGNRVDTNALGFSDKMSSGIVAFEMEYGHWVEEQNRQISELRTVLQGQVSDVELRLLVDNAMKHYFQLFRMKSAAAKIDVFYIMSGMWKTSAERFFMWIGGFRPSELLKVLLPHFDPLMDQQVLDVCNLRQSCQQAEDAVSQGMEKLQHTLADSVAAGNLGEGSYIPQITCAMERLEALVSFVNQADHLRHETLQQMHRILTTRQAARGLLALGEYFQRLRALSSSWATRQREPT

SEQ ID NO: 792 - protein, 229 aa, Glycine max
MASETEVLNIISSVFERFERNMSLFLPFIFGFSDATSGRDSDDPDHETAHTEGSLRQRIILVNPLTQGMVVIDGGLSLEALFRELANGKGGRPPASKESIEALPSVEIGEGNEDSECVVCLEEFGVGGVAKEMPCKHRFHGNCIEKWLGMHGSCPVCRYEMPVEEIDWGKKREEEGGERRRSDGGEVWVSFSFNRSSRRNQDHDQADSGDSNDDDGSSSSHGDGAAEES

SEQ ID NO: 793 - protein, 333 aa, Zea mays
MALEAVVLSQSQFQQGSRFGCGAMAAGGAWSDLLFSGTEGLFEMGGAAGRGWNAAASSPPQLLQELGDNGAAGSLPVASAGSASGGAGQDAPAMAAAAASGRRKRRRMRPVKNEEEVESQRMIHIAVERNRRKQMNEHLAALRSLMPPAHTQRGDQASIVGGAINFVKELEQLLQSLEARRRSPQCAAYAVDPDDAGPFADFLTFPQYSMCAVIAAPENTGHHREGGAVAEQEASGSKPSAVADVEATMVESHANLRVLSRRRPRQLLRLVLGLQGHRLTVLHLNMSSGAHMVLYSFSLKVEDDCQLTSVGEIAAAAHHIVEKINEEQNKAAA

SEQ ID NO: 794 - protein, 189 aa, Brassica rapa subsp. pekinensis
MVEVEELEPLSPVEDGDEGEEEEEEDISYDDLKRRMWKDQNLMEKLKQQKRDNTDVVSLPTHRAEASRRKKMARSQDSVLKYMMKIMEVCKAKGFVYGIVPEKGKPITGSSDSLRRWWKENVDFDQNAPNAVAGYLTLAAAAAELIEKEPSSLLHMLQELQDTTLGSLLSALMQHCAPPQRRCKLEKIL

SEQ ID NO: 795 - protein, 198 aa, Gossypium barbadense
MAPKKDGVSKRVFNKGSWTAEEDRRLAKYIEIHGAKRWKTIAIKSGLNRCGKSCWLRWLNYLRPNIKRGNISDEEEDLIIRLHKLLGNRWSLIAGRLLGRTDNEIKNYWNSHLSKKIINHDVRTEQTSSSEQIVPHKAWETVQMEEEEVVKGSDEIENSEFSIDVDEFFDFTTEGCFSLDWVNKFLELDDQQDPLAMV

SEQ ID NO: 796 - protein, 221 aa, Zea mays
MATHHLAQGHPQAWPWGMAMYTNLHYHHHQQQQQYYEREHLFEKPLTPSDVGKLNRLVIPKQHAERHFPLGGGDGNGGESKGVLLNLEDAAGKVWRFRYSYWNSSQSYVLTKGWSRFVKEKGLQAGDVVGFYRSAAGADTKLFIDCKLRPNSVVAASTAGPSPPAPVAKAVRLFGVDLLTAPATAAAPAEAVAVAGCKRARDLGSPPQAAFKKQLVELALV

SEQ ID NO: 797 - protein, 426 aa, Arabidopsis thaliana
  misc_feature (299)..(299): Xaa can be any naturally occurring amino acid
  misc_feature (309)..(309): Xaa can be any naturally occurring amino acid
MMKDPTGYRFSPTGEEVINHYLKNKILGKTWLVDEAISEINILNHKPSKDLPKLARIQSEDLEWYFFSPIEYTNPNKMKMKRTTGSGFWKPSGVDRKIRDKRGNGVVIGIKKTLVYHEGKSPHGVRTPWVMHEYHITCLPHHKRKYVVCQVKYKGEAAEISYEPSPSLVSDSHTVIAINGEPEPELQVEQPGKENLLGMSVDDLIEPMNQQEEPQGPHLAPNDDEFIRGLRHVDREPVEYLFANEENMDGLSIMNDLTIPMIAQQEDLILSEWEGFIAATFFSDNNNNNNLNVHQLTSXYRDDYQNAFXGYNGATPPDHELVMQENRNDHMPRKPVTGTIDYSSDSGSDAGSISTTVKQEIPRAVDAPMNNESSLVKTEKKGLFIVEDAMERNRKKPRFIYLMKMIIGNIISVLLPVKRLIPVKKL

SEQ ID NO: 798 - protein, 361 aa, Oryza sativa Japonica Group
MEEELCGNNWDLDAVVRLGCCRRRISPAAVAQQVDPFASFLQQGVAMEVAAEKEVGVEAAWSFPELTVRDGGGGGLGRDADELLKAFCAAFPSSSSSKSSPLPTPPPPPPTQPQPEQQKPVTVQENLPAPTTAPARASQPAAARQVPAGGVPRSKRRKNQQKKVVRHVPADGVSADVWAWRKYGQKPIKGSPYPRGYYRCSSSKGCPARKQVERSRSDPNTFILTYTGEHNHSAPTHRNSLAGTTRNKLPSSSAASAASAQPQPPPPSVVVVGAGGGGAEAAGLSPTTPLRTPSMEEDEEEEEEEELLVEDMEMAGEDELLFLNGGDDNAALDGTPMSSLFDIADEPFLPSPWTEPTAAGS

SEQ ID NO: 799 - protein, 286 aa, Oryza sativa
  misc_feature (45)..(45): Xaa can be any naturally occurring amino acid
  misc_feature (70)..(70): Xaa can be any naturally occurring amino acid
MGMEAECDRIKGPWSPEEDEALRRLVERHGARNWTAIGRGIPGRXERRPFTAEEDAAILRAHARLGNRWXAAIARLLPGRTDNAVKNHWNSSLKRKLATATDGGEIDRPCKRVSPGPGSPTGSERSELSHGGCGSGSGGGQVFRPVPRPGGFDAISAADVVRPPRRRDDNDDDGDDDPLTSLSLSLSLPGFHHDSARSHFQELPSPSRSPSPPPSPPAASPSAYPFNADLVSAMQEMIRTEVRNYMAGVGLRAGCGPGAVAESFMPQLVDGVMRAAAERVGVVTRQ

SEQ ID NO: 800 - protein, 347 aa, Oryza sativa Japonica Group
MGTNDPGTPSKATKASEPEQSPATTSGTTAPVYPEWPGFQAYSAIPPHGFFPPPVAASPQAHPYMWGAQPMVPPYGTPPPYMMYPPGTVYAHPSTPGVHPFNHYPMLANGNVETAGTAPGASEINGKNELGRTSGPSANGITSHSESGSESESEGSDANSQNDSHSKENDVKEDGSSQNGISHTALNQNMSMAPTQTGVVIGGVAPTTNLNIGMDYWGAAGSSPVPAMHGKASSGSVRGEQWDERELKKQKRKQSNRESARRSRLRKQAECEELSVRADNLRAENSSLRAELERIKKEYEALLSHNASLKEKLEGNSDSIPYMNEQNDTNGTHQKQQDSDAQPNDAP

SEQ ID NO: 801 - protein, 387 aa, Arabidopsis thaliana
MTRRCSHCSNNGHNSRTCPTRGGGTCGGSGGGGGGGGGGGSGSSSAVKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 802 - protein, 330 aa, Arabidopsis thaliana
MNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGSHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 803 - protein, 218 aa, Picea sitchensis
MVRGKTQMKRIENATSRQVTFSKRRNGLLKKAYELSVLCDAEVGLIVFSPRGKLYEFASPSMQEILEKYQDRSQESDISVRTKEQDTQSLRRELANMEEKIKILDSTQRKMLGEGLTSCSMAELNKLESQAERGLSHIRARKTEILMDQIECLKRKELFLSEENAFLSKKYVDRQSMDGSVSTSPSIGLGSIDNIEVETQLVIRPPTAQDHFSVNNSY

SEQ ID NO: 804 - protein, 468 aa, Oryza sativa Indica Group
MGAHGDHRHHHHHQEAGVLVDEEEEEVIEQACGGPTSGVVEQEVGGDGGGVCQDAAGMVFEATSSVGSVSATMGPPPIMCWPPPAQPVHGAIHHHHNLGGGGGQQSPFFPLLPPLPPQPPPPPPFFADFYARRALQYAYDHSGGASSSSDPLGLGGLYMGHHGSHVAGMMMPPPFAPSPFGDLGRMTAQEIMDAKALAASKSHSEAERRRRERINAHLARLRSLLPNTTKTSEITEEACPLPTESDELTVDASSDEDGRLVVRASLCCDDRTDLLPDLIRALKALRLRALKAEITTLGGRVKNVLVVTGDDSAAAAALRGDGRGRRAAGGGDAGAHVAAAHGRVHPGRAARRHGADGVGHRGVRGVRRRRWAQAAAHHEPLGDPREQILHHNAVLSSIKAITYISTTSIHAITDSIMYTVTMSWCTREAGRGYMSKSEDNGANSSMYHEVEKRHSSSISFNAYGGTHD

SEQ ID NO: 805 - protein, 206 aa, Picea sitchensis
MGKTKMEMKRIQNPSRRQVTFSKRKNGLLKKAFELSVLCDAEVALIIFSETGKISEFASHDDVATILEKYRIYTETNGNLGSTSLQNIKFGELRLKTLHEKMDVLKKKEKNMVGEDLESLTMKELQRLEKQLQTGIKRISDRKMRIFAQSSKLLIQKVRILEEEKIELQTKLSARGDSSTSATNLDLGLSYSTMASGPCDGNRNGD

SEQ ID NO: 806 - protein, 248 aa, Antirrhinum majus
MGRGKVQLKRIENKINRQVTFSKRRGGLLKKAHELSVLCDAEVALIVFSNKGKLFEYSTDSCMDRILEKYERYSFAERQLVSNEPQSPANWTLEYSKLKARIELLQRNHRHYMGEDLDSMSLKEIQSLEQQLDTALKNIRTRKNQLLYDSISELQHKEKAIQEQNTMLAKKIKEKEKEIAQQPQWEHHRHHTNASIMPPPPQYSMAPQFPCINVGNTYEGEGANEDRRNELDLTLDSLYSCHLGCFAA

SEQ ID NO: 807 - protein, 147 aa, Brassica napus
IQRNEYHNLFNFVSGKNLKILNLGEDGQDRTGAVAAALQSTDDDPVDPHLERIKNQAGDEESDEEDEDFVADKDDSGSPSDVSEEGSDASISDGEKEKSSKKEASSSKPPAKRKPKNVDVEGSEKRKPKKKQKKDPNAPKRAIAPFM

SEQ ID NO: 808 - protein, 293 aa, Emericella nidulans
MPPDPDRRRSSNRMAIPYATGLPADNQPLPSFRELLPPHLHEEIESTSYFNSQHNSRQPRERPASSHELGLNSVPREHASSRSSRPSPVLPPIRDLQSYPDRATGVYPDPRGLPPPPEITARPVGPHGYPHAAPAVPGPLADRNADAYRGVPPMHGQVRYHYPSMAYQSDPDHASVPSLSHAPQSNFGILGDSTDARNRRRRGNLPKPVTEILKAWFHAHLDHPYPSEEDKQMLMSRTGLTINQISNWFINARRRHLPALRNQRRTGGSDLDERQSLSDMEQTSPEPSPHRRL

SEQ ID NO: 809 - protein, 280 aa, Oryza sativa Japonica Group
MAAAIEGNLMRALGEAPSPQMQKIAPPPFHPGLPPAPANFSSAGVHGFHYMGPAQLSPAQIQRVQAQLHMQRQAQSGLGPRAQPMKPASAAAPAAAAARAQKLYRGVRQRHWGKWVAEIRLPRNHPRLWLGTFDTAEEAALTYGQAAYRLRGDAARLNFPDNAASRGPLDAAVDAKLQAICDTIAASKNASSRSRGGAGRAMPINAPLVAAASSSSGSDHSGGGDDGGSETSSSSAAASPLAEMEQLDFSEVPWDEAEGFALTKYPSYEIDWDSLLNNNN

SEQ ID NO: 810 - protein, 194 aa, Brassica napus
MEKGGVEHEITELRLGLPGRDVTEKMMKKRGFTEMIMTSSGSNSDESGVVSGGDVEKINESPTAKSQVVGWPPVCSYRRKNNCKEAWTTKVGLGYVKVSMDGVPYLRKMDLGSSQGYDDLAFALDKLFGVRGIGVALKDGDNCEYVTIYEDKDGDWMLAGDVPWGMFIESCKRLRIMKRSDATGFGLQPRGVDE

SEQ ID NO: 811 - protein, 263 aa, Brassica napus
MATTMDYYNSKTFQQTDPFGGELMEALLPFIQSPPTDSPASAFAFASYPDVCLTQPIPYVSSDLNQTHSYSNLLSPKPVPMKQTGSPPKPMKLYRGVRQRHWGKWVAEIRLPRNRTRLWLGTFDTAEEAALAYDKAAYKLRGDFARLNFPNLRGEFGEYQPLQSPVDDKLEAICKSLAETQKPTKKSSSRRRSSTAKQPEEVKSEDYSSVVSPPSTESYGSPLSDLTFVDVEEEEQPWNVNFALEKYPSYEIDWGLDSVHVDI

SEQ ID NO: 812 - protein, 211 aa, Triticum aestivum
MMVAKAEMSAIEMEKATSDGEVVLGAGDEEDDDDVVLPGYRFHPTDEELVTFYLRRKVAKKSLRIEVIREMDIYKHDPWDLPKASTVGGEKEWYFCLRGRKYRNSIRPNRVTGSGFWKATGIDRPIYSAAAGGSGVSIGLKKSLVYYRGSAGKGTKTDWMMHEFRLPPAAAPATNASPSMQEAEVWTICMIFRRTITYRKQQTWRPAPAPS

SEQ ID NO: 813 - protein, 576 aa, Aspergillus oryzae
MESFDNIYLDLSKQPGKCKLAESGLGWKPSGEGETFTLDSSNVGAAQWSRAAKGFELKILSRSSGVIQLDGFDQEDFERLSKAFKIWYGINVESREHALRGWNWGKAEFTKAELSFNVQNRPAFEVPYSEISNTNLAGKNEVAVELALNTDGADANAQPAGSTKNRGRKAASGPDELVEMRFYIPGTVMKTEKGIKEENGKEENGEEEEEGEEQNAANLFYEMLMEKAEIGDVAGDTFATFLDVLHLTPRGRFDIDMYESSFRLRGKTYDYKIQYSSIKKFFLLPKNDDTHTLIVLGLDPPLRQGQTRYPFLVMQLKLDEEISLELNMTDELMETRYKDKLEPRYEEPIHQVVTKIFRGLSGKKVIMPSKDFVSHHGHSGVKCSIKANEGLLYFLDKSLIFVPKPATYIQVENIAIITMSRVGGAVSASRTFDITVSLKAGMGEHQFSNINREEQQPLEEFFKAKNIRFKNEMSDDAGALLAAALDNDVMGSSDDEGVRADRGSADEDEESIDEDFQAESESDVAEEYDSAHESSGSGSDAEMNDASDGGGDDDDDDEDVDMSEEERPKKKSKVGK

SEQ ID NO: 814 - protein, 801 aa, Chlamydomonas reinhardtii
MTNPANQPPPFLIKTYDLVDDPSTDNIVSWGADGHSFIVWKPPEFARDLLPKHFKHNNFSSFVRQLNTYGFRKVDPDRWEFANEHFVRGKKEQLRDIHRRKPSATHNATGTGGGASGAAAGAAAATPGAPVPSNALVAAGQTAPAIEIGAYGGFREEIDNLKRDKNVLMVELVRLRQQQATADAKIRDLTGRLENTEAKQQTMINMFAAAFKNPAMFQRMLSTMASSGVQRLTAAPAYSGGAGAAGGRRKRRARGETSVTDIGEDIAGTGVGITEAIDADMLETGGANHMAVNGVHGAAGSPPSHGHGADDTSSNGSATDATGAANGYGHQLVAYNPAVAAAAAAAGAAGGSSAAAVSGGAASTDALSEMMMRSFQSLLSGAEDMTGDVTGALNSLAIGQGGGVGGGGAHVGHALGAHMVPSAAAPHVTIQEQPSTSAAAAAAAAAGGGTPTTSSVVLMGSSAPGVVVNSTGGAVVDPTSGAAGLISTAIQPYQGPAALPGLPQGVAVGGVTGLSGLGPGTTLLAPGAMATAPHAPGAHPTPSAFVITKPEPMLGGAPGPVLPVGTPGMVPVQPSTGPGSSAAMTASALPTSAFAALAGVPAVPMPVPAVPMAGAAGPSVPIPMPGSAAATPVPMVPVVMSPPPPGHTMIPIQTATMAPPTQAMGAAGLRVPSGLPAINNMALTPAAAAAAAAAAAAAAMPGSGGLFDATPTSAAGLPVNDNPTVTSPPADADGVDGMLGGLSGLDLMTSLPSGELVLPSDGDFGDDVWAQIMSAASAQAPDAAGGLGGLDLNPVSAALEH

SEQ ID NO: 815 - protein, 125 aa, Glycine max
PRAAEHHLLKGEGVAGGAFMTNQPCFSDDITSLSKKDYPMSHHARLFGLRAAVAIRLRSIYNSTDDFVLEFFLPVDCNDIEEQRKMLTSLSNIIQRVCRSLRVIREKELEEANLSVNEVIALADS

SEQ ID NO: 816 - protein, 317 aa, Arabidopsis thaliana
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 817 - protein, 545 aa, Oryza sativa Japonica Group
MKEKEVLVEIVEDDELKRSIGRNQLDLNEEVMDVESEEGEVGDDEDDEDEEDDDDDDDGGSTTDVAGSRSSSNNSSTNNVSESKLKGDKDSGGGRLEGINGGEQRVPSVRQYNRSKLPRLRWTPDLHMAFVHAVERLGGQERATPKLVLQMMNVRGLSIAHVKSHLQMYRSKKLDHEGRQIRGAIASVFSPMDFHLMRGDRRFHDMLLQRAAALSSSRQEHGGFFSSRSGGGGGGLPPEASRLYGLLQHRQSPAIATMQTLDFKNSSFRNQEWSFSFNHQRKETMNPSSSSSTTAAIRRWPSAAGAVAVVAGERQRLAERFGYYTGNGGASSTSLPLITRAAMAAPPPMFAAAVAPPGRDHHRLPFGWHAGGGGGGGGNKNRSSSDPVVIDEALDSRRLEHQQKHVEQPRMTPTTTTTPAGKRPPEWSPPDLQLTLSPTTAPAAADGGGAKRSKTSTTTTNTTAAISGEQEAEKNMDRCKNKLSISLSLSPPAAAAAAANFSSMDLSMEQQKQKQEKTTIGSSEEEAGDLGQSTLDLTMSIRALE

SEQ ID NO: 818 - protein, 360 aa, Oryza sativa Japonica Group
MAAIDLYKYQLSSSSSSSSSDQELMKALEPFIRSASPTSTSTSTPLFYSSSSISTTTTTPFSYSSPLPQESYYLPASSSYAAIVPPPTTTTNTTTSFSELPPLPPSSSSFASPANAAAVGLAHLGPEQIQQIQVQFLMQQQLQQRGMAASASASAAASYLGPRAQPMKQAGAAAAAAAGGKMYRGVRQRHWGKWVAEIRLPKNRTRLWLGTFDTAEDAALAYDKAAFRLRGDAARLNFPTLRRGGAHLAGPLHASIDAKLTAICHSLAAAPPASSKKAAAAAAHPDSPKGSASTTTTTSEGDESAISACSPPLPPPPPPPPAALPEMANLDFTEAPWDESDAFHLYKCPSWEIDWDSILS

SEQ ID NO: 819 - protein, 312 aa, Thlaspi caerulescens
MANPWWTGQVNLSGLETTPPGSSQLKKSDLHISMNMAMDSGHNNHHHHQEVDNNNNNDDDRDNLSGDEHEPREGAVEAPTRRPRGRPAGSKNKPKPPIFVTRDSPNALKSHVMEIASGTDVIETLATFARRRQRGICILSGNGTVANVTLRQPSSAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSVPGQLGGGGSPLSSGGGGGDGNQGLPVYNMPGNLVSNGGGGGGQMSGQEAYGWAQARSGF

SEQ ID NO: 820 - protein, 851 aa, Oryza sativa
MAPPPPPQGSSTGDPLYDELWHACAGPLVTVPRVGDLVFYFPQGHIEQVEASMNQVADSQMRLYDLPSKLLCRVLNVELKAEQDTDEVYAQVMLMPEPEQNEMAVEKTTPTSGPVQARPPVRSFCKTLTASDTSTHGGFSVLRRHADECLPPLDMTQSPPTQELVAKDLHSMDWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSVGMRFRMRFEGEEAPEQRFTGTIIGSENLDPVWPESSWRSLKVRWDEPSTIPRPDRVSPWKIEPASSPPVNPLPLSRVKRPRPNAPPASPESPILTKEAATKVDTDPAQAQRSQNSTVLQGQEQMTLRSNLTESNDSDVTAHKPMMWSPSPNAAKAHPLTFQQRPPMDNWMQLGRRETDFKDVRSGSQSFGDSPGFFMQNFDEAPNRLTSFKNQFQDQGSARHFSDPYYYVSPQPSLTVESSTQMHTDSKELHFWNGQSTVYGNSRDRPQNFRFEQNSSSWLNQSFARPEQPRVIRPHASIAPVELEKTEGSGFKIFGFKVDTTNAPNNHLSSPMAATHEPMLQTPSSLNQLQPVQTDCIPEVSVSTAGTATENEKSGQQAQQSSKDVQSKTQVASTRSCTKHMKFFLLVVDMLKFSFCKFLAKSQFYPLCGMVHKQGVALGRSVDLSKFSNYDELKAELDKMFEFDGELVSSNKNWQIVYTDNEGDMMLVGDDPWEEFCSIVRKIYIYTKEEVQKMNSKSNAPRKDDSSENEKGHLPMPNKSDNYVCLLNCLIWINLFNCR

SEQ ID NO: 821 - protein, 216 aa, Triticum aestivum
  misc_feature (185)..(185): Xaa can be any naturally occurring amino acid
  misc_feature (201)..(201): Xaa can be any naturally occurring amino acid
MVAAAMQALFDQTDLSLSLSLAPTAAPALNKDDYLAICLAALAATGKGGQQQQDQASAWRPAPAPAQELRFSCAVCGKAFASYQALGGHKSSHRKPPPTGERCVVVAQASAGAGSEASAAASSGGSSGGPHQCTVCGRGFATGQALGGHKRCHYWDGTSVSMSMSVSVSASSSMLRNFDLNLLPXPENVNAGLKRCAEEEXEVQSPLPAKKLRLLL

SEQ ID NO: 822 - protein, 169 aa, Oryza sativa Indica Group
MEDLYSIHPGISRVGGAASEASGVGVVVGGGGGSSSSDLTELMKAQIAGHPRYPTLLSAYIECRKVGAPPEVASLLEEIGRERRAGGGGGGAGQIGVDPELDEFMEAYCRVLVRYKEELSRPFDEAASFLSSIQTQLSNLCSGATSPPATTATHSGNQHIHYICMHTLQ

SEQ ID NO: 823 - protein, 896 aa, Ostreococcus tauri
MASCQREPGDALLEAFLEGLPNADASDDPVLGDVESLFDGLVDDMNSDQAQRVQGGALATTQGPRDGRVGRPATAGERGRNTRSTSRSKSRSRARSAGRDSTVRSLVRAALASTGSVNDGLEDAVDNVRSKLTAMAEGVKSIIEHECLIQVWLVDKRDEEWTMSACDELVGLKSANHMDALWAFHSEFKSFSLNAYMAGHDGFTPVSGAPGRVFVTKEPEFTPSVQCYNPSEYQRKALACEMGCHSQLLVPIFLEAVETPIGIVEVTFLRVLDNIGTLYRQILNEITSVGLKSATSPLLGPPIMMAERIAPDSQRLDSGSIATRLQDFCSRMDIPYAQIWIPCAADKTFVTAGAPFYQISTHFNQYRNFASNVGIADSHGTFSKVWTSGSMIWLHDLSTISRRDLVLKHACELLQIRAMCVSKVAFNDVKTGAPLEVLLEVLLDPNLKSPREQAKTVQAFWSSLESSLNVSVVTQTEKTWLEEMKKEQTASDVQIEGTNVSTMWGITLEVLQANFHKHLKQAASDLGVGSTTLKRICRQYGIRRWPRRSLNSRNGRMNEILTKSQGGEDSYGELRSESPVQPTGSAISYASELLDQAAERFARDAAGVSHEAQHHKRGLEERVHRGGNLGALWRGGKMQRGASWHGNDAALNAIEFDVPTRFEQSVHGMYNFNMSPPPLDQSVHGNTALDELRNNQEMADFFEGLVQDPSEHQALIVKISVGDTLMRVRLVTASRYAELTEALGAMLSETLANCKLKYQDDEGDWCLMRSQEDFDECIALNTHKGKSNVIRIKLTMDGTVKDLFKLEQVVRKLPPSVVANAISVKASVEDDVVRFKLTSDMTFAALLAKLHLNGKKEVTLHYLDDGDEWIRLGGDLDLLEARICGDAAGALRIKCM

SEQ ID NO: 824 - protein, 401 aa, Arabidopsis thaliana
MRSSSQNSENSKTCLSNNIKATTKNEEDKDEEDDEEGEEDEEERSGDQSPSSNSYEEESGSHHHDQNKKNGGSVRPYNRSKTPRLRWTPELHICFLQAVERLGGPDRATPKLVLQLMNVKGLSIAHVKSHLQMYRSKKTDEPNEGDQGFSFEHGAGYTYNLSQLPMLQSFDQRPSSSLGYGGGSWTDHRRQIYRSPWRGLTTRENTRTRQTMFSSQPGERYHGVSNSILNDKNKTISFRINSHEGVHDNNGVAGAVPRIHRSFLEGMKTFNKSWGQSLSSNLKSSTATIPQDHIATTLNSYQWENAGVAEGSENVLKRKRLLFSDDCNKSDQDLDLSLSLKVPRTHDNLGECLLEDEVKEHDDHQDIKSSSKLDRTIRKEDQTDHKKRKISVLASPLDLTL

SEQ ID NO: 825 - protein, 144 aa, Oryza sativa Indica Group
MVGSSDEDQCSGETDMLDIGQEQSSRLADHELKEMLLKKYSGCLSRLRSEFLKKRKKGKLPKDARSALLEWWNTHYRWPYPTEEDKLRLAARTGLDPKQINNWFINQRKRHWKPSDGMRFALMEGVAGGSSGTTLYFDTGTIGP

SEQ ID NO: 826 - protein, 354 aa, Oryza sativa Japonica Group
MDTFSHVPPGFRFHPTDEELVDYYLRKKVASKKIDLDVIKDVDLYKIEPWDLQEKCKIGMEEQNDWYFFSHKDKKYPTGTRTNRATGAGFWKATGRDKPIYARSCLVGMRKTLVFYKGRAPNGQKSDWIMHEYRLETNENGTTPEEGWVVCRVFKKRVATVRRMADGSPCWFDDHGAVGAFMPDLSSPRQLLPHHHHHHPGSSAALYHGHHHQQLQQMRPSCSIFLSWRAPSRRRRLLRRRAYIGGHLGSSSSTALTTHDDEASGSAAQQQPPSLEAVYMAGAGVGIGVDASVTDWRLLDKFVASQLLSKESMSSYGSHPAQVFQAADGGKHEEALDYASTSAGSGGGEADLWK

SEQ ID NO: 827 - protein, 370 aa, Triticum aestivum
WTGNKGIMGIGGGIGILIHSSTVERLYAWDKKLFLEVKNYDGHKQDVRTKVGLLRKQEVRGVDYLKMDKNRMEMESLESKMLVATQSIDTTTSEIIRLRESELFPQLLELVAGLMSMWRGMYECHQVQTHMVQQLEYLTMSTNPTSNDHRQAALQLEIEVDRWYSAFCSLVKSQRDYVYSLTGWLRLSLFQCHHNPLMKDIQNSDIYSLCEEWQLAIDRIPDKVASEGIKTLLSVIHAVVVQQAEEQKQKKRSDAAFKDFEKKTEELRSLESKYGPYSAEGYGEMTRKTPVAEKRAKVEALRSRADDEKSKHEKSVGVTRAMTLNNLQTGFPNVFQAMTGFASVCMEAFESVYNFKRSSDRALDMKRLLT

SEQ ID NO: 828 - protein, 241 aa, Cucumis sativus
LERRMWRDKMRLKRLKEQSKVKEGIDIVKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPTGVEEWWPQLGLPKDQGPPPYKKPHDLKKAWKVGVLTAVIKHMSPDIAKIRKLVRQSKCLQDKMTAKESATWLAI

SEQ ID NO: 829 - protein, 216 aa, Glycine max
MAKTRPGRKDLDSYTIRGTDKIVRAGDCVLMRPSDTSKPPYVARVEKIEQDSRNNVKVRVRWYYRPEESIGGRRQFHGAKELFLSDHYDVQSAHTIEGKCIVHSFKNYTKLENVGAEDYYCRFEYKAATGAFTPDRVAVYCKCEMPYNPDDLMVQCEGCKDWYHPACVGMTIEEAKKLEHFVCSECSSDDDMKKPHATFSVSPGSDVKVEPKRRKR

SEQ ID NO: 830 - protein, 549 aa, Ipomoea batatas
MAASSGTIDAPTASSSFSFSTASSFMSSFTDLLASDAYSGGSVSRGLGDRIAERTGSGVPKFKSLPPPSLPLSSPAVSPSSYFAFPPGLSPSELLDSPVLLSSSNILPSPTTGTFPAQTFNWKNDSNASQEDVKQEEKGYPDFSFQTNSASMTLNYEDSKRKDELNSLQSLPPVTTSTQMSSQNNGGSYSEYNNQCCPPSQTLREQRRSDDGYNWRKYGQKQVKGSENPRSYYKCTHPNCPTKKKVERALDGQITEIVYKGAHNHPKPQSTRRSSSSTASSASTLAAQSYNAPASDVPDQSYWSNGNGQMDSVATPENSSISVGDDEFEQSSQKRESGGDEFDEDEPDAKRWKVENESEGVSAQGSRTVREPRVVVQTTSDIDILDDGYRWRKYGQKVVKGNPNPRSYYKCTSQGCPVRKHVERASHDIRSVITTYEGKHNHDVPAARGSGSHGLNRGANPNNNAAMAMAIRPSTMSLQSNYPIPIPSTRPMQQGEGQAPYEMLQGSGGFGYSGFGNPMNAYANQIQDNAFSRAKEEPRDDLFLDTLLA

SEQ ID NO: 831 - protein, 535 aa, Cryptococcus neoformans var. neoformans B-3501A
MPDPAPFWLCHECGAQMRPVTVDGTPHCASCNGEFIEILDPEVNPDPDYELPPPPPTRPGQQTPSRFDPHFLSNFPPPPQSEGSSSPARQRDTNNTGNFLSSLFSMLGTGSRQGSEETPRRPPPSFHGEPSASQRNGQSQNTDRPGMRTYAFNFGNARGSVTIGSFGSNLGRQGYRMNNDPTSPSGNLFNDPDPFRADPFDARFRPPGDGNRDINGDMPLPLGANEALQLIAALLDGNPPPNMGNLGDFATSDADFMRILQETFMEAAGPQGPVPANETVIEGLPRFTFDSGSLAKSQFRDCPVCKDDFEIGNEVMLIPCGHIYHPDCLVPWLRQNGTCPVCRFSLVSEDEQPNNQRTTNVGTEHTRNAEEERPATPTIPAAVSNFFRNLFGGSESQPPTPRAAAGGGHGSNASQDPHSSVNVVSESTISADASSRHSPTIHGATRREQVQQCDEVASEGSSNDSLVRVYPEHSSGETHGDDATNGEAGRIAEQEQQVASRDRLADRVNRDFNERWQRLRREREEDDTVYHPDLD

SEQ ID NO: 832 - protein, 274 aa, Triticum aestivum
NKFVQKSRLVPVRNSRDIVDPRVRTRLVSELPPRLSCARGEGTAGHGVPVPPPGPRAGDGPGGGEVDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKKKRNNAGEGNAEQSW

SEQ ID NO: 833 - protein, 338 aa, Brassica rapa subsp. pekinensis
MGRSPSSDDSGLKKGPWTPEEDEKLVNYVQKHGHSSWRALPKLAGLNRCGKSCRLRWTNYLRPDIKRGKFSPDEEQTILNLHAVLGNKWSTIANHLPGRTDNEIKNFWNTHLKKKLIQMGIDPMTHLPRTDIFSSLSQLMSLSSNLRGFVDMQQQFPNGQDQTILKLQTEMAKLQLFQYLLQPPTMSNNIRNPNDFDILSLLNSIASFKEITSNNLDLGSNLQDFNSLPSLKTLNSNIGPSSVLPQIPEDNHFKFCRIERENLPVSPIWLSDPTNSNQHMLPSLDPSSAVSDDMIRNQYVIEHVNSNLTSSSQESGASASAAWPDHLLDDSIFSDMIP

SEQ ID NO: 834 - protein, 405 aa, Arabidopsis thaliana
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNADKRPRMKGRFVKRSSIGVAH

SEQ ID NO: 835 - protein, 299 aa, Solanum lycopersicum
MIIMSTEQPNCSESTESSCNSSSSSSPSSPSSVLLQPLPQINSKNRLKRCRGEEEVEEEEDVVVNNPNPKKMNKNNNNGSSTSVVSYVGVRMRAWGKWVSEIREPKKKSRIWLGTFATPEMAARAHDVAAMSIKGTSAILNFPQFSHLLPRPVTCSPRDIQNAAVKAAHMDHLNPKFSILPETSAATMTSSSSSLSLVSGVTSSSSSFQDDEESRPSPPELIPEATGQLSEIVELPKLGSSYELVESTQSLFESDEWWDNNYGNCEYFFGQDNYISSNMEFTGLENVVSTSFESFLWQH

SEQ ID NO: 836 - protein, 245 aa, Oryza sativa Japonica Group
MRVDREMERGDEASVNRGWLELRLGVNGGGGVETVPVTAADSSASSEAGEADTVTPSQQQQQQQQGSPSSPAASSAPNKVFSCNFCMRKFFSSQALGGHQNAHKRERSAAKRTPSSSPYHLHHHRMMMAGAGLPLEAHAAFMRAALRVNPAGSAIHKQQQQHQPPPPITQDATAPRFHDGAAVAAAAAVTPWAPVAPLAYDEVLSSSASSWPGSFRFRTQPEPPPSSEQEPPSEQSKKIDLSLRL

SEQ ID NO: 837 - protein, 460 aa, Selaginella kraussiana
MELRGRRSTSQSPASTQDSTEVSMEQHLPPPRHPHPQQHEMGAMMVLMEESSNAHHHHLGSTSSMPPHQEQQQNPYRPSAAGEHQQQFFLPGMIKEESSPHHQQQQQNFLLPSSVFSMENICWPTNDQADLMESMSPESADLCRNLSSQLEHFRKEIGTYHGAESSSQQHHLVSSASGSSSGSYGVDKSLSVVPAVSLASDLLGSTSSQSSESEMLRAAIVSHPHYPELVVAHMNCHKVAASPEVVSQIDEIIQNFKDFQPPVAASLGANPELDQFMVAYYSMLLKCEKEVRKTFKEAVAFCKKLDQQFQVITNGSASSVTSVESDDRNEAYDSSEDEDSGAEVEIEVDPMAKDKELKEQLMRKYSGYISSLKHEFLKKKKKGKLPKDSRQILLNWWSVHYKWPYPSESEKASLAESTGLDQKQINNWFINQRKRHWKPSDELTALSGQPSQSTEASSGS

SEQ ID NO: 838 - protein, 315 aa, Selaginella kraussiana
MTSAAASSSSKFTAPASTMDEWYMLSSYQSLIDANEGLEHAAGALEHHQQQQSSSSKQKSSLQLSEKEMKAAISGHPQYLELIKAHMSIKKVGASSQKVAEINEVIRMHQDSQPSSVHTNIGANPELDQFMVAYCDVLNMYENQLNKAFTGAIEYCKQQEQELKLVSVSDEPIDALSSVELDDDVEDDEEAESDDVAADGGDIDPLIGDKEIKRALMKKYGGYLGGLTQEYLKKKKKSKLPSAATKTLRDWWFQHLEHPYPSEAQKATLAATTKLDPKQINNWFINQRKRHWDPSAAAASARGESLQQQGSQDGD

SEQ ID NO: 839 - protein, 438 aa, Picea mariana
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYHLELSKPFKEARTFLNKMETQLNCLSKGAIRSFPSGYCDEREDGGGSSEEEFSCGEIEVHEVDPRAEDRELKDQLLRKYSGYFSSLKQEFLKKKKKGKLPKEARQKLLEWWNVHYKWPYPSETDKVSLAESTGLDQKQINNWFINQRKRHWKPSEDMQFVVMDSLNPHGASFYMDGADC

SEQ ID NO: 840 - protein, 363 aa, Selaginella kraussiana
  misc_feature (282)..(282): Xaa can be any naturally occurring amino acid
MGGDQEQQARQHNNDDREAAAKQMPTWLLSSRQQPPPSAQCDEEAWSSHHHHQQQQASSSSYENPRTTTQGLLQDDDKAEHGLGVGSGDMVEECARMQSAKLKADIVTHPLYEQLLEAHVSCLRIATPVDQLGKIDGQIAQCHQLIAKYYILANHQLLCGNSKDELDQFMAHYVMLLRSFKDQLQHHVRVHAKEAVMACWELEQSLLGLTGVSPGEGSGATMSDDETTEQEQQCESDLWQDNLGFGPLIPTETERTLMERVRQELKHELKHGYRARIVDVRXEILRKRRAGKLPGDTTSVLKAWWHAHSKWPYPTEDEKARLVQETGLELKQINNWFINQRKRNWHHHPSSSASTTSKLKCKS

SEQ ID NO: 841 - protein, 237 aa, Oryza sativa Indica Group
MVTVREEMRKGPWTEQEDLQLVCTVRLFGDRRWDFVAKVSGLNRTGKSCRLRWVNYLHPGLKHGRMSPQEEHLIIELHARWGNRWSRIARRLPGRTDNEIKNYWRTHMRKKAQERRGDMSPSSSSSSLAYQSCLLDTVPIISMDGGDIHDDRSCMARVLKSTQSVMDGYTMDQIWREIEAPGAPSLLGIDEGKDKACSNLPCPLLTSTMSDYSCPEVFWKIDNEGTRMLATQSGYGK

SEQ ID NO: 842 - protein, 307 aa, Capsicum annuum
MIKGIVGNQQLGLPAGFRFHPTDEELVQHYLCRKCAGQSISVSIIAEIDLYKFDPWQLPEKALYGEKEWYFFSQEDRKYPNGSRPNRAAGTGYWKATGADKPVGKPKTLGIKKALVFYAGKAPRGIKTNWIMHEYRLANVDRSAGKSNNLRLDDWVLCRIYNKKGHTLRSITMWASKRGESFGEFEDEIKPKIFPTQLAPAPGQWPPRPQSTPASDYFNFETSESMTTTRMHTTNSSSGSEHVLSSCDKEVQSAPKWDDLGTAALDFQINYLDGLLNDPFEIQMQQQNCNIDQFNTFQDMFLYMQKP

SEQ ID NO: 843 - protein, 1153 aa, Physcomitrella patens subsp. patens
MMQLAVICKGLSATLCGCPGSPMTPFGTFAGNKDGVSRGMRRRGESEPPRSYFKAGPGEYRCLFKPGMMCKSEEDETGYYARRKCYWVREDNIRRTKRRARADQGDVSEAALVIPVAKKKKTRPSEEVFFKSTSMCPQTTLSAREAGRECLRHGSEVNNLEASFDVVKPSLSDYPFSVHLYTKDCEREFQERARSHANDLERSPSILPKTPTSPEILDHEINVSSQLLSSRPSRPKDNMHRYNSQNNMTYDDSRYFNGTQESTFEVESEAPEAAGRNMMLNFGGTMDRLDPSASFPGLGELPSNGMEPAVEQNLTGTFTGDLNSTAYEVGDDHNHLLQEMLQQHSQTQQAQLSDANSQMYKSQTLKANLCQVPATASHGAWEDSLNVLQEMVHLQQQQQVQQIYNQAQTEAHEFNQSYSADRFRNAPYGSGAKFPGESDLLNLFQFPRSTSTSLIPSFGYTTGIRGKGPWYSTSTISGPVNTDNRSIGVDPLLAHHSQNSSQGFFHNLSRGNTPEASRHGGPATLVDLDQEREVLSGKNIVYGSKRELGAASAKGEPRGVNHFATERQRREYLNEKYQTLRSLVPNPTKADRASIVADAIEYVKELKRTVQELQLLVQEKRRAAGDSSGAKRRRSLDATDTYPGACTPENASNGHLVMQKGNDTFSADGSQLRSSWLQRTSQNGTHVDVRIVHDEVTIKVNQRRGKTCLVFDVISVLQELQLDLLQASGATIGEHDVFLFNTKASQMMILNVNTMKCYDLGTYSISQHRTLTSYYLSPKLICRVRKLRRDAHYFSRQTLRNFSLSLAVSGPRALALALAFALALAPYQNGHETSSRRHLPQFPGSPPKATHHCGKRQNAESPAQEQNQCQRSINIRLQSTANSRLSVTLNCDLAASLGICVALEGGSNTGDSSNGAGVFIPCERASEQFTGPKVAVDLSYVRLYRNNYHFMEKLKVFSEALEAARTAGENHLTNHPERMRSMSEACTIHHSLKINDMLPRCRNRQSFTPGAASPAIQEFLNRGYPRRYISHYSEYPHLPIQTYFSATPCFILSLPSLGMIFDMIPTTCGDAISICVTEMKASCNQAGLQILAWTVFCQSAEQCAGGGIRMKSQIAAETVTEVGRTIKGGDSAFIDGPQTHPRQNKSNVEQLDS

SEQ ID NO: 844 - protein, 533 aa, Arabidopsis thaliana
ASLKVGGTGPTQKHMIQEGSSMFYHQPSSVKQMDLSVQTFDSYCTLESSSGTKSHPCLNNKNNSSSTTSFSSNESPISQANNNNLSRFNNHSPEENNNSPLSGSSATNTNETELSLMLKDLETAMMEPDVDNSYNNQGGFGQQHGVVSSAMYRSMEMISRGDLKGVLYECAKAVENYDLEMTDWLISQLQQMVSVSGEPVQRLGAYMLEGLVARLASSGSSIYKALRCKDPTGPELLTYMHILYEACPYFKFGYESANGAIAEAVKNESFVHIIDFQISQGGQWVSLIRALGARPGGPPNVRITGIDDPRSSFARQGGLELVGQRLGKLAEMCGVPFEFHGAALCCTEVEIEKLGVRNGEALAVNFPLVLHHMPDESVTVENHRDRLLRLVKHLSPNVVTLVEQEANTNTAPFLPRFVETMNHYLAVFESIDVKLARDHKERINVEQHCLAREVVNLIACEGVEREERHEPLGKWRSRFHMAGFKPYPLSSYVNATIKGLLESYSEKYTLEERDGALYLGWKNQPLITSCAWR

SEQ ID NO: 845 - protein, 852 aa, Zea mays
MTSSAAAAAAAAQVAGGGGGGEGDAAAAARGGGGTEDGMYTELWNLCAGPLVTVPRVGDKVYYFPQGHIEQVEASTNQVAEQHMQFYDLPWKILCEVMNVELKAEPDNDEVYAQLTLLPESKQPEENGSSEEMPASPPAALARPRVHSFCKTLTASDTSTHGGFSVLRRHADECLPPLDMTRQPPTQELVAKDLHGVEWRFRHIFRGQPRRHLLQSGWSVFVSAKRLVAGDAFIFLRGDSGELRVGVRRAMRQQANVPSSVISSHSMHLGVLATAWHAVNTGTMFTVYYKPRTSPAEFVVPCDRYMESLKRNYPIGMRFKMRFEGEEAPEQRFTGTIVGNVDPDQAGWAESKWRYLKVRWDEASSIPRPERVSPWQIEPAVSPPPINPLPVHRPKRPRSNAVASLPESSAPTKEAAPKVTLETQQHALQRPLQTQDNVAPKSVFGDNSELDSAHKSSLRPSGFDLDKSTIGMQRKLGSDIWMRMNRPDGYSEMLSGYQPPNEGARNSQGFCSLPDQIAAGRPNFWHTVNAHYQDQQGNHNLFPGSWSMMPSSTGFGMNRQSYPMIQEVGGMSQSCTNTKFGNGVYAALPGRGIDRYPSGWFGHTTPGGRVDDAQPRVIKPQPLVLAHGEALKMKGNSCKLFGIHLDSPAKSEPLKSPPSVATPAAEKWMADGIDADKSPEPHKTPKQLGATQTQVDPVPERCPQASRGTQCKSQGGSTRSCKKVHKQGMALGRSVDLTKFNGYTELVAELDEMFDFNGELKGCSKEWMVVYTDYEGDMMLVGDDPWNEFCSMVHKIFVYTREEVQRMNPGALNSRPEDSGLANSTERGSASTAAAREAPGYQSASSLNSDNC

SEQ ID NO: 846 - protein, 556 aa, Zea mays
  misc_feature (120)..(120): Xaa can be any naturally occurring amino acid
  misc_feature (127)..(127): Xaa can be any naturally occurring amino acid
MADTPTSRMVHPFGDVPRQTPKQFLYSGNPQHLCHPYQSAPDTHVVPQRRYTVRSQSHSPNNAGSQDHETHKQYTLESSAASGCSRHGSPSSQSVHAGSGSPVSHDDSHSGSTNGHGSPXVSASCVXTGEDPTDLKQKLKDLEAVMLGTSETDPEIVNSLEISAANQLSLEPEEWEHMVSMPRGNLKELLIACARAVERYNTYAIDLMITELRKMVSVSGEPLERLGAYMVEGLVARLAASGSSIYKALKCKEPRSSDLLSYMHFLYEACPYFKFGYMSANGAIAEAIKGEDRIHIIDFHIAQGAQWVSLLQALAARPGGPPFVRVTGIDDSVSAYARGGGLELVGRRLTHIAGLYKVPFQFDALAISGSEVEEEHLGVVPGEAVAVNFTLELHHIPDETVSTANHRDRILRLVKGLSPKVLTLVEQESNTNTAPFAQRFAETLDYYTAIFESIDLALPRDDRERINIEQHCLAREIVNLVACEGEERVERHEVFGKWKARLMMAGFSPSPLSALVNATIKTLLQSYSPDYKLAERDGVLYLGWKNRPLIVSSAWH

SEQ ID NO: 847 - protein, 263 aa, Festuca arundinacea
MSRKKKVRRRSTGPDSVSEIIKKWKEQNQKLQEENGARKAPAKGSKKGCMAGKGGPENSNCKYRGVRQRTWGKWVAEIREPNRGNRLWLGSFPTAVEAAHAYDEAARAMYGATARVNFSERSLDANSGCTSAPPVLMSNGPTAVSHPADGKDESESPSLRSDGPTATLRRSDAKDEPESAGTVVHEVKTEVSNDSTSVREERKTVEVFQPKGKALHKEEKVSYDYFNVEEVLDMIIVELSADRKMEVHEEYQDGDDGFSLFSY

SEQ ID NO: 848 - protein, 232 aa, Zea mays
IASGRSPHASGEMLNRQVVKSDSATIKIPELDFEIPPEAQRGTLSTVEGIIMRAVDELQALQDERKKVDPQKAEAIDQFLLKLRSLGSGEAAFTFILDDPAGNSFIENPHAPLLDPLLSVRFYERTREQQAALGFLAEPPKEQPGDAVLPASAVESNSDGLQSVPHGSVGAVAGRRAIAQGNPDEVAAALCRYSAPEEVDTLPSTCGACGTECVTRFFATSILSPDFHHFNV

SEQ ID NO: 849 - protein, 99 aa, Saccharomyces cerevisiae
MAATKEAKQPKEPKKRTTRRKKDPNAPKRRLSAYMFFANENRDIVRSENPDVTFGQVGRILGERWKALTAEEKQPYESKAQADKKRYESEKELYNATRA

SEQ ID NO: 850 - protein, 256 aa, Arabidopsis thaliana
MMQEEGNRKGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHMRKKAQEKKRPVSPTSSFSNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSG

SEQ ID NO: 851 - protein, 290 aa, Oryza sativa Japonica Group
MKVQCDVCAAEAASVLCCADEKTLCDACDHRVHRANKLAGKHRRFSLLNPSASGRSPTSTTAPLCDICQVRQEKQTIAFDLDTEGVIRVWRRGVSLFCKEDRAILCRECDVPVHTASELTMRHSRYLLTGVRLSSEPAASPAPPSEEENSSSFCCSADDAVPAPAAPATSHGGSSGSSSISEYLTTLPGWHVEDFLVDDATAEAAAAAAATSSGISANGPCQGVTRIGGLQESAGYPAWMAQQQLCCDGLVAGDASPASRERWVPQMYADQLAAGSKRSRTSTASSYSYW

SEQ ID NO: 852 - protein, 261 aa, Triticum aestivum
MSSSAMEALHALIPEQHQLDVEAAAAVSSATSGEESGHVLQGWAKRKRSRRQRSEEENLALCLLMLSRGGKQRVQAPQPESFAAPVPAEFKCSVCGKSFSSYQALGGHKTSHRVKQPSPPSDAAAAPLVALPAVAAILPSAEPATSSTAASSDGATNRVHRCSICQKEFPTGQALGGHKRKHYDGGVGAAASSTELLAAAAAESEVGSTGNGSSAARAFDLNIPAVPEFVWRPCAKGKMMWEDDEEVQSPLAFKKPRLLTA

SEQ ID NO: 853 - protein, 549 aa, Glycine max
ELEKLGADEEGNETTPTKSTPHMFCKTLTASDTSTHGGFSVPRRAAEDCFPPLDYKKQRPSQELVAKDLHGVEWKFRHIYRGQPRRHLLTTGWSIFVSQKNLVSGDAVLFLRGENGELRLGIRRAARPRNGLPESNSARESYYPNFLSSVANAISAKSMFHVFYSPRASHADFAVPYQKYIKSIKNPVTIGTRFKMKFEMDESSERRREFSDRTGMSDLDPYKWPKSKWRCLMVRWDEDIEISHQDRVSPWEIDPSSSLPPLSIQSSRRLKKLRPGLQAATPSHLTTGGSGFMDSEESVRSSKVLQGQENTGFMSLYYGCDKVTKQPEFEIRSPSHPNLASTGVRKISAAEFMRVHPSSFAGFSETNMFPRVLQGQEICPFRSLTGKADLNFGSWGKPNVSYSNNNLHQATKPSFHSLGPEVIQTAYFPYGDIHNAGQGSSILCSKPTNFQRENIPFNTPSTQSGIMRNEVGRSDITIPNEQKLQDNISGTASLGANMRIPKDDNFKGQVKACKLFGISLSGETTAQNLQNSAKRSCTKVSDDSNRVIL

SEQ ID NO: 854 - protein, 237 aa, Brassica napus
TKIKKKKKKKKKKDSIRQYVQRTQRLTHLSQDTKKEKTNAVRDSGKHPVYRGVRKRNWGKWVSEIREPRKKSRIWLGTFPSPEMAARAHDVAALSIKGASAILNFPDLAGSFPRPSSLSPRDIQAAALKAAHMEIIMTPSQSSTSSSSFTFSSSQSSSSLESLVSSSGTGSEELGEIVELPSLGSSYDGTTQLSNEFIFSDPADFWVYPPHQLLKSDYEMIPGSFSQDWDLSGLFNY

SEQ ID NO: 855 - protein, 61 aa, Physcomitrella patens subsp. patens
HYRGVRQRPWGKFAAEIRDSSRQGTRVWLGTFDTAEQAALAYDAAALKMRGRRALLNFPLR

SEQ ID NO: 856 - protein, 278 aa, Zea mays
  misc_feature (59)..(59): Xaa can be any naturally occurring amino acid
  misc_feature (262)..(262): Xaa can be any naturally occurring amino acid
MAATTPAPPSHGGGRNGTLPTPLPSNESFSKFFESWISEQSRDLEELRAAASADPPAPXAELRRLVGQVLGHYAQYYRAKAAAAADDVLCMFTPSWTSTTENLYLWCGGWRPTAAIQLLYTKSGMQLQHQLPAFLDGGGLKDDLGDLGAAQLQAADQLQRRTIRREREIEDAAASAQEALTTATMVELAGGGGRDAGAMDREMQAKAEGMRRVLEMADALRLETMREVVALLRPAQAVHFLLAAAELHLAVHDFGRRKDGRXATSPPPRRRSDGRWRA

SEQ ID NO: 857 - protein, 151 aa, Oryza sativa Indica Group
MGDVKGVGVDTLELVKPSQRAYECSVCGKVYWCYQALGGHMTCHRNLFAQVVAGDELSSDGTMVVKGHKCSICRLEFPSGQALGGHMRVHYVCGVEGGSVKEKNVVKTKVTGALKLVLKDFDLNVLVVATMVGDEAESSHSEAKARMMTLP

SEQ ID NO: 858 - protein, 242 aa, Vitis vinifera
MASSPQSSALHHIRHHLLSDSADSTTASTSSPLLQLLSHAAPSHNSPVSSPQSSNSSFSPNFARRKPTLSIAIPHPSPPPTAADSGHERHYRGVRRRPWGKFAAEIRDPNRRGSRVWLGTFDTAVEAARAYDRAAFRMRGSKAILNFPLEAGAPPEASQRNPSVRKRLRETEKNDRETVEVKVIKKEEIVESPVSDVTLANTSTAVACPLTPSSWTAVWDGADGNGIFNVPPLSPLSPLVMT

SEQ ID NO: 859 - protein, 513 aa, Oryza sativa Indica Group
MVLDLNEGFGEGSEEGGVGEDGDEEDDDEDDDDDDDDDGGSTSEVAGGGRSSSNNSSTNHNSGSDKDHDMNSSSSKADGGGDRVPTVRQYNRSKLPRLRWTPDLHMAFVHAVERLGGQERATPKLVLQMMNVRGLSIAHVKSHLQMYRSKKLDHESGHERGAISSVFSPMEFHMRRGDHRFHHHDMFFQRAAAAGVSPFSSRMLHENGGGFFASRNPGLPESSRLYGLFQRRQQAPMQKFDFKNCDSFSRNQEWAFNQQHAAARAAGAVNGHGPAKGLIHEMIFQKEGKPTSHLFDVRDAIASTRVTSATTAAAADHRLDGAGKAGNFDWIGSSSSRPLTRTMSAATAATMGDHHHLRWRGGAAGSGNTTASSDPVVASEAALGSLLERAKTKATEAMRLETPVKMTAAAVAAEEINSRTPDLQLSLSPNAGDHRSAGKKRKFLSEQEVDSDKQQLPLTLSLSLRGGGDNGGGGGGGEAAGRLEEEMTGSSSSKKAALGLSTLDLTMSIKALE

SEQ ID NO: 860 - protein, 529 aa, Arabidopsis thaliana
MKIEIQCMENKQPLAASCSSASEGSGCFFLKSPEIATPATVSSFPRRTSGPMRRAKGGWTPEEDETLRRAVEKYKGKRWKKIAEFFPERTEVQCLHRWQKVLNPELVKGPWTQEEDDKIVELVKKYGPAKWSVIAKSLPGRIGKQCRERWHNHLNPGIRKDAWTVEEESALMNSHRMYGNKWAEIAKVLPGRTDNAIKNHWNSSLKKKLEFYLATGNLPPPASKFIVLKDIADGDRDSKQSSATKPFKDSDSLTQTSSGNTDSNEVGRDHFDSSSALLEEVAASRRIGVNEYACSPVEYKPQLPNLEPISEEVRINSKAYFERSIQRKVENGFGTPKHGNLYYKSPLDYYFPSEADLQHMYGYECGCSPGAASPVSLMTTPCNKDSGLTATRSPESFLREAARTFPNTPSIFRKRRKVVLAAKTDAVVVVNGVVKEVDRKEESKDMRKSLLLETTDNCSDDEELGLNGNAFNLSPPYRLRAKRTAVIKSRQLEFTSEKEKQPDNEIEFTSAKEKQPDNEIKTSEEDKPV

SEQ ID NO: 861 - protein, 475 aa, Physcomitrella patens subsp. patens
MAGGGGIKGAVNNNVATAMAIAGRDSRACDVCGLHRARWYCSVDNAHLCRRCDQNVHSANALALHHERVRLDLQGNALHTPRKALKGNTSAPQNSLKSAAQMDHAAPSRKSFRQSRRPNTDASPPNSHKINRRGKEKSDSSHEVPNFVTVNIHESPFSFTHDSATAMSIAEYCKGRAAAAAAMAADVDTNEELSSGDSDQYLVPNGYLDDFESATVPTPGCRQQGCDPSDDAASNDALDDGEGKDQYDSGAFDQTNGLEFKRGSDQDRINEKYRLGFSEVVGMRDADDFEGESGYTEGEGEVEDEAYDQSCAYGDPERQRVSPFVKDLKSEYDVLDRLDLIKREVAAVLRCSLEAQEKKSAPPPLLRLNFDDVLSAWSDRSLWTDGRRPQTVPDDSSEAVGGTDVGLVPDINTQYAQGATLAAGDKGREFRVMRYKEKRRTRLFSKKIRYEVRKLNAERRPRMKGRFVKQTPGGS

SEQ ID NO: 862 - protein, 390 aa, Oryza sativa Japonica Group
MGSSGADAPTKTSKASAPQEQQPPASSSTATPAVYPDWANFQGYPPIPPHGFFPSPVASSPQGHPYMWGAQPMIPPYGTPPPPYVMYPPGVYAHPSMPPGAHPFTPYAMASPNGNADPTGTTTTAAAAAAGETDGKSSEGKEKSPIKRSKGSLGSLNMITGKNSTEHGKTSGASANGAISQSGESGSESSSEGSEANSQNDSHHKESGQEQDGEVRSSQNGVSRSPSQAKLNQTMAIMPMTSSGPVPAPTTNLNIGMDYWANTASSTPAIHGKATPTAAPGSMVPGEQWVQDERELKRQRRKQSNRESARRSRLRKQAECEELAQRAEVLKQENTSLRDEVNRIRKEYDELLSKNSSLKEKLEDKQHKTDEAGVDNKLQHSGDDSQKKGN

SEQ ID NO: 863 - protein, 210 aa, Glycine max
MASSSSMISNPVPNTDRSRDAKRRKKKAQLRQQQQRQEDQSNPKWKSQAQQQIYSSKLRQALARVNLGLAPPPRRGKAVRDAADRVLAVTAKGMTRWSRAILTNRLKLKFTKHKRQRLTTPPTRSKKPRVSVYRLKGKGSPGVQRKVRFLARLVPGCRKEPLPVILEEAIDYIPALEMQVRAMSALFNLLSGSSSSSGAAASPSAPPSSS

SEQ ID NO: 864 - protein, 366 aa, Oryza sativa Indica Group
MVTSKEFARDQAAMDQKIKSDVGEVVLAGDEEEDGDVVLPGFRFHPTDEELVTFYLRRKVARKSLSIEIIKEMDIYKHDPWDLPNASTVGGEKEWYFFCLRGRKYRNSIRPNRVTGSGFWKATGIDRPIYSAAVNSNSGESIGLKKSLVYYRGSAGKGTKTDWMMHEFRLPPAIAAADASPCMQEAEVWTICRIFKRSITYRKQQQQQAWRPPAPAPATVTVKAPPPGDSSSNTGSFESDGGGDEFMNCGLTPAISQQQQHGGRHQMMSTMSCNGGYFFNDGIHHSHSHHKLHSQWGSLQMAPPEPKPEPEQKPLSSPAMTIAFHQNDHGFPAAAADFYKDGYLEEIARMMEVADPSPTGFYDCRY

SEQ ID NO: 865 - protein, 303 aa, Triticum aestivum
  misc_feature (97)..(97): Xaa can be any naturally occurring amino acid
LSRRGWPGAAAQQQKGGSGGGGGAVRVGGGGPAPFLTKTHQMVEERGTDEVISWSEHGRSFVVWKPVELARDLLPLHFKHCNFSSFVRQLNTYGFRXVPDRWEFANENFRRGEQGLLSGIRRRKATATTTTPQSSKTSGTGVNVAFPPPLPALPPASASTSGTGNDHSSSSASSPTRPDLSSENEQLRKDNHALAAELALARRHCEELLGFLSRFLDVRQLDLRLLMDGDMQGAAGGARSADQEHCCEKKVKLFGVILKDASARKRGRCDEAAASERSMKMTRIGEPWVGVPSSCPARCGGGN

SEQ ID NO: 866 - protein, 350 aa, Zea mays
  misc_feature (84)..(84): Xaa can be any naturally occurring amino acid
  misc_feature (99)..(99): Xaa can be any naturally occurring amino acid
  misc_feature (260)..(260): Xaa can be any naturally occurring amino acid
MGAMTLPPGFRFHPTDDELVGYYLKRKVDNLKIDLEVIPVVHLYKSEPWELPEKSLLPRRDLEWFFFCPRDRKYPNGSRTNRAXSTGYWKATGKDRRIXCDGGVYGLRKTLVFYRGRAPGGERTAWVMHEYRLCQDLAHGTCNFIGAYALCRVIKRHEGGLPQGESYAKGAAGSARSGQMSKVSSSSSLVSNDQLSASFTPPPTLDVGTMAGSGNAFQSPVGYGYGVPTTATATATTAGLPSSALAPPLLIVPSPHDTFXSSAAAATATSSLPRPSRARSHAHLFDTVGMGMGGVSEQELKWDSFACPSTFSSGADMAAASPATLCRQASDGFDDLLAAFFFSDDNRIVF

SEQ ID NO: 867 - protein, 362 aa, Arabidopsis thaliana
MFPSLDTNGYDLFDPFIPHQTTMFPSFITHIQSPNSHHHYSSPSFPFSSDFLESFDESFLINQFLLQQQDVAANVVESPWKFCKKLELKKKNEKCVDGSTSQEVQWRRTVKKRDRHSKICTAQGPRDRRMRLSLQIARKFFDLQDMLGFDKASKTIEWLFSKSKTSIKQLKERVAASEGGGKDEHLQVDEKEKDETLKLRVSKRRTKTMESSFKTKESRERARKRARERTMAKMKMRLFETSETISDPHQETREIKITNGVQLLEKENKEQEWSNTNDVHMVEYQMDSVSIIEKFLGLTSDSSSSSIFGDSEECYTSLSSVRGTISAAGMSTPREHNTTSIATVDEEKSPISSFSLYDYLCY

SEQ ID NO: 868 - protein, 445 aa, Oryza sativa
  misc_feature (275)..(275): Xaa can be any naturally occurring amino acid
MDGNARSAANQTKQIVTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRIHEKMRALQELIPHCNKVRNIIIYASFFXSGASPWTDTAMLTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQVSGPYASGPQVAQQNQIPKASASTVLPNSGAEQPPTSDGI

SEQ ID NO: 869 - protein, 52 aa, Brassica napus
  misc_feature (22)..(22): Xaa can be any naturally occurring amino acid
MEDDGGSDGGEGNGGFSPNSSXGAFPEMPMDLDLDELFFDGCWLETTDLKQS

SEQ ID NO: 870 - protein, 148 aa, Brassica napus
NSTTATNSSIFQSQEQERKNQSDQKWSQTLNNSNTHQAVSYNVREQRKGEDCYNWRKYGQKQVKGSENPRSYYKCTFPSCPTKKKVERSLEGQITEIVYKGSHNHPKPQSTRRSSSSSSTFHSAVFNASLDNSFSHSDSLAIQQDDNT

SEQ ID NO: 871 - protein, 198 aa, Trillium camschatcense
QVTFSKRRNGLLKKAFELSVLCDAEVGVIVFSPRDKLYEFSSTSMQSTIDRYRMHTKCVNTNMPTEHNTQQWKYEAVSMANKIELLEASKRKLMGESLEPCTVDELQELESQIERSLSNIRGRKDYLLEQQIEELKEKERRLLEDNELLRHKSEEETELQLATPKGVQYDHGSQQMELETELHIGWPPKVATQCISHA

SEQ ID NO: 872 - protein, 278 aa, Oryza sativa Japonica Group
MENLSCLISSPLPMPMPEYELAACSPASPSSSASSTSTPPSPGGEAAARCGEKRGRGGGGGRHPTYRGVRMRAWGKWVSEIREPRKKSRIWLGTFPTPEMAARAHDAAALVVKGPAAVLNFPGAAASLPRPASAAPRDVQAAAARAAAMALDAVVPAPPSPPPPLMPPQASPSEAARAHALVAQVDQDDDDEELEEIVELPPIDELDAAAELVFASSGATTFHYDPAADQPWYDQPAACLQDGGGGGIAVHDALGFELDHVWADGVVASGFGALLWNM

SEQ ID NO: 873 - protein, 409 aa, Arabidopsis thaliana
MMFNANERNVLDENSNSNCSSYAAASSGFTLWDESASGKKGQTRKENSVGERVNMRADVAATVGQWPVAERRSQSLTNNHMSGFSSLSSSQGSVLKSQSFMDMIRSAKGSSQEDDLDDEEDFIMKKESSSTSQSHRVDLRVKADVRGSPNDQKLNTPRSKHSATEQRRRSKINDRFQMLRQLIPNSDQKRDKASFLLEVIEYIQFLQEKADKYVTSYQGWNHEPAKLLNWQSNNNQQLVPEGVAFAPKLEEEKNNIPVSVLATAQGVVIDHPTTATTSPFPLSIQSNSFFSPVIAGNPVPQFHARVASSEAVEPSPSSRSQKEEEDEEVLEGNIRISSVYSQGLVKTLREALENSGVDLTKASISVEIELAKQSSSSSFKDHEVREPVSRTRNDNVKQTRKPKRLKTGQ

SEQ ID NO: 874 - protein, 111 aa, Physcomitrella patens subsp. patens
MAGGRSSPAQQASSVDQKSKSNDSVPVHNSESSPTVARAPIQKPPRSLNYRGVRRRPWGKFAAEIRDSAQNGARIWLGTYDTAYDAACAYDQAAFEMRGCKALLNFPLKAN

SEQ ID NO: 875 - protein, 272 aa, Triticum aestivum
MDAQYNPRTVEEVFRDYKGRRNGLARALTTDVEEFFRQCDPEKENLCLYGFPNEHWEVNLPAEEVPPELPEPALGINFARDGMQEKDWLSMVAVHSDAWLLSVAFYFGARFGFDKSDRKRLFGMINELPTIFDVVSGKSKTKAPTNNNHSNSKSKSNNKMKTSEPRAKQPKPQLKEEDHEDEAPDAGEDGGGAAGGGGGGEEHGDTLCGACGDNYGQDEFWIGCDMCEKWFHGKCVKITPAKAEHIKQYKCPSCMGANGGGSGSNKRARPSS

SEQ ID NO: 876 - protein, 195 aa, Thellungiella halophila
MTKMGFKPDSNPSPNPNESNAKEIRYRGVRKRPWGRYAAEIRDPGKKTRVWLGTFDTAQQAARAYDAAAREFRGAKAKTNFPTFLELNAAKDGGFARSPSQSSTVDSVSPTSARLVTPPQLELSLGGGGGGACYQIPVARRPVYFYNMTTFPAAAAATCGVQSESDSSSVVDFECGAEKKYRPLDLDLNLAPPAE

SEQ ID NO: 877 - protein, 123 aa, Oryza sativa
AQLPTLLLGVSSGNLGDLSPSQLAQIDDLQRRTVAEEDGLSREMALVQEGHGAVAVGGGIDVDGIVGRVRGVLGRADALRLRTVKRAVEILEPAQAAELLVAAADMEIGFREFGLKYSSARSD

SEQ ID NO: 878 - protein, 193 aa, Arabidopsis lyrata
SYTPGDTQTGPVISVPESEKIMNAYRFPNNNNNEMIKKKRLTSGQLASLERSFQEEIKLDSDRKVKLSRELGLQPRQIAVWFQNRRARWKAKQLEQLYDSLRQEYDVVSREKQMLHEEVKKLRAILRDQGLIKKQISAGTIKVSGEEDTTEVSSVVVAHPRTENLNTNQITGGNQVYGQYNNPMLVASSGWLS

SEQ ID NO: 879 - protein, 326 aa, Zea mays
  misc_feature (248)..(248): Xaa can be any naturally occurring amino acid
MNFLESIAVNGHRDRQHGGVMSRQSMVAVEQLTGPASARPAHTCAAQPHAHQLLSARYDHRGACASQVELPDRISPSNASTFCTSMYSSSSSSSAAADSSKSCRRAGALPFLPHPPKREQQQQQQSSSSPSLLVCTDLGNGGQDEAEAEHPAELKDFLNLSGEASWRGGFHGESSGVAFRFGEKVEFQFLSEQLGIAITDHDESPRLDDQEDIYDRPPQTSSCPVLSCSNQEEGLQRAGSPVKAQPSXSRAASCNNKPRLRWTLELHELFVKAVNKLGGPEKATPKGVLRLMKVEGLTIYHVKSHLQKYRFAKYLPETKEGTFSEA

SEQ ID NO: 880 - protein, 741 aa, Oryza sativa Indica Group
MAAFSSSNGVPPGFRFHPTDEELLLYYLKKKVGFEKFDLEVIREVDLNKIEPWDLQERCRIGSAPQNEWYFFSHKDRKYPTGSRTNRATTAGFWKATGRDKCIRTSYRKIGMRKTLVFYRGRAPHGQKTDWIMHEYRLEDADDSQSASSEDGWVVCRVFKKKCFFKIGGGGGGEGSGGSQGGDVGGGHLAVSPPLGGGHAMAAASHYMHPHHQYHHHHHHAAAASPFYYTQMPPPPAAAPPHAAYSHHVQFPSTQCNVHLLQIIEAFQKCHVDHPVKKFFGECTDLKIKLDQCFRQEKALKRKANFEESRSSKNQLLAYKKEMAEPRPRNHNPIYRNKDNYVICPFKFQVNQDTRTSRGAGEREKMDPVPLFNPCEMGRFTFSHRIVLAPLTRARSYGNLPQSHAILYYSQRATKGGLLISEATGVSSDAPCTNTPGIWTKEQVEAWKPVVDAVHAKGGIFFCQIWHVGRASDLEQEPISSTDKPVEKNEDMDFPVPRRLAVEEIPDVINHFRIAARNAIDAGFDGVEVHGAHGFLLEQFMKDGVNDRADEYGGSLQNRCRFALEVIDAVSTEVGPDRVGFRISPYISYYGCHDSDPDALGVYMARELDRRGVLYCSAVEPEMVAATTVVDCETTTTTMSRRMMIPHRLHGMREAFRRGMFMVGGGYDRDAGNMAVASGYADMVVFGRLFLANPDLPRRFQLDAPLNKYDRATFYTHDPVVGYTDYPFLDDDREAMSDHTG

SEQ ID NO: 881 - protein, 284 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDNSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 882 - protein, 467 aa, Oryza sativa Japonica Group
MSTQSVIAVKQFSGPDKIAQAYTVPQPSAHVLSNANYDYDLCGSTNSTSLSCAIQSSNIKTESISSSSLPKILPFSTDSNGESSLSRMSQAEFSDPILSSSSTFCTSLYTSSPMNSGSCRKTGYLPFLPQPPKCEQQQNSAGQSSSSLMLLDADLRNSGHADDEHTDDLKDFLNLSSDCSFHGKCSAMAYNEQMEFQFLSEQLGIAISNNEESPRLDDIYDRPPQLMSLPVSSCSDQEDLQDARSPAKVQLSSSRSSSGTASCNKPRLRWTPELHERFVDAVNKLEGPEKATPKGVLKLMKVEGLTIYHIKSHLQKYRLAKYLPETKEDKKQEEKKTKSVANGNDHAKKKSAQMAEALRMQMEVQKQLHEQLEVQRQLQLRIEEHARYLQKILEEQQKARESISSMTSTTEGESPEFAPMEKTEDKAETSSAPLSKCRITDTDAECHSKVDNKKTKPQADLEMVHDE

SEQ ID NO: 883 - protein, 284 aa, Vitis vinifera
METLYPASHISTSNWWLQDSNSTLWTKEENKRFERALAIYDENSPDRWLKVAEMIPGKTVWDVIQQYKILEEDVNDIEAGMFPIRGYLAPSFTLELVENRGLDALRKRTATMVRASDQERKKGVPWTEDEHRRFLMGLIKHGKGDWRNISRNFVVSKTPTQVASHAQKYFARQLSGGKDKRRPSIHDITTVNLTDTTPPENNKSPSLHHSTALQSQQKSTGAPKVILDWDHSNDGALMVFNSTHGNLFMPSPYEVASFGTHHGAHIVPRNPVFQIQSARHQVRG

SEQ ID NO: 884 - protein, 183 aa, Lupinus paraguariensis
SGPYPSSSSSYHPFAFFNPENASSNNTFSHDLLSFPYNTPTTHHYHAPIPETLSNFADCAASAAMFKNDVSGSNFGFSNFLAKKPASKKDRHSKIHTSQGLRDRRVRLSIEIARKFFDLQDMLGFDKASNTLEWLFNKSKKAMKELARSKNSSSGVVANSFSSSDSECEVVSMINQDSIDATP

SEQ ID NO: 885 - protein, 183 aa, Lupinus paraguariensis
SGPYPSFSSSYHPFAFFNPENASSNNTFSHDLLSFPYNTPTTHHYHAPIPETLSNFADCAASAAMFKNDVSGSNFGFSNFLAKKPASKKDRHSKIHTSQGLRDRRVRLSIEIARKFFDLQDMLGFDKASNTLEWLFNKSKKAMKELARSKNSSSGVVANSFSSSDSECEVVSMINQDSIDATP

SEQ ID NO: 886 - protein, 456 aa, Zea mays
MDNHIHSQPAANLYYQFGMGTEQQYPPPFASPPSTNIPHMDWNPATMLDNLTFIEEKIQQVKDVIRTMVDNAGQVQVQCHHQAGELLAQKQKQQVVNADLTCLIVQLISTAGSLLPSLKNSSFLSHPHPAGHVDMANHVGPSSSLVPNAMTVSEDYEELFKGWTDGGIEVDDDGVLVEEQEITKDGDSLSYELLQLEEDEILAPHTHFCTICGKGFKRDANLRMHMRGHGDEYKSPAALAKPPRDPGAEQEPAKRRYSCPFAGPLKTILCVKNHYRRSHCEKSHTCGRCHAKKFSIVADLRTHEKHCGRRDRWVCSCGTSFSRKDKLFAHVALFQGHTPALSSPLEEEPPKACSDQHQTGRAGSRREPAKVPAGSVGGGSGSSFVWGASSSGENSALDIKGFVDGCSGDFLSTANFGSFNLSFGPADGFTGEPSSGGSFSMLPPEHFQSAQKKGQN

SEQ ID NO: 887 - protein, 819 aa, Pisum sativum
MAACALFNGVGGGNTTPDETNNNSTSNSSNISTEDFHNMPQQQPHHSERKLLRKRMASEMELQLHNNNNNNDYHRFSRRTNNTSSLNCSLPATTQKGVTTTTTTTLASSGNNNNNNNNNNNYHYHNNNNNSIINNNNNNVALSRDNVAIQNFPTVTVTTNYSTMLLPSSCSSNLNNSSTSAANYTHYQQPLVEEQNTLPEICGFSGLPLFPSQNNQTNRTNNNSSNNRNNTNTVVDVVSSSPSMEETSATTNWIDGILKDLIHTSNSVSIPQLINNVREIIYPCNPNLALVLEHRLRLLTEPNTCVPERKRNSTEQSGVNVNGNVLAASNVNNSSVKLMNRVDDVVPTSLHFSDSSTLLNQNQNQNMFPNWGATQINNNNNPSVSLVTLPSQPLSTQQDQQHQLQQHPEDLAPATTTTTTSAELALARKKKEEIKEQKKKDEEGLHLLTLLLQCAEAVSAENLEQANKMLLEISQLSTPFGTSAQRVAAYFSEAISARLVSSCLGIYATLPVSSHTPHNQKVASAFQVFNGISPFVKFSHFTANQAIQEAFEREERVHIIDLDIMQGLQWPGLFHILASRPGGPPYVRLTGLGTSMETLEATGKRLSDFANKLGLPFEFFPVAEKVGNIDVEKLNVSKSEAVAVHWLQHSLYDVTGSDTNTLWLLQRLAPKVVTVVEQDLSNAGSFLGRFVEAIHYYSALFDSLGSSYGEESEERHVVEQQLLSREIRNVLAVGGPSRSGEIKFHNWREKLQQCGFRGVSLAGNAATQASLLLGMFPSEGYTLVEDNGILKLGWKDLCLLTASAWRPPYHTNTIIPHHN

SEQ ID NO: 888 - protein, 217 aa, Oryza sativa
  misc_feature (146)..(146): Xaa can be any naturally occurring amino acid
MAKTKQGKKDVESYTIKGTTKIVRVGDCVLMRASDTEKAPYVGRVERLETDGRGSVRVRVRWYYRPEESKGGRRQFHGAKELFLSDHFDTQSAHTIEGKCVVHSFKNYTKLDNVGPEDFFCRFEYKAATGAFTPDRVAVYCKCRDXPYNPDDLMVQCEGCKDWFHPSCMGMTIEQAKKLDHFLCADCVKENGTKRPSNSYPASSNSDSKVEPKKRKR

SEQ ID NO: 889 - protein, 423 aa, Brachypodium sylvaticum
MEAYCSSLVKDELINGGGGGAGGMRYCEAAPRVSPPVAIKSVKRRKREPPAVSGMTTVSGGGGGNGKDGDKSAGNAAAAKRSSRFRGVSRHRWTGRFEAHLWDKGTWNPTQKKKGKQVYLGAYNEEEAAARAYDLAALKYWGPTTYTNFPVVDYEKELKVMQGVSREEYLASIRRKSNGFSRGVSKYRGVARHHHNGRWEARIGRVFGNKYLYLGTYSTQEEAARAYDIAAIEYRGINAVTNFDLSSYIRWLKPNSAANTNTPPAAAAELAILGGAPAALISPAPAPTTMRVPRLLPPLVRGRGGSIPDDVSAGGSCVFGSPSPSPSPTTTSALSLLLRSSVFQELVAQQQPPSIVDDDDGVGGQEAVSDAAERAAEENEESFGEVLYGAGEGEAAAAFSCSMYELGLDDSFARIEESLWGCL

SEQ ID NO: 890 - protein, 251 aa, Glycine max
MCMMEGDENIQASTKGKNVESFTSLEAPRKKSKKIENKRRFSDEQIRSLECIFESESKLEPRKKMQLARDLGLQPRQVAIWFQNRRARWKSKRIEQEYRKLKDEYDNLASRFESLKKEKDSLQLELQKLSDLVVTSQDGGREDKDGKENSIEDGGSGSGYSSWKPEAKKPRFSNDEGLEERIGVYSDDQNENSIIRGVEKSEDKGHQLLRMDDHDHADMPLASLEKWYSGVDPSGILDQSCSSSQWLDFWT

SEQ ID NO: 891 - protein, 216 aa, Zea mays
VVGGAASEASVAGAGAGGPSPSDLTELMKAQIASHPRYPSLLSAYIECRKVGAHPHVTSLLEEVSRERRPDAGAGEIGVDPELDEFMDAYCRVLVRYKEELTRPFDEAASFLSSIQAQLSDLCSGGSSPAATATHSDDMMGSSEDEQCSGDTDVPDMGQEHSSHLGDHELKEMLLKKYSGCLSRLRSEFLKKRKKGKLPKDARTVLLEWWNTHYRW

SEQ ID NO: 892 - protein, 151 aa, Brassica napus
  misc_feature (146)..(146): Xaa can be any naturally occurring amino acid
MASSPLTTNVQGAKTTEKPKIQFSDQEGNDYAPKVRKPYTITKERERWTDEEHNKFVEALKLHGRAWRKIEEHVGTKTAVQIRSHAQKFFSKVAKEASGGNGSSLEPIVIPPPRPKRKPSHPYPRKLGNEGDQASRSVSPSERDRXSPTSV

SEQ ID NO: 893 - protein, 247 aa, Glycine max
MFPLQRGNELVIQFSNGHHPQHKISQDLILDDQDIDQSPLVGYSDKKLRTSRPKKLFYHEADTCHANSNQEYTKKMVHREIEKQRRQEMATLHASLRSLLPLDFIKGKRSISDQMNEAVNYINHLQKNIKELSDKRDKLKKKPSIINSSPEDHENYKHASSGFTVHQNSGGAVGIEISGFSEEEVPLSKLLELVFEEGLEVVSCLSTKVNGRLLHSLQCEVDNSDSVDLSELRRKFSNVIPSLRCSE

SEQ ID NO: 894 - protein, 189 aa, Glycine max
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAMDLSSASDELSQIIELPSLESTDDGSVVLEKEFVFVDSLDAWMYQPPFGFDTEQDTGFEV

SEQ ID NO: 895 - protein, 217 aa, Brassica napus
  misc_feature (192)..(192): Xaa can be any naturally occurring amino acid
MADRAKGPWSQEEDEQLRRMVEHYGPRNWSEVSKSVPGRSGKSCRLRWCNQLSPVVEHRPFSSDEDKTIVSARATFGNKWATIARLLNGRTDNAVKNHWNSTLKRKCLGGGGDGNLIVMTTEDQDRRKKRRSVSSESATPVDTGLYMSPESPTGIPPPPSPPSPVDAQLLKPMAMPSPAEMSSVEEDPTAVXSLSLSLPGADVRQGVKPHNSFAVSA

SEQ ID NO: 896 - protein, 952 aa, Arabidopsis thaliana
MEAESSTPQERIPKLRHGRTSGPARRSTRGQWTAEEDEILRKAVHSFKGKNWKKIAEYFKDRTDVQCLHRWQKVLNPELVKGPWTKEEDEMIVQLIEKYGPKKWSTIARFLPGRIGKQCRERWHNHLNPAINKEAWTQEEELLLIRAHQIYGNRWAELTKFLPGRSDNGIKNHWHSSVKKKLDSYMSSGLLDQYQAMPLAPYERSSTLQSTFMQSNIDGNGCLNGQAENEIDSRQNSSMVGCSLSARDFQNGTINIGHDFHPCGNSQENEQTAYHSEQFYYPELEDISVSISEVSYDMEDCSQFPDHNVSTSPSQDYQFDFQELSDISLEMRHNMSEIPMPYTKESKESTLGAPNSTLNIDVATYTNSANVLTPETECCRVLFPDQESEGHSVSRSLTQEPNEFNQVDRRDPILYSSASDRQISEATKSPTQSSSSRFTATAASGKGTLRPAPLIISPDKYSKKSSGLICHPFEVEPKCTTNGNGSFICIGDPSSSTCVDEGTNNSSEEDQSYHVNDPKKLVPVNDFASLAEDRPHSLPKHEPNMTNEQHHEDMGASSSLGFPSFDLPVFNCDLLQSKNDPLHDYSPLGIRKLLMSTMTCMSPLRLWESPTGKKTLVGAQSILRKRTRDLLTPLSEKRSDKKLEIDIAASLAKDFSRLDVMFDETENRQSNFGNSTGVIHGDRENHFHILNGDGEEWSGKPSSLFSHRMPEETMHIRKSLEKVDQICMEANVREKDDSEQDVENVEFFSGILSEHNTGKPVLSTPGQSVTKAEKAQVSTPRNQLQRTLMATSNKEHHSPSSVCLVINSPSRARNKEGHLVDNGTSNENFSIFCGTPFRRGLESPSAWKSPFYINSLLPSPRFDTDLTIEDMGYIFSPGERSYESIGVMTQINEHTSAFAAFADAMEVSISPTNDDARQKKELDKENNDPLLCWTSTIASLQSKQQKKSHPTS

SEQ ID NO: 897 - protein, 164 aa, Thellungiella halophila
MGLSSLPGPSEGMLCVILVNTALSISIFKGIVRSVLHVLGIRLSQSSSSPSSVTASSEIPASEPFDFRVSHPESFLEEFRNKTPTLRYESLCRCKKHEDNECSVCLSKFEEDSEINKLKCGHLFHKTCLEKWIDYWNITCPLCRTPLVVVAAAEDQKQLSSNVW

SEQ ID NO: 898 - protein, 1157 aa, Arabidopsis thaliana
MVSHKVLEFGDDGYKLPAQARAPRSLRKKRIYEKKIPGDDKMCAIDLLATVAGSLLLESKSPVNACLVVQNTVKNEYPADENPVKAVPYSESPSLFDNGKCGFSSVITNPNHLLVGDKVGKEVEGFSSLGVSGDVKPDVVASIGSNSSTEVGACGNGSPNESRDDVNLFSRNDDDENFSGYIRTRMTRPVPRIGDRRIRKILASRHWKGGSKNNTDAKPWYCSKRSYYLHHHQRSYPIKKRKYFDSVYDSNSDDYRLQGKTHKGSRTISSMKSRNASFVSRDHHVKLRIKSFRVPELFVEIPETATVGSLKRMVMEAVTTILGDGLRVGLMVQGKKVRDDGKTLLQTGISEENNHLDSLGFSLEPSLETTPQPLLSSYLSDHACDDVTLCHDNALDSSHEPEPSPADSFGKLGTSDHSRALIPVASAAMLAPRPPNRKFKRTEQQLAAQRRIRRPFSVTEVEALVQAVEKLGTGRWRDVKVRAFEDADHRTYVDLKDKWKTLVHTARISPQQRRGEPVPQELLDRVLKAHAYWSQHLMHQLQTEPPSTQFMVHMCPILGKNTQKLVLVSERFCFMDAILPVPVDGFRFDTGSGSCCKPRNNLESGTTNRFTCFNESESQSNPSPTESKVCSDYLPVFKYINDMLMEEDLEGQSCMLEDSLALQAAERSFFEVLQDQTPISGDLEDGSLGNFSSITSLHQPEVSEESTRRYRHRDDDEDDDLESGRKSKLPAISTVDELAEKFEEVLLVCQKNDQGEATEKKTRHVKGSSNRYKQQKSDQPVDMRNLLMQCAQAVASFDQRRAFEKLKEIREHSSRHGDATQRLGYHFAEALEARITGTMTTPISATSSRTSMVDILKAYKGFVQACPTLIMCYFTANRTINELASKATTLHIIDFGILYGFQWPCLIQALSKRDIGPPLLRVTGIELPQSGFRPSERVEETGRRLKRFCDKFNVPFEYSFIAKNWENITLDDLVINSGETTVVNCILRLQYTPDETVSLNSPRDTALKLFRDINPDLFVFAEINGTYNSPFFLTRFREALFHCSSLFDMYETTLSEDDNCRTLVERELIIRDAMSVIACEGSERFARPETYKQWQVRILRAGFRPAKLSKQIVKDGKEIVKERYHKDFVIDNDNHWMFQGWKGRVLYAVSCWKPAKK

SEQ ID NO: 899 - protein, 256 aa, Oryza sativa Indica Group
MDGGYGSVTIVHDARSPEDVFQDFCGRRSGIVKALTIEVEKFYKQCDPEKENLCLYGLPNGTWAVTLPADEVPPELPEPALGHNFARDGMQEKDWLSLIAVHSDSWLLSVAFYFGARFGFDKKARERLFMMTSSLPTVFEVVSGGVNTQSKTANGSSKNKSGSKPPKRPNSDSKPQKQVQAKYEEENGGRGNGGDEDQAETICGACGEAYANGEFWICCDICETWFHGKCVRITPAKAEHIKHYKCPGCSNKRTRE

SEQ ID NO: 900 - protein, 130 aa, Arabidopsis thaliana
GSSGSSGRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDASGPSSG

SEQ ID NO: 901 - protein, 438 aa, Triticum aestivum
MAGGSTSPRAQTRSSTSSWMPTATCSQSTSSCDPRFRPRVRHTRSSFIHLPASSSSFLPPSVHPQVSSSTTTSLLFSRVHPISFLVRVSWPCRLFLICRFSAQIMERFPNLGGGGGSGSSSSSASMASFLQLPPPSASSPSPELAGEQHGSRLALQQLLAVPPPSAQQRREISPADAATIKAKIMAHPLYSPLLASYLDCQKVGAPPEVLERLSAVAAKLDAGHGRGKHESPRPDPELDQFMEAYCNMLAKYREELARPIQEATEFFKSVETQLDSITFTDSTNCEGAGSSEDELDTSCVEEIDPSAEDKELKHQLLRKYGGYVGSLRQEFCKRRKKGKLPKEARQKLLHWWELHSKWPYPSETEKIALAESTGLDQKQINNWFINQRKRHWKPAPEDMPFSVMDGGVGVSFLPAPQGPALYMDRAPFMVDGMYRLGS

SEQ ID NO: 902 - protein, 244 aa, Solanum lycopersicum
MGRGKVELRKIENKINRQVTFSKRRGGLVKKAHEISVLCDAEVALIVFSQKGKIFEYSSDSCMEQILERYERYSYAERRLLANNSESPVQENWSLEYTKLKARIDLLQRNHKHYMGEDLDSMSLKDLQNLEQQLDSALKLIRSRKNQLMHESISELQKKERAILEENNMLTKKIKEKDKIVEQQGEWHQQTNQVSTSTSFLLQPHQCLNMGGNYQDEVAEARRNNELDLNLDSLYPLYNMNKHL

SEQ ID NO: 903 - protein, 139 aa, Guazuma ulmifolia
TEIIYKGTHDHPKPQPSRRYSSGNIMPGQEERSDKVSSFTGRDDKSSGMYGQMANSIEPNSTADLSPVTANDDNIDEVDDDDPFSKRRKMDGGIDITPVVKPIREPRVVVQTLSEVDILDDGYRWRKYGQKVVRGNPNP

SEQ ID NO: 904 - protein, 420 aa, Brassica rapa subsp. pekinensis
MVEVEELEPLTPVEEEEEEVISYDDLKRRMWKDRNLMEKLKQQKRHSNDVVSLASHRAEASRRKKMARSQDSVLKYMMKIMEVCKAKGFVYGIVPDKGKPITGSSDSLRRWWKETVQFDQTAPNAVSDYLTIAAAAAAEMIEKEPSSLLHMLQELQDTTLGSLLSALMQHCVPPQRRFPLEKGIAPPWWPTGTELWWGEQGEAHEHGVPPYRKPHDLRKSWKVSVLAAVIKHMSPDLGRVRRLATQSKCLQDKMMAKETDTWSRVLNQEEALLNIKDRKISDQDQEASGSKTKRKCDFMEPSKRPRSDVTQEPRQITGDMISMLVTSPSIGTNTTSEDDYSVSSSAMGKPDDYDSNWMDYLWFERMQPEFNSSRRFDDDEDNPMVLNQSTESNQSDNVSQSIFSVWDMGCEDKDIYMFDY

SEQ ID NO: 905 - protein, 264 aa, Zea mays
QFVVRLCLQRAVMDVVNSIMEGGLRVGVLLQGKDIQDDNKTLCQAGICHDKKLNNIDFTLECEREREPPSGVIIQEQMDFLTTDMVEPLARMKCEEPFPEADVGDDSQQPRAPYRSRSLSDLYSVHCPVQMASQDTTASSQAIVPVSPAPSDVGALAIVPLCKSKGSEVGQRRMRRPFTVGEVEALVGAVEQLGTGRWRAVKTLAFDSIDHRTYVDLKDKWKTLVHTASISPQQRRGQPVPQELLDRVLLAQAYWSQQQQQARL

SEQ ID NO: 906 - protein, 319 aa, Oryza sativa
MAPKRPTPPPPPPPVASSEETASGSDSDESEEEEEEAEESPLAQPAPVVSNKGAESDSSGEEESEEEEEEDLVRSSATKSRDPPQENREEDDSSDEEEDESSESEKAEAPPPPPPNPAPKQGAEGNGPKVSSPKRQAFHRIWSTEDEVRILEALAAHRREHGSLPQTDALIATLAGSLDNTGYGRKELQGKVSTLKRRYESTAKKKGDLPSKGHDRRLYDLSKSVWGSEAAAAAVNGTTTAPREFGEMCELYPHLAEEVKLLEAAHPGLFKRDFGKLDDDKAHALDMKIKKQRIAEISVVLRRGDLTKEVTKVLAELVE

SEQ ID NO: 907 - protein, 166 aa, Glycine max
  misc_feature (59)..(59): Xaa can be any naturally occurring amino acid
ETKGINKPLERKRGKTEKCIRLEDLQRYCAGSLKDAAKSLGVCPTTVKRICMQHGISRXPSREINRVNRSLSKLKRDIESVQGAEGAFGLNSLSKSPLPIAVGSFPEPSTPNKFSLPASLSINPSEPQIRENELNAKALETNSRAVMEDDRLLGGMTPHLEKVLTI

SEQ ID NO: 908 - protein, 268 aa, Oryza sativa
  misc_feature (241)..(241): Xaa can be any naturally occurring amino acid
  misc_feature (253)..(253): Xaa can be any naturally occurring amino acid
MGRGKVQLKRIENSMNRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIRSRKSHLMLESISELQKKERSLQEENKALQKELVERQKNVRGQQQVGQWDQTQVQAQAQAQPQAQTSFFFFFMLRDQQALLSPQNICYPPVMMGQRNDAAAXAAVAAQGQVQLXRIGGFPPWMLSTFKA

SEQ ID NO: 909 - protein, 519 aa, Ostreococcus tauri
MERARGAEEATREATTPGDDGDDDDAYELGERMDDVSESDGYDYDDFEGGAEALMSVKDELAAARTGSKTSKGAKAKAAGEPNGSLKGDAESRDKRNQSRENRRVRQFRSASEITQEELSSCFHLPSEAACRKLGVGLTVLKRQCRKYGIKRWPFRKMKSLDRLITNVQAGISPGDQNRLLVKSVEELEDQKRKMEECAMLDLDDTTKKLQQAYSKANHKARRNRGEATRIRVHAAANAVRELEARRRGGYGDEPNGAGETLLELAHKIHDITVPVKAATEAPVLPQVLTGFPATAPPAMRGETTPVKRDDATLKPLLSNTPTPPAGNGVKVEMESVEGKKASTSSNPKPMKGDLVAANYVGPPEKVLTAVRGAWSPARPARRTDDPSDTEAFLSPREAVRRGRPSVVASVRPSVGIASSETAKANANGRTKSAVTEDHPAFGLAPVVKGARSGAQSRLSGIERAELEHMFRDRLTKVRDSMCEAFQIDPTECEVHFSPKLQATSLATAVEKLATRNSR

SEQ ID NO: 910 - protein, 225 aa, Persea borbonia
KRIENKINRQVTFAKRRNGLLKKAYELSVLCDAEVALIIFSNRGKLYEFCSSSSMLKTLERYQKCNYGAPETTVSTRETQSSHQEYLKLKARVEALQRSQRNLLGEDLGPLTSKELDTLEKQLDASLKQIRSTRTQYMLDQLADLQRREQMLSEANKNLKRRLEEGMQANPQVWDPNGHPVTYGRQQAPPQSDGFFHPLDTCEPTLHIGYQPADQITIAAPGPSV

SEQ ID NO: 911 - protein, 244 aa, Triticum turgidum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHAAQQDQTQPQTSSSSSSFMLRDAPPAANTSIHPAATGERAEDAAVQPQAPPRTGLPPWMVSHING

SEQ ID NO: 912 - protein, 72 aa, Chlamydomonas reinhardtii
QVEGCNADMTAERPYYRRYSVCEAHIRALQVQHAGKTQRFCQQCGKFQELVDFDGDKRSCRTQLAKHSARRR

SEQ ID NO: 913 - protein, 441 aa, Arabidopsis thaliana
MDLRLQQAAESGSINELYALIDENPYILENIDAVPFVSTPLHVAAVFGNIEFAMEMLNLKPSFARKLNTSGYSPLHLAVEKEQSDFVSHMLWHDGGLSRVKGRNGVTPFHLLVIRGDDDLVAECLITSPECIEDVNVDRQNALHLAVMNDRFEVLQVLTGWIQRMSQKDAYYIENRVLNKRDFDFNTALHLAAYKNDQQALKLLLKCRLVEPNLVNIDDLTFVDILRTQGENAGGGNLDLEQAVIKTGCVEAASMPKFKEESDLLKSPINFMTYYSTSMKRMKSSTSDQDRGAFLIVCTLIITATYQMALQPPGGVHQSENANANAGSVVMKQTFFILLWISNTVGFCCAVFYTFCLIPLGQLFTIWFFYIGTCLCISYALAMAVISPHPLVFLSATFALFLVFALYLLLEAFVDTWRKHRTVVPKSRFSWFWKVLQYYYI

SEQ ID NO: 914 - protein, 427 aa, Arabidopsis thaliana
MDNFQGDLTDVVRGIGSGHVSPSPGPPEGPSPSSMSPPPTSDLHVEFPSAATSASCLANPFGDPFVSMKDPLIHLPASYISGAGDNKSNKSFAIFPKIFEDDHIKSQCSVFPRIKISQSNNIHDASTCNSPAITVSSAAVAASPWGMINVNTTNSPRNCLLVDNNNNTSSCSQVQISSSPRNLGIKRRKSQAKKVVCIPAPAAMNSRSSGEVVPSDLWAWRKYGQKPIKGSPYPRGYYRCSSSKGCSARKQVERSRTDPNMLVITYTSEHNHPWPTQRNALAGSTRSSSSSSLNPSSKSSTAAATTSPSSRVFQNNSSKDEPNNSNLPSSSTHPPFDAAAIKEENVEERQEKMEFDYNDVENTYRPELLQEFQHQPEDFFADLDELEGDSLTMLLSHSSGGGNMENKTTIPDVFSDFFDDDESSRSL

SEQ ID NO: 915 - protein, 384 aa, Physcomitrella patens
  misc_feature (136)..(137): Xaa can be any naturally occurring amino acid
  misc_feature (153)..(153): Xaa can be any naturally occurring amino acid
  misc_feature (355)..(355): Xaa can be any naturally occurring amino acid
  misc_feature (363)..(363): Xaa can be any naturally occurring amino acid
MASEGSINRDTEKFQQELAYKCPRSSDLLLAITTSANTAVREHGSSAERRRRGNSGLFGNMSLLTEDEDDAPDAQDHEFEDNPQSEQDLELRAAIIDHPFYPEMVLAHVRVFKIGAPGRLRRKLDELAKKFQRFQXXDHTSKIGSDPELDHFXRSYVGVLTKFAEDLEEPFNKFIQFTDNTSKALEEICGHYVDTTPDEDNCGFDIGPLEYGAQEGDDLDTLGDENVMYPLDIDESVIVDPMASDEDIKKALRKKYGRHIGELKAEFNRVRKKGKLPTSARTILKDWFNRHSHWPYPSEMEKQYLQRICGLNLKQINNWFINERKRHWSCEGKCMHPNAKFYGTSNGQCRGHLEXEQSNRLQXSSEETIYVKCSHAALIFEVSM

SEQ ID NO: 916 - protein, 319 aa, Oryza sativa Japonica Group
MDGEWSDGAAVSSPTMSGGGGREQMKGGEDVAAADCPGSPVSPSPAAAQRSAAGAAASPSGRSRRSAQKRVVTVPLADVTGPRPKGVGEGNTPTDSWAWRKYGQKPIKGSPFPRAYYRCSSSKGCPARKQVERSRNDPDTVIVTYSFEHNHSATVPRAQNRQAAPQKPKAQACSPPEPVVEVEPEETHQYGVTAGPATGGGGGAAAIEVRDEFRWLYDVVSVPATSTSPSDIDAADEMQLYDQPMFFGGAVVGTAALLPDEFGDVGGLGGEGLGEEEALFEGLGELPECAMVFRRRAGDGLEMGGGVKIEQPAESTAMT

SEQ ID NO: 917 - protein, 61 aa, Physcomitrella patens subsp. patens
HYRGVRQRPWGKFAAEIRDSAKNGARVWLGTFDTAEQAALAYDRAALNMRGSRALLNFPLK

SEQ ID NO: 918 - protein, 333 aa, Arabidopsis thaliana
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKNQRVL

SEQ ID NO: 919 - protein, 139 aa, Herrania albiflora
TEIIYKGTHDHPKPQPSRRYSSGNIMPGQEERSDKVSSFTGRDDKSSSMYGQMAHSIEPNSTADLSPVTANDDNIDEVDDDDPFSKRRKMDGGVDVTPVVKPIREPRVVVQTLSEVDILDDGYRWRKYGQKVVRGNPNP

SEQ ID NO: 920 - protein, 133 aa, Herrania cuatrecasana
GTHDHPKPQPSRRYSSGNIMPGQEERSDKVSSFTGRDDKSSSMYGQMAHSIEPNSTADLSPVTANDDNIDEVDDDDPFSKRRKMDGGVDVTPVVKPIREPRVVVQTLSEVDILDDGYRWRKYGQKVVRGNPNP

SEQ ID NO: 921 - protein, 86 aa, Brassica napus
MSAGFESKAVILSLINNISCPISSTSCSKPGLGPTSNALHFCSKQRLVLETPSLSMRLRPKRTCSGVEVFGGFHIKQQKFSFFIVR

SEQ ID NO: 922 - protein, 256 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQHNQGHNMPPPLPPQQHQIQHPYMLSHQPSPFLNMGGLYQEDDPMAMRRNDLELTLEPVYNCNLGCFAA

SEQ ID NO: 923 - protein, 132 aa, Herrania nycterodendron
THDHPKPQPSRRYSSGNIMPGQEERSDKVSSFTGRDDKSSSMYGQMAHSIEPNSTADLSPVTANDDNIDEVDDDDPFSKRRKMDGGVDVTPVVKPIREPRVVVQTLSEVDILDDGYRWRKYGQKVVRGNPNP

SEQ ID NO: 924 - protein, 192 aa, Lupinus microcarpus
SSGPYPYFPSSSSSASYHPFAFFNPENSSSNNTFSHDLLSFPYNIPTTHHYHAPIPETVSNFADCAAASAVMFKNDVSGSNFGLSNFLAKKPASKKDRHSKIHTSQGLRDRRVRLSIEIARKFFDLQDMLGFDKASNTLEWLFNKSKKAMKELARSKNSSSGVVANSFSSSDSEFEVVSMINQDSIDATPEG

SEQ ID NO: 925 - protein, 98 aa, Chlamydomonas reinhardtii
QEDDLLRALVDRHGANKWTEIAASLPGRTGKSCRLRWVNQLRGDLVMGAFSPAEDQRIVELQATLGNRWSAIAKELPGRTDNMIKNRWNSYLKRRLEM

SEQ ID NO: 926 - protein, 355 aa, Zea mays
MALEAVVFPKEHPGCTAVKARPASLGCGFHTEELEVEDKGGVVLQGEAADALPPPGGAATTWDWDAVLCPCSTAPAAGAVEECWDVQQQQHQLLSVSPPPSSAVAASSSGRRKAAASEAARRRRRRPMAVRNTDEMESQRRNHIAVERNRRRQMNEYLSVLRSAMPPSYTQRGDQASIVAGAINFVKELEQLLQSLEAQKRRQRCTEPPAPAPFAGFFIFPQYSTTAATGGAVGSSSDSAGSGGDQSGGGGGCAGARRGVADIEVSLAESHANVKVLAARRPRQLLRMVVALQCLGLTVLHLNVTTTADHLALYSLSLKMEDECRLSPSVDDIAAAVNEILADISDECARGGPGH

SEQ ID NO: 927 - protein, 264 aa, Hordeum brevisubulatum
MTRKKKVRRRSTGPDSVAETIKKWKEQNQKLQQENGSRKAPAKGSKKGCMAGKGGPENSNCAYRGVRQRTWGKWVAEIREPNRGNRLWLGSFPTAVEAARAYDDAARAMYGATARVNFPEHSPDANSGCTMAPSLLLSNGATAVSHPSDGKDESESPPSLVSNAPTAALHRSDAKDEFESSGTVAHKVKAEVSNDLRSTHEEHKALEVTQPKGKALHKEANVSYDYFNVEEVLDMIIVELSADVKMEAHEEYQEGDDGFSLFSY

SEQ ID NO: 928 - protein, 314 aa, Oryza sativa Japonica Group
MEKTSAGKEEGSESKTAAANNDGSSTSSTTEEEESGESQRRTSSSSSVRPYIRSKNPRLRWTPELHLSFVRAVDRLGGQDRATPKLVLQLMNVRGLSIGHVKSHLQMYRSKKIDESGQVIGGGSWRSSDEQQYHHLQMQGGGDGGQAYNLGHLSLPAALHHRHITAGSGTILQSRVANAWSPWRCHGSYWLRAGHHLLVGSKPYYPPPPAEARANTSSNHPDFVQGSSSSPDDHTMNHQRPVVLKEMIYNEGSNHQGGPLNLDLSLDICPRGEKRKRELISWRKHEEDHDHTTIAIGGDQEAESCATGLSLSLF

SEQ ID NO: 929 - protein, 220 aa, Persea borbonia
KRIENKINRQVTFAKRRNGLLKKAYELSVLCDAEVALIVFSTRGKLYEFCSTASMLKTLERYQKCNYGAPETTVSSRELQSSHQEYMKLKARVEALQRSQRNLLGEDLGPLTGKELDTLEKQLDVSLKHIRSTRTQYMLDQLGDLQRREHMLSEANKSLRRRLEEGMQENPNHAWDPNGYVRQQAPPQSDGFFHPIECEPTLQIGYQSSQITIAAPGPNV

SEQ ID NO: 930 - protein, 322 aa, Solanum tuberosum
MMDELSKLHSAIVCSRSRQQQQAEAEDEAGPTIINNTHTSFAIHHYRQLEAADHQNNTKSSTNMSDLIKAQIANHPLYPNLLSAYLQCRKVGAPQGMTSILEEISNENNLISSSCHSSEIGADPELDKFMESYCAVLVKYKEEPSKPFDEATSFLNNIKSQLSSLCKDNLITSTSFNSNNNYISDEAGGTSEEDLGCEEMEAADSPAYREGDNELKEMLMRKYSGYLSSLRKEFLKKRKKGKLPKEARIVLLDWWNTHYRWPYPTEEEKNRLSEMTGLDQKQINNWFINQRKRHWRPSEDMKFALMEGVSAGSMYFDGSGGT

SEQ ID NO: 931 - protein, 193 aa, Vitis vinifera
MARQKIQIKKIDNTAARQVTFSKRRRGLFKKAQELSILCDAEIALIVFSAAGKLFEYSSSSVSQVIGRHNQHPQTPGKPEPPSLELQLENSTCAALSKEIAQQTQRLRQMKGEELQVLKIEELTELEELLEAGLCNVVEEKEERIRTEISDLQRKGDLLQEENERLRKEVRTLTIPSFCFLFFVFCASCLQEC

SEQ ID NO: 932 - protein, 239 aa, Persea americana
MGRGRVQLKRIENKINRQVTFSKRRMGLLKKAHEISVLCDAEVALIIFSTKGKLYEYATDSSMSKILERYERYSYAERELVLPGQASEGNWCQEYGKLKARVEALQRNLRHFMGEDLDSLSVRELQQLEQQLDVALRHVRSRKIQVMFDSISELQTKEKALQEQNIMLEKKLQEKEKAAAQQAHRHSPSLLLPTPLPTLNIGSYTHSSSVGVAAEEEVGARPLARTNSLVPPWMLRHIN

SEQ ID NO: 933 - protein, 644 aa, Oryza sativa Japonica Group
MMGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGIGGSNGGVFEDVNGMMQQPQQTTPAQQQFFIRDDTPFGNQMGDINGASEFRFGSGFNMSGAVEYPGAMQGQQKNDGASEFEELE

SEQ ID NO: 934 - protein, 376 aa, Arabidopsis thaliana
MQKVFLAMDTCALVIHQSLSRIKLSPPKSSSSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAAKKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 935 - protein, 374 aa, Triticum aestivum
MEATPISVKPPSPAPPQPPHPHLTAAVPLSAMEPPPSPPPAVAAAAEGPDALPDPGSMNQLALATTPKRQKVEDAADGCKHCACKKSRCLKLYCPCFAGGGYCSEKCGCVPCFNKSDFAETVQTTRKVLLSRQKRMSLKINRRLEANAETMEDAHNSSSSTPPRRGCNCKKSSCLKKYCDCYQDGTGCSLFCRCEDCKNPYGKNEGFMADESKRFIYTGADLDHSEDEHDFVVERSPRLQSPISKESSFQHTPPRSKASSRDTHLLPQVLSQWQPRSWQQSSKRQGNDHRAVDDSGENNKSSSHEWQLAKHQVQEDAYSISRCVQILNGMVELSQVEKSVAPDVFLQPGNREIFVSLGLDVRALWLKRKIQHLT

SEQ ID NO: 936 - protein, 340 aa, Paulownia kawakamii
MNDGPEVCRKVRTRRPIQTGQSSLGPDARHTDPPGPPPPGPLGDLLPFPYARRHPPRRRPSWPQPRPPPNPSFPPSQWAAAVGPAQQDQRDQACVPFKDPAGRRGLFRWAWIGRPAAGFDGGGSSPGPRHGHSNSVDEYSSAMSSELDSIAKRAMAADRLAELSLIDPKRAKRILANRQSAARSKERKTRYTSELERKVQTLQTEATTLSAQITLLQRDTTGLTTENKELKMKLQAMEQQAHLRDALNEALKDELQWLKIAAGQVPGVNGNNRGSFSQFSSQPPTIRYFGNHLAQQQQQQQQQQQQQQQQQPLHMPHSSANNPRLGGQSQLSFQDFNHRV

SEQ ID NO: 937 - protein, 488 aa, Vitis vinifera
MFASFAEELFSFNDQSGGSRSNTFLSAGNLISLDAGTHSLTAAELKEQFSCRDDLAPKARKPYTITKQRERWTEEEHKKFLEALKLYGRAWRRIEEHVGTKTAVQIRSHAQKFFSKVVRETSGGNTNSAEPIEIPPPRPKRKPVHPYPRKLVHPLRKGISVLEPPVRSVSPNFSASEQENQSPTSVLSAVGSETLGSTLSNTQNGSPSPVSSAAGVNPDRMFLPELNPPTEENASPSPVLTTSSSVPDEPLPMKFELFPQEIFAKECSVEEASTRTLKLFGRTVLVTDSHRPSSPTTSKSQPSDINNEGMHVETLPWNSTPTESSPENSSFSWSHLQPQPSGAFYYMHFQKEDSNCVEAGTTAPLPWWTFYGGIPIPFLPLHHQDSIKAHEDTKFAETHDKEIQKEGSWTGSNTGSSHQPYLDTMEKESDSAFELKLSERSAFSRGRTNTDKCVKGFMPYKRCLAERDTQSSIIIGNEREEQRIRLCL

SEQ ID NO: 938 - protein, 932 aa, Oryza sativa
MAIGVMMTSDNGKAPEKGGEASGPSSAPQEGEISNEPQRRRPLSGRTTGPTRRSTKGNWTPEEEDDIIVQMVNKLGPKKWSTIAQALPGRIGKQCRERWHNHLNPGINKEAWTQEEEITLIHAHRMYGNKWAELTKFLPGRTDNAIKNHWNSSVKKKVDSYMSSGLLTQVSCLPLNEYSAHCNSSPALTQQNSEDSGSYAVREVENSSVCSQSSLAKVSCSQVHNANVALGCDLQVNANVDNNEAHDSQSSVGHEACYTSVGAVATAIPEVHYHVSSSNFDPDQHLQEEFAQGLNLHMSMDEVPSNSSFADNPTICSIENHERSLEPYDVAMEMPLSMLPSDSGAEQKLHFMSEADFNSPNCLKSELWQDISLQSLLSGPDAVETDSFSRSNHQSDVYSSQADNEFLAPPYLLQTSNSSSVMEATYGQSPQMSVPPSLICSNVMTDVPSDNRSEPKEMTVSQAEMVTQSSSSSGDAEMSANPGSSNGSDIPSMMERIPECADQHVTNAEEPEASIEKEPSVTPSATADEKQDEGALFYEPPRFPSMDVPFVSCDLVTSGDLQEYSPLGIRQLMRSTMNVCTPMRLWGSPTHDESPDILLKSAAKSFICTPSILKKRHRDLVSPIPDKRIEKKSGTEKDCGVSDTSSIGIQTCFINATKDDAVITKSVLRIERSASSKPLEKKLEFSDENKENLDNTIEQAKDGQSAGNYKHIDEQARGERRTATNITTTYDDLPGNLQPAGILIEPNGDDLVSPDYVCKEGVSAKKLAELIVEKSSACINVDYEYVNILADTPGIKRGLESPSAWKSPWFVDMQFQGSYFVSPANGSYDALGLVKQINVQTAAALAEAREVLASGGQSENINSDKENLENPDAKKEPGATTKLQAKIKTEGKILDFNECATPIRSSDKKAGSSLGRSLSSPIPSSHLLKSFR

SEQ ID NO: 939 - protein, 327 aa, Petunia x hybrida
MENYQHFDCSDSNLPPGFRFHPTDEELITYYLLKKVLDSNFTGRAIAEVDLNKCEPWELPEKAKMGEKEWYFFSLRDRKYPTGLRTNRATEAGYWKATGKDREIYSSKTSALVGMKKTLVFYRGRAPKGEKSNWVMHEYRLDGKFAYHYISRSSKDEWVISRVFQKSCSTVGTTSNGGKKRLNSSFNNMYQEVSSPSSVSLPPLLESSPYNNTATSAAASKKEHVSCFSTISTPSFDPSSVFDISSNSNTLHSLPAPSFSAILDPSSTFSRNSVFPSLRSLQENLHLPLFSGGTSAMHGGFSSPLANWPVPETQKVDHSELDCMWSY

SEQ ID NO: 940 - protein, 196 aa, Brassica napus
  misc_feature (67)..(67): Xaa can be any naturally occurring amino acid
  misc_feature (153)..(153): Xaa can be any naturally occurring amino acid
  misc_feature (177)..(177): Xaa can be any naturally occurring amino acid
  misc_feature (189)..(189): Xaa can be any naturally occurring amino acid
MVKSSSDRVDSSSPSSSVAPFLRKCYEMVDDSSTDSIISWSTNGDNSFVISDTTVFSAQLLPKYFKXSNLSSFIRQLNIYGFRKVDADRCEFANDWFVRGQKELLKNVIRRKNVQSTSEHQSKTTTTDASQEKKSGESELWKEVDILKGDKKXLAQELVKVRQYQESTDTKMLHLEXRVQGMEESQARXMLSFLVM

SEQ ID NO: 941 - protein, 220 aa, Zea mays
MAPRTSERAMTSAAAGLARGAGPHYRGVRKRPWGRYAAEIRDPAKKSRVWLGTFDTPEDAARAYDAAAREYRGAKATAAWADAGGLPLAAADVAGACRSGNSSSTTTTTTVDSFGGDVQAPPMQAMPLPPSFCASGAVRFPFSSYPVTHPYYFFGQAAAGCHMLKLPPTTVTVAQSDSDSSSVEDLSPSPSPSPPAAVSATRSATFDLDLNCPPPAEAEA

SEQ ID NO: 942 - protein, 177 aa, Vitis vinifera
MSPWIMFFTQTTMAAIEALNDKSGSSKSFISKHIESAHGDLSAAHSTLLVHHLNRRKQNGDPVMVRNHCMKPDPNAPPRKGRGRPPEPEFPLPLGTVLAPPRPRCHPLKPRDPFALVSPPKKASSGSGKPRGRPPEKPKVGTSSAPAPATGASRPRGWPPKAKPVVVPVGWRFEQRC

SEQ ID NO: 943 - protein, 603 aa, Yarrowia lipolytica CLIB122
MMDVERVEHMPPKPMYSLMTQPVVLKEEPVAPSPPTTQAAQQQQQQAPTQTQTPAQPPQAQQPTHNQTHTQPPQQQPTSAQQPTSSNATASNSTDNKKPGTTPKVSQAAFIHKLYSMLEDSSIEHLISWSASNDSFIVSPGEEFSKVLRQYFKHTNVSSFVRQLNMYGFHKVNDTFTFHTGDSSQWEFKHGGGSFKRGDVESLRGIKRRASRQSASQRDSVPLRPVGLVSDYGVAPSGGAPPGMNGSVDVGTAAAAAAAQHGHMMLHPSQHPHHPHPADDAAAAAATAATWHLHDSVSRMAATQAALIDAVRSLQSDVISLLDVLPRITEGRAAVESAHTECQRVAHAMGHRNAFLASLDGRRESQPQPQQQQPYFYQQSAAASAASATAPGGSQWRQPEPQYPVPPTDPFHRGSRGRAVSVYFDPLAKEPAAGPDGQAPPTHTSAPPPPPQQQQQQQQQPPHSQGAAPPPPFGSSPGPTGPPGGVPRSQRPGSFPLLHRQDKTEFVGGGFAEALKYRTDAPARRHTASGAETMPLPQYTAPTSTPHPHEPSTPPPHSSPHTPYRSPHPSGGSTRSNSSSSTRGASVAALLNPEGGDKKRKIE

SEQ ID NO: 944 - protein, 268 aa, Triticum aestivum
MCNNSGGRGGAMAARKGPWTENEDAQLVWFVRLLGERRWDFLAQVSGLRRTGKSCRLRWVNYLHPGLKRGRITADEERLILSLHAEWGSRWSRIARKLPGRTDNEIKNYWRTHMRKKAQEEKMLAKNKASSSPSSSSADSTSLTTTTCSASPTATSSSAATTEEAPQESTTSMDDEAEEEAATSASEEKKAEVVQYCSPVDMDQLWNDIAASERYPEMMMSWGVAGHVVMPAPAVEPSSPVWEFCEDYSLWRIDDQEYYNKIDQHALN

SEQ ID NO: 945 - protein, 427 aa, Oryza sativa Indica Group
MPSPLKERPAGRLGRLLAALRPARAGPLPVQTGFPTSLADLVVKNHGRLKKPSASASRRKKRGGPEAPPSPSPSPSPSPPPQPSSPPPPPPSPPPAAAVSVSPPTQPRPRPELPPVEAVLRRQPKGRVFGLGLGFVSLVGVVSLALLVIWSKKVVAAVTVASFSLFLLESVRSSALSRRPRRPAANNKLDLDGRGYVSPIREVEPARASFSDSSRRSEFSILTIEERSEVGDDSIVAIEERIAAGGDDSSNAKVKTKKRSWRKLIPRKLQKGMKGKEAEDSSGSFRSSEGNRGDATATDSSDSRRGMRTKAADAFVARSMDSSPSFRGNGGDTDADAYSNATRVEIDAPADVLAGDGDAVGGTRSSVALLVVAVVLVGLVAGKLPAVVFTVLCGVFISSVQRLPAGGDGNGDRSFTWWFRIKPKDVN

SEQ ID NO: 946 - protein, 277 aa, Zea mays
MTEPCPNRESGTEGSLSNKTTGPRGPDNPCYRNISIGRWTPEEEAALKAGVAKHGPGKWRTILRDSDFSALLRLRSNVDLKDKWRNLSVTAGGYGSREKARMALKKGRRVVPKLTAEPMDVDEKDMDNAHDTVIDVEPLDDLIVEAIRKLNEPSGSNKAVISGYIEVNQKYRIAPSSSLGGISTKVSSSEGMNTENNNVKRLTKPQVVAELEKMKGMTREEAAAFAAKAVAEAEVAMAEAEEAARVAEAAENDAEAAKAFLDAVILSMRNRNAASMV

SEQ ID NO: 947 - protein, 364 aa, Brassica rapa subsp. pekinensis
MNTTTSTHFVPPTRFEIYDPLNQIGTMWEESFKNNGGGFYTPNSIIIPTNQKPYSLSEDGTEGTPHKFDQEASTSRHPDKTQRRLAQNREAAKKSRLRKKAYVQQLETSRLKLIHLEQELDRARQQGFYASNRVDTNALSFSDNMCSGIVAFEMEYGHWVEEQNRQISELRTVLNGQVSDIELRLLVDNAMKHYFQLFRMKSAAAKLDVFYIMSGMWKTSAERFFLWIGGFRPSELLKVLLPHFDPMMDQQVLDVCNLRQSCQQAEDAVSQGMEKLQHTLAESVAAGELGEGSYVPQITSAMERLEALVSFVNQADHLRHETLQQMHRILTTRQAARGLLALGEYFQRLRALSSSWETRQREPT

SEQ ID NO: 948 - protein, 139 aa, Theobroma angustifolium
TEIIYKGTHDHPKPQPSRRYSSGNIMPGQEERSDKVSSFTGRDDKSSSMYGQMAHSIEPNSTADLSPVTANDDNIDEVDDDDPFSKRRKMDGGVDITPVVKPIREPRVVVQTLSEVDILDDGYRWRKYGQKVVRGNPNP

SEQ ID NO: 949 - protein, 190 aa, Lupinus lepidus
  misc_feature (156)..(156): Xaa can be any naturally occurring amino acid
SSGPYPYFSSSSSPYHPFAFFNPENSSSNNTFSHDLLSFPYNIQPTHHYHAPTQETLSNFADCAASAAMFRNDVCGNSNFGFSNFLAKKPASKKDRHSKIHTSQGLRDRRVRLSIEIARKFFDLQDMLGFDKASNTLEWLFNKSKKAMKELARSKXSSSGAVANSFSSSDSEFEVVSMINQDSIDATPEG

SEQ ID NO: 950 - protein, 139 aa, Theobroma bicolor
TEIIYKGTHDHPKPQPSRRYSSGNIMPVQEERSDKVSSFTSRDDKSSSMYGQMAHSIEPNGSADLSPVTANDDNIDEVDDDDPFSKRRKMDGGADITPVVKPIREPRVVVQTLSEVDILDDGYRWRKYGQKVVRGNPNP

SEQ ID NO: 951 - protein, 204 aa, Oryza sativa Japonica Group
MAGAGDWPFAADEASKSLTPGKKRARQPRFAFMTKSEIDHLEDGYRWRKYGQKAVKNSPFPRCTNSKCTVKKRVERSSDDPSVVITTYEGQHSHHTVTFPRAAATAAGFSHIHAMAALAAAPFSAHQQLYSNLQPPPPTMPLAATTPASSSSLLQLPLHCNHELQVVASCGGYPSSSSSPPASVLPVDKGLLDDMVPRAMRHDG

SEQ ID NO: 952 - protein, 202 aa, Zea mays
  misc_feature (111)..(111): Xaa can be any naturally occurring amino acid
MQSQIVCHGCRTLLFYPRGAPSVCCAVCHVVTNVPPPAMEMARLICGGCQTLLMYARSATTVRCPCCDTVNLVRPVSSIAHVNCGQCQTVLMYPYGAPSVKCAVCNLITNXGGVTPMIPLPPPALTASSGTSYIIPSISVPTNQPRNVTVVVENPMTVDDKGKNTYLVSYCCLAIGCSTEEDIPLPGECSGKAARLSPLRSC

SEQ ID NO: 953 - protein, 190 aa, Lupinus lepidus
SSGPYPYFSSSSSPYHPFAFFNPENSSSNNTFSHDLLSFPYNIPTTHHYHAPTQETLSNFADCAASAAMFKNDVCGNSNFGFSNFLAKKPASKKDRHSKIHTSQGLRDRRVRLSIEIARKFFDLQDMLGFDKASNTLEWLFNKSKKAMKELARSKNSSSCVVANSFSSSDSEFEVVSMINQDSIDATPEG

SEQ ID NO: 954 - protein, 232 aa, Chlamydomonas reinhardtii
MADVAAPAPAKSPAAKKAAKAKKVATHPPYITMVSEAILALKERDGSSIPAIKKWIDAKYGKDIHDKNYPKTLSLTLKTFVKSGKLIKVKNSFKLSEEVKKAAKKAATPKKAAAPKKEGAVKKTKAPKKEGEKKPKSAKKAEKKPKKEGEKKKAAKPAKAEKKPKAAKPAKKTPTKKAAAKPKAEKKPKAAAKPKAEKKPKAAKPKAEKKAKAAKPAAKKSAEKKPKAAKKA

SEQ ID NO: 955 - protein, 190 aa, Lupinus latifolius
SSGPYPYFSSSSSPYHPFAFFNPENSSSNNTFSHDLLSFPYNIQPTHHYHAPTQETLSNFADCAASAAMFKTDVSGNSNFGFSNFLAKKPASQKDRHSKIHTSQGLRDRRVRLSIEIARKFFDLQDMLGFDKASNTLEWLFNKSKKAMKELARSKNSSSCVVANSFSSSDSEFEVVSMINQDSIDATPEG

SEQ ID NO: 956 - protein, 396 aa, Gossypium hirsutum
MCGGAIISDFIPPARSRLVTANYLWPDLKKSGSKKRSGRKHSKKPAVGFEDDFEADFQVFKDEDSDVDDFNDDVDDVLADVKSFAFSATKKPSPAVSHGSNSIKSVEFSGQAEKSAKRKRKNQYRGIRQRPWGKWAAEIRDPRKGVRVWLGTFNTAEEAARAYDAEALRIRGKKAKVNFPDETPRTTPKHAVKMNSQKPLSGSNLSSVQSSLNPDFSYSNKLEQGYYDTVGFIEEKSLMDQFAYADPVRAAVDDGLKPFADPENTASFFISDPGSNNFDSSDLVWGDQGAKTPEISSSLEPTLEVNEFLDNANPTKKLKLSLNNVMPTGGDNSVKSLSDELLAMDNQVNYFQTPFIDENWNVSMDDFLNGDATQVGGNEMGFWSFDDFPSIDGGIF

SEQ ID NO: 957 - protein, 319 aa, Gossypium barbadense
MSNVYLWFMYPYDIKFFFLCSIIEGSNSEKSMQFDGQAEKCAKRKRKNQYRGIRQRPWGKWAAEIRDPRKGVRVWLGTFNTAEEAARAYDAEARRIRGKKAKVNFPNETPRTSPKHAVKTNSQKPLSKSNLSPVQLNLDQNYNYLSQPEQEYFDTMGFVEEKPLVNQFAYVDPVPTSIDAGSNQSDNAPLYFNSDQGSNSINCSDYGWGEQGARTPEISSILEASVVGEEFLEDANPSKKLKPSSDNVMPAEDNSAKTLSDELLALDNQMKYFQMPPFIEGNWDATIDAFLNGDATQDGGNPMDLWNFDDFPTMAEGVF

SEQ ID NO: 958 - protein, 454 aa, Vitis vinifera
MCRKITRPRRMYVYEENACFDGTKSVAEGDDEGFSQSVAPPPTNNSFEDSTNMRVSMEDASATMEIELHQQLAFDMDQQCYNSNNDGNDSNQVFSYEMQEMGFNHHQQQQEDPLLLQQHQAEMQNAHQNFSAAYPPTPDLLNLFHLPRCTPSSLLPNSSISFTNPDSSATAASGILYDPLFHLNLPPQPPVFRELFQVGSLFGGGMDEREASGGGYGDGDDHRQFDNGVLKFTRDMACIGKGREGKGTKSFATEKQRREHLNDKYNALRSLVPNPTKSDRASVVGDAIEYIRELLRTVNELKLLVEKKRCGRERSKRHKTEDESTGDVKSSSSIKPEPDQSYNESLRSSWLQRKSKDTEVDVRIIDDEVTIKLVQRKKINCLLFVSKILDELQLDLHHVAGGHVGDYYSFLFNTKIYEGSSVYASAIANKLIEVVDRQYAAIPIPIPIPPTSSF

SEQ ID NO: 959 - protein, 589 aa, Aspergillus nidulans FGSC A4
MCASPNSESFDNIYLDLSNQPGKCKLAETGLGWRPSGGGDTFTLDSSNIGAAQWSRAAKGYELKILSRSSGVIQLDGFDQEDFERLSKAFKIWYGINVESREHALRGWNWGKAEFTKAELAFNVQNRPAFEVPYSEISNTNLAGKNEVAVELSLSVDPNGSKPAGSTKNRGRKAAAGPDELVEMRFYIPGTAVKTENGIKGENADEKNGGEGEENGEEQNAANLFYELLMEKAEIGDVAGDTFATFLDVLHLTPRGRFDIDMYESSFRLRGKTYDYKIQYSSIKKFFLLPKNDDTHTLIVLGLEPPLRQGQTRYPFLVMQLKLDEEISLELNMTEELLETRYKDKLEPRYEEPIHQVITKIFRGLSGKKVIMPSKDFVSHHGHSGVKCSIKANEGLLYFLDKSLIFVPKPATYIQMENVAVVTMSRVGGAISASRTFDITVSLKAGMGEHQFSNINREEQQPLEEFFKAKNIRIKNEMSDDTNALIAAALDNDDMMSSDEDGGGRPDRGSADEDEESVDEDFQADSDSDVAEEYDSAHESSGSGSDAEMDDASDAGVDEDEDADADMSEEERPKKKSKTGKTLLHDAEV

SEQ ID NO: 960 - protein, 556 aa, Triticum aestivum
  misc_feature (109)..(109): Xaa can be any naturally occurring amino acid
MADTPTSRMIHPFSNMQRQNPKQFQFQYSDNPQHPCRPYQPSPDTHVVPQHHYSLKSHSSDASYENQVAQMKHTLDSSAAAGCMRHDSPSSHSFTPPSIGSGSGSPFVXHDDSHSDSTNGSPVSASCVTVTTEDPNDLKQKLKDLEAEMLGPDAETVNSLESSVAKQLSLEPEKWAQMMDFPRGDLKELLLACARAVEEKNMYAVDVMVPELRKMVSVSGTPLERLGAYMVEGLVARLASSGHSIYKALRCKEPKSSDLLSYMHFLYEACPYFKFGYMSANGAIAEAVKGEDRIHIIDFHIAQGAQWISLLQALAARPGGPPTVRITGLDDSVSAYARGGGLDLVGRRLSHIAGLCKVPFEFHSVAMAGEEVEEGHLGVIPGEALAVNFTLELHHIPDETVSTANHRDRILRLVKSLRPKVLTLVEQESNTNTAPFPQRFAETLEYYTAIFESIDLTLPRDDKERVNMEQHCLAREVVNLIACEGAERVERHEVFGKWKARLTMAGFRPSPLSSLVNATISTLLQSYSENYKLAERDGALYLGWKNKPLVVSSAWH

SEQ ID NO: 961 - protein, 470 aa, Mesembryanthemum crystallinum
MNMRPALPMQTSGGNCFNELKVSGPYSSQLPVLPNPLEDFPKSPDPFAVSSSREMIPNPLQIQANPMVSHFGSSHNSSTYASGFPTDLHFPSFSPRERQSQNSPLGGGVAFPPSQNTSPDVQSAGFINYQKEDDDNSWSTGHLQDLLDFPEGIPVSNGQVGTSTEVMSNDNHVKRIGWRELTEDLYADSIEPNWNDFLADSNVADQQPKVTQPSSDVRVHQPLIQQQLSLPPREVSAAANQTSAAANQTSAAHSNRPRMRWTPELHEAFVDAVNQLGGSERATPKGVLRHMNVEGLTIYHVKSHLQKYRTARVRPESSEGNSERRASSVDPVSSVDLKTSVTITEALRMQMEVQKQLHEQLEIQRKLQLQIEEQGKYLLQMLENQNKVEKEKLNPDGSSAHNDKSEGSQPEPSREGAVISISSQGPGESSHGSKGKQKAPEADTTGDHHLEDGGSNPPPMKRARTDDSFL

SEQ ID NO: 962 - protein, 552 aa, Arabidopsis thaliana
MVSHKVLEFGDDGYKLPAQARAPRSLRKRIYEKKIPGDDKMCAIDLLATVAGSLLLESKSPVNACLVVQNTVKNEYPADENPVKAVPYSESPSLFDNGKCGFSSVITNPNHLLVGDKVGKEVEGFSSLGVSGDVKPDVVASIGSNSSTEVGACGNGSPNESRDDVNLFSRNDDDENFSGYIRTRMTRPVPRIGDRRIRKILASRHWKGGSKNNTDAKPWYCSKRSYYLHHHQRSYPIKKRKYFDSVYDSNSDDYRLQGKTHKGSRTISSMKSRNASFVSRDHHVKLRIKSFRVPELFVEIPETATVGSLKRMVMEAVTTILGDGLRVGLMVQGKKVRDDGKTLLQTGISEENNHLDSLGFSLEPSLETTPQPLLSSYLSDHACDDVTLCHDNALDSSHEPEPSPADSFGKLGTSDHSRALIPVASAAMLAPRPPNRKFKRTEQQLAAQRRIRRPFSVTEVEALVQAVEKLGTGRWRDVKVRAFEDADHRTYVDLKDKWKTLVHTARISPQQRRGEPVPQELLDRVLKAHAYWSQHLMHQLQTEPPSTQVEAL

SEQ ID NO: 963 - protein, 357 aa, Vitis vinifera
MPLPWKNARVGRISRFVADLQSPKRGGSLVVETGFPTSLIDLFVKNRDRLKKPRKRRSRVSDPVPQQPVEPQRRPESVQAPASSDSFSEIRSVECEEEEIGGIDGGSLVDGGGEVEESVRRPSGRGVTVAVLKMSVVVILALGTKKLAVGITMSAFLLLFLEYAAKWVFGLLTPCSDAQIAIKSLIPKVFPFLLTKQTALNPPEAPTPITLSNASVEEIQIAESQFDFPAPVEETREIQEIQMGRPKIDFPAGERRWGYMEVKEREGDKEKEEEIFEALEPKHGHSRSARLKAKIKKYIPKKIRRRKWGSGKEKGRGPDSSSEVSSCMGGDKPVYIFILLFLSLFVIITLMMSFTIP

SEQ ID NO: 964 - protein, 366 aa, Glycine max
MSKPLLGIAEEEGQSNVTLLVSSSATMESVCLNSSKLKERNYMGLSDCSSVDSSAPSFSDETKSNLNLKATELRLGLPGSQSPERDSDLCLRSSIQFDEKPLFPLHPATDEHHSSSKPAVLGNKRGFSDVMSGFAEEKLLVSSEVNTILPPRPSSNVGLKPSSMLENVGAQQQAKELATVKVGHERSHAVNESRPNLNDSTNNNSSAPATKAQVVGWPPIRSFRKNSLVTTSKNVEEVDGKVGPGALFVKVSMDGAPYLRKVDLKNYNAYADLSSALENMFSCFTIGSCGSHGNLGGEVLNETKLKDLLHGSEYVLTYEDKDGDWMLVGDVPWEMFTETCKRLRIMKSSEAIGLAPRAVEKSKSRN

SEQ ID NO: 965 - protein, 454 aa, Glycine max
MASPSELSLDCKPQSYSLLLKSFGDQTDHSYKLEEFLNRLEEERLKIDAFKRELPLCMQLLTNAMEASRQQLQAFKVNHGAKPVLEEFIPMKHLASESSEKATNMSDKANWMTSAQLWSQASSEGTKQQPPITTLKESDIGFSISPKLALDNKQRNGGGAFLPFSKERNSCQGSTLRPLPELVLASAEKEMEDKKRPEVEIKGVSCQSKKENSGSDGTVVDQGKGGSPVASSHATTTTTTSSAQTHRKARRCWSPDLHRRFVNALQMLGGSQVATPKQIRELMKVDGLTNDEVKSHLQKYRLHTRRPSPSPQAVGAAPQLVVLGGIWVPPEYATAAHTATPTLYGAHPTSHAPPPHYCAATPMPQDFYTTAPPQPLLPPPPPHHNALHHLHMYKAAPHGQGSPESDVPSNGERSESIEDGKSESSSWKGESGENEGERKGISKGSNGSEITLKF

SEQ ID NO: 966 - protein, 406 aa, Oryza sativa
MSAAEDPAKPPPPPPPQLEASGSDPDDPLLRDRVVVIAPPPPPPPPPPPAPAPALLAPAENASAEAAFAVPPAAIAAVVEANGNSEKKKKRKTDEGEGCKSCSCKKSKCLKLYCVCFASGSHCSESCGCDPCYNKSIHGVPRSTPALPLKAVQTLETGQDSVEQLIRSPMDFGRRKCTCKKSGCLKKYCDCYQGGAGCSINCKCDDCKNPYGRKVGVILDGKNILAGPTPNERNGTEADSSDDEEDDYYMNRPLSPVSPSPVSRESSFQQETLVGVEVQTMNGHLYPKPLTQVRPESWQLTRRPTEEVRGEAWHYLRRPSEDGTSDVMEGHADPKFQRDNKQLENHVDRYSIPRCIEVMNAMADLSPIEKSLAPDVFLDPSNREIFLSLTVDIRTMWLKRKMKSLV

SEQ ID NO: 967 - protein, 117 aa, Physcomitrella patens subsp. patens
MRLKGVAGGAGTDDRIKGPWSPEEDVVLNRLVEKFGARNWSLIARGIPGRSGKSCRLRWCNQLNPGVKRKPFTEEEDRAIVAAHAIHGNKWASIARMLPGRTDNAIKNHWNSTLRRK

SEQ ID NO: 968 - protein, 377 aa, Triticum aestivum
MDPFHGIVKEEEFDFAGAAADGYSPSSWGSSPSSWGSSQSSWAGGGALAELPRPMDGLGEAGPTPFLNKTYEVVDDHSTDTIVSWGVAGNSFVVWDAHAFSMVLLPRYFKHCNFSSFVRQLNTYGFRKVDPDRWEFAAEGFLRGQKELLKTIRRRRPQSSPSGTPALLQQQQQGQQGACLEVGHFGPEGEVQRLQRDKGTLIAEVVKLRQEQQATRAQMQEMEARLAATEQKQQQMTVFLARAMKSPSFLQMLVQRQDQSRRKELAEALLSKKRGRPIEYLLPRNGETSSAASYSAAARGYGPGLADGSDGRRADGEDTESFWKELLSLGLEERHREAGGGGGEASGAEVDDDVDDEVDELVQSLYHLSPNRPHSHQ

SEQ ID NO: 969 - protein, 139 aa, Theobroma chocoense
TEIIYKGTHDHPKPQPSRRYSSGNIMPGQEERSDKISSFTGRDDKSSSMYGQMAHSIEPNSTADLSPVTANDDNIDEVDDDDPFSKRRKMDGGVDITPVVKPIREPRVVVQTLSEVDILDDGYRWRKYGQKVVRGNPNP

SEQ ID NO: 970 - protein, 311 aa, Glycine max
MEAVYRLKPLLDVVRVGNATTSEMRLESTANCYLQLEAPQPQENNNVTDSSSDMSDRIIKIQIANHPLYPDLLSAYIECQKVGAPPELACLLEEIGRESHRMNARREIGEGPELDHFMETFCQVLHRYKEELSRPFNEATLFLGDMESQLSNLCNETLTKSSDNNNRSDEVASGASEEELSCGEMEAFEDNVSSVTCPSDQRLKEMLLRKYSGHFSGLRKEFLKRRKKGKLPKDARMALMGWWNTHHRWPYPTEEEKVKLSEITGLDQKQINNWFINQRKRHWKPTEDMRFAVMDGLRGGGGGGIGGPMLF

SEQ ID NO: 971 - protein, 82 aa, Physcomitrella patens subsp. patens
VYKGVRMRTWGKWVSEIREPNKRSRIWLGSFSTAEMAAKAYDAAVVCLRGPSATLNFPESPPSDLPLCSTPRDVQAAAAAAA

SEQ ID NO: 972 - protein, 356 aa, Zea mays
MAFTGDADGFALDFIREHLLGAGCGGDPDPVHCTVDLDGDDITFPVLPPPQPEFEPMPFLPPPPPPPQHQHQGYIGVDPTNEYMGEPAAVFPEQEPAPPVIITFGSEPSSPVKQPLTIAVPPRPYYASAAAATAPTAAQLVAAAAEAVEDFRKYRGVRQRPWGKYAAEIRDPKRRGSRVWLGTYDTPVEAARAYDRAAFRMRGAKAILNFPNEVGTRGADFWAPPAPAKKADTAAANKRKRQQLVEDADGDDVEVVAVVVSKAAKVVDEIPASSPSQDQTSCTSRSSSVSTRETTATASSTVTSAAEETGSGAVGLPMTPSSGNWEQYWEALLGSLPLLSPQSPLPALGFPQLTVT

SEQ ID NO: 973 - protein, 139 aa, Theobroma gileri
TEIIYKGTHDHPKPQPSRRYSSGNIMPGQEERSDKVSSFTGRDDKSSSMYGQMAHSIEPNGTADLSPVTANDDNIDEVDDDDPFSKRRKMDGGADITPVVKPIREPRVVVQTLSEVDILDDGYRWRKYGQKVVRGNPNP

SEQ ID NO: 974 - protein, 105 aa, Physcomitrella patens subsp. patens
PNIIKGQWSPEEDRYLVGLVEMHGQQRWSLIATQLPGRIGKQCRERWHNHLRPDIKRDGWNTEEEEALVSAHNKLGNRWADIAKMIPGRTENAIKNHWNATMRRK

SEQ ID NO: 975 - protein, 156 aa, Capsicum annuum
MMLGSGSGRRHYRGVRQRPWGKWAAEIRNPKKAARVWLGTFDRAEDAALAYDEAAVRFKGSKAKLNFPERLVQGQPQLLSQDTSPQHNSHHFEEFNTASATGISYPHLLQYAQLLSSNDAEFPFFTSALYNNKQDGSTSNILQQHDFPSQHDDFSS

SEQ ID NO: 976 - protein, 159 aa, Chelidonium majus
FMEAYCEMLTKYEQELTKPFKEAMLFLSRIECQFKALTVSSSSDSVGHDAVDRNGSSDEDVEASDNYIDPQAEDRVLKGQLLRKYSGYLGSLKQEFLKKRKKGKLPKEARQQLLEWWSRHYKWPYPSESQKIALAESTGLDQKQINNWFINQRKRHWKP

SEQ ID NO: 977 - protein, 261 aa, Glycine max
MDSKFRKKNRNVNSYTSEQDQDTDIAQENLAESPPSSTVFNIDGLVPSPTSSSKRRRAIQKRVVQIPMKETEGCRLKGESNTPPSDSWAWRKYGQKPIKGSPYPRGYYRCSSSKGCPARKQVERSCVDPTMLVVTYSSDHNHPWPPSRNHARPTKKPEPVPDPVQPEPEEKFADLGGDDSMITTAEELGWLGEMEATSSTVLESPFMATTYHADVALIPMREEDESLFADLGELPECSVVFRQGLLAERRRYTAPWCGTTS

SEQ ID NO: 978 - protein, 757 aa, Oryza sativa Japonica Group
MGSETNKEGARGGGQFEVVATTCEVTIVVGCMKEMSAGQFYCKGEERVDGGAGIKRRGAPQRKGKSPKKVEGKTYKYKGFVIEGCELDSTIIMIKSSDLVHIPSIFTPPEVNSQKGSKTSICIDRSLSQAYHDSPDNASILPTNLAQRIQLSSDTLGSDKRHGIAGKTDHETAQKHAKLSCFDQRCLDKMKQLTSGMNVQKRDLAKTHNDEITACDWDYLGTQYDSSVVPESDLRFETAELLLETPKNGDAMPGKSFLPIVEANLENSRRKLFQGSADCYSQSAVDNIHAYCTSRGKEVATNHVSGILPCPRESQLIPDHHFSDSLEVPSDYMAMNPSAVSQHLRGLHRRSLFNDKVRDPTMGVQSVSNLGASTCATRHRSIPDDNYSKLVGSPVCALPNVDLHLVRMTEEMLAPNTSEMNTHNQGDYSSQATMPTSAGNSGQENPKRKRQKCQNDNVDSCKRCSCKKSKCLKLYCECFASKVYCSESCSCRGCFNDHSHEETVLSTRNRIESRNPLAFAPKVIRTCGPGLEFGEDSNATPASSRHKRGCNCKRSYCVKKYCECFQSGVGCSMSCRCENCKNSFGVRKGIERFETKEIERADRKMKDHPKEEQSEMDKYHALCEIWGVRSTENLFTTPSMDSRRAFALFPSECPKSSLTSSTRTSSHLHSPTRTDVLLSPFGSYTQMLLGNEASDMLLQQGDSSCTASLRIASPNKKRVSPLRTGNTLSPTCRKELGLKSIIPPFPSLTGDANSELQ

SEQ ID NO: 979 - protein, 245 aa, Lolium perenne
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRARKNQLMHESISELQKKERSLQEENKILQKELIEKQKAHTQQAQWEQTQPQTSSSSSSFMMGEATPATNCSNPPAAASDRAEDATGQPSARTVLPPWMVSHINNG

SEQ ID NO: 980 - protein, 316 aa, Oryza sativa Japonica Group
MAPKRPTPPPPPPPVASSEETASGSDSDESEEEEEESPLAQPAPVVSNKGAESDSSGEEESEEEEEEDLVRSSATKSRDPPQENREEDDSSDEEEDESSESEKAEAPPPPPPNPAPKQGAEGNGPKVSSPKRQAFHRIWSTEDEVRILEALAAHRREHGSLPQTDALIATLAGSLDNTGYGRKELQGKVSTLKRRYESTAKKKGDLPSKGHDRRLYDLSKSVWGSEAAAAAVNGTTTAPREFGEMCELYPHLAEEVKLLEAAHPGLFKRDFGKLDDDKAHALDMKIKKQRIAEISVVLRRGDLTKEVTKVLAELVE

SEQ ID NO: 981 - protein, 261 aa, Lolium perenne
MGRGKVQLKRIENKINRQVTFSKRRNGLLKKAHEISVLCDAEVAVVVFSPKGKLYEYATDSSMDKILERYERYSYAEKALISAESESEGNWCHEYRKLKAKIETIQKCHKHLMGEDLECLNLKELQQLEQQLESSLKHIRSRKSHLMMESISELQKKERSLQEENKALQKELVERQKAARQQQQEQWDRQTQTQQAQNQPQAQTSSSSSSFMMRDQQAHAQQNICYPPVTMGGEAVAAAPGQQGQLRIGGLPPWMLSHLNA

SEQ ID NO: 982 - protein, 279 aa, Lolium perenne
MGRGPVQLRRIENKINRQVTFSKRRSGLLKKAHEISVLCDAEVALIVFSTKGKLYEYSSQDSNMDVILERYQRYSFEERAIVDQNIGGQANWGDEFGSLKIKLDALQKSQRQLLGEQLDPLTTKELQQLEQQLDSSLKHIRSRKNQLLFESISELQKKEKSLKDQNGVLQKHLVETEKEKSNVLSNIHHREQTNGAANIHRREQMNETTHIHNQEQLNGATTSSPSPTPVAVLDSVATLNIGSSQSREAAGEEPESQPSPAQANSGKLPPWMLRTISNR

SEQ ID NO: 983 - protein, 352 aa, Elaeis guineensis
MVSQYTSRTDRQIAREMEGRGGSGGGGDNSGLMGGFSDGSGSLSPLMIMPLMASRPVLPPTPHMSNNGLFLPPPLSNAAGEDYDNSVIKAKIMAHPQYPRLLSAYVNCHKVGAPPEVVARLEEACATSLMMGRASSSSAAGDGGSGGGGGEDPALDQFMEAYCEMLTKYEQELSKPFKEAMLFLSRIDAQFKSLSLSTPPPPQVYGEQLERNGSSEEEFGASENYVDPQAEDRELKGQLLRKYSGYLSSLKQEFLKKRKKGKLPKEARQQLLDWWNRHYKWPYPSEAQKLALAQSTGLDQKQINNWFINQRKRHWKPSEEMQFVVMDTAHPHYFMDNSLGNPFPLDCAPALL

SEQ ID NO: 984 - protein, 302 aa, Oryza sativa Japonica Group
MAAAEAAAAVGKQQQKGGGGRGGGGGGPAPFLTKTNQMVEESATDEVISWGKEGRSFVVWKPVEFARDLLPLHFKHCNFSSFVRQLNTYGFRKVVPDRWEFANGNFRRGEQGLLSGIRRRKATTPQSSKSCGSGVNVAFPPPLPPLPPEPSATTSSGNDRSSSSASSPPRADITSENEQLRKDNQTLTMELARARRHCEELLGFLSRFLDVRQLDLRLLMQEDMRAAAGGVGGEQRVQEHAREEKCVKLFGVLLDDTHGAATRKRARCEEAAASERPIKMIRIGEPWVSVPSSGPARCGGDN

SEQ ID NO: 985 - protein, 388 aa, Oryza sativa Japonica Group
MEAVLRHPSLSRLKPPNPNAQRTPALSITVPFRLRLPNRRLTAAAVFQDQTNPRNPASKGGDDDEAYGEVDRIVSSRTIKNPVFAEDGSATTVTATEYLVEWKDGHEPSWIPAEAIAADVVAEYETPWWTAAKKADAAEITALLADETLRRDPDAEDAQGRTAMHFAAGLGSEECVRALAEAGADVGRPERAGGGLTPLHIAVGYGRPAAVRALLELGAEPEAPDGQGRTPLELVQDVLAKTPKGNPATFERRLALEAAAKELEKAVYEWGEVEKVVDGRGEGKWREYLVEWRDGGDREWVRAAWVAEDLVKDFDAGLEYAVAEAVVNKREAAEGEGKWEYLVKWVDIEEATWEPAENVDAELLQEFEQRQSGVAAGGDAPPPPPVAG

SEQ ID NO: 986 - protein, 499 aa, Arabidopsis thaliana
METEDDLCNTNWGSSSSKSREPGSSDCGNSTFAGFTSQQKWEDASILDYEMGVEPGLQESIQANVDFLQGVRAQAWDPRTMLSNLSFMEQKIHQLQDLVHLLVGRGGQLQGRQDELAAQQQQLITTDLTSIIIQLISTAGSLLPSVKHNMSTAPGPFTGQPGSAVFPYVREANNVASQSQNNNNCGAREFDLPKPVLVDEREGHVVEEHEMKDEDDVEEGENLPPGSYEILQLEKEEILAPHTHFCTICGKGFKRDANLRMHMRGHGDEYKTAAALAKPNKESVPGSEPMLIKRYSCPFLGCKRNKEHKKFQPLKTILCVKNHYKRTHCDKSFTCSRCHTKKFSVIADLKTHEKHCGKNKWLCSCGTTFSRKDKLFGHIALFQGHTPAIPLEETKPSASRSTQRGSSEGGNNNQGMVGFNLGSASNANQETTQPGMTDGRICFEESFSPMNFDTCNFGGFHEFPRLMFDDSESSFQMLIANACGFSPRNVGESVSDTSL

SEQ ID NO: 987 - protein, 252 aa, Physcomitrella patens subsp. patens
MEGASVSTNPRSVDEVFKDFRGRRAGMLKALTSEVEEFYRQCDPEKENLCLYGYPEETWEVNLPAEEVPPELPEPALGINFARDGMQRKDWLSLVAVHSDAWLLAVAFYYGARFDKNERKRLFNSINELPTVFDVVTGKKPVKEKASVVVNHNNNNNNNNNSGRNKTKSAAKAKPAPPPPKEDDDLEDEDEEEHGDTFCGTCGGSYTADEFWIGCDICEKWYHGKCVKITPARAEHIKQYKCPACSNKRART

SEQ ID NO: 988 - protein, 139 aa, Theobroma microcarpum
TEIIYKGTHDHPKPQPSRRYSSGNIMPGQEERSDKFSSFAGRDDKSSSMYGQMAHSIEPNSTADLSPVTANDDNIDEVDDDDPFSKRRKMDGGADITPVVKPIREPRVVVQTLSEVDILDDGYRWRKYGQKVVRGNPNP

SEQ ID NO: 989 - protein, 200 aa, Chlamydomonas reinhardtii
AAGLRGVRKRPWGMWAAEIRDRTSGKRRWLGTFNTAEEAARAYDTAARAIHGPAAKCNFPEGEWGEEEDEEERRMAVAHNRTGAGGQAADSLAPGQQPELEPAAGAETHLQLQLHLKQEHEEQGLHALATGHAALGPQAAAGAGLLRDGDYLAGAGDAFPSFHAFSGGYGGDAWDAFNGAGGLEDLHQLGNLDHDPAADM

SEQ ID NO: 990 - protein, 608 aa, Arabidopsis thaliana
MIETGKYLLGAAGASGFGSKSTAEEVTENCDLRSITAVITGATSGIGAETARVLAKRGARLIFPARNVKAAEEAKERIVSEFPETEIVVMKLDLSSIASVRNFVADFESLDLPLNLLINNAGKLAHEHAISEDGIEMTFATNYLGHFLLTNLLLNKMIQTAEETGVQGRIVNVTSGIHGWFSGDLIEYLRLISQPKCQFDATRAYALSKLANVLHTKELSSRLQAAATTCYVATNPRLVNVSGKYFTDCNETTPSGLGTNSSEATKLWAASEILEIVVKPLEEIVTNTCPKPQPQPLQPQQPPSVGGERKARPEKDQAVNCPRCNSTNTKFCYYNNYSLTQPRYFCKGCRRYWTEGGSLRNIPVGGGSRKNKRSHSSSSDISNNHSDSTQPATKKHLSDHHHHLMSMSQQGLTGQNPKFLETTQQDLNLGFSPHGMIRTNFTDLIHNIGNNTNKSNNNNNPLIVSSCSAMATSSLDLIRNNSNNGNSSNSSFMGFPVHNQDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 991 - protein, 185 aa, Guillardia theta
MSEKSNLAPFIKKLYQLVNDPMTNDYICWEKNETCFIVNKPTELSVYILPRYFKHNNFSSFVRQLNQYGFHKLEPNEWVFGHPYFKGGDKLKLSSIKRKKQWSSQKNVSVDFYNNEIFKKLIYELDTLKKYKQVLTKDILDVCRRQERFLIKQQSIETKIKKIEEELNNLKYLVFGYFGKILKSN

SEQ ID NO: 992 - protein, 325 aa, Brassica rapa subsp. pekinensis
MGRSPSSGDSRLKKGPWTPDEDEKLVKYVKKHGHSSWSALPKLAGLNRCGKSCRLRWTNYLRPDIKRGKSLRRREQTILNLHAVVGNKWSTIANNLPGRTDNEIKNFWNTHLKKKLIQMGVDPMTHRPRTDVLSSLSQLISLSSNLRGFVDQEQIMLKLQTEMAKLELFQYLLQPPSMYNNINPNDFDTRSLLSSIASTTNNNLNLGSYLQDFNSLPSLKTLNTNIGPSSVFPQNLDDNHFKFFNQRENLPVSPIWLSDPSSSNQSFLPSLDPSYSMADDLIRNQYVIEDVNSNLTSSSCQESGASVSAAWPDHLLDDSIFSHIP

SEQ ID NO: 993 - protein, 413 aa, Vitis vinifera
MGSSEMDKAGKEKESKTPPTTTQEQSSTTSAGTVNPDWSGFQAYSPIPPHGFLASSPQAHPYMWGVQHLMPPYGTPPHPYVAMYPPGGLYAHPSIPPGSYPFSPFAMPSPNGIAETSGTTPGSMEADGKSSEGKEKLPIKRSKGSLGSLNMLTGKNNELGKTSGASANGVYSKSAESASEGSSEGSDANSQSDSQLKSGCRQDSLEAETSQNGSTCHAPQNGGPNTPHAMVNQTMAIMPISAPGAPGGVPGPTTNLNIGMDYWGAPTSSTIPAMRGKVPSAPVTGGIVTAGSRDSVQSQLWLQDERELKRQRRKQSNRESARRSRLRKQAECDELAQRADALKEENASLRAEVSRIKSEYEQLLSENASLKERLGEIPGQDDHRTGGRNEQHLGNDTKQTGQTGQAEHGQGGH

SEQ ID NO: 994 - protein, 436 aa, Ceratopteris richardii
MEDKSYVESKLGAPTWLSGAVQQQQVRASQQGTTNSAGSSFVNEATQQQQSHDTPRKWCGCEAGGQCVQCSFMHLSGGGAGGGGSSVAGNGIAMTANHNQQHSAAEAAGLLAIARSGGDLAQSGQGGRGNLLDLHSDTANSSDLVEGEHGGGEHGGGGHNQQDSQVLWQNARLKADITMHPLYDQLLAAHVACLRIATPVDQLPRIDAQIAQASQIVAKYAVLGQNNLLVGEEKDELDQFMAHYVLLLCTFKEQLQQHVKVHAMEAVMACWELEQSLLTLTGVSPGEGTGATMSDDDDDPAESDPSIYDPAFDTHDSGAFGPLIPTETERTLMERVRQELKNELKNGYKDRIVDVREEILRKRRAGKLPGDTTSVLKAWWHAHSKWPYPTEDEKARLVQETGLQLKQINNWFINQRKRNWHSNPSSTAAMKTKRKR

SEQ ID NO: 995 - protein, 383 aa, Picea abies
SRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEELTKPFKEAMAFLKKIENQLGALTKGTIRTSSLDQGDERGDGAASSEEEDGSGGEVEFHEVDPHAEDRELKDQLLRKYSGYLSSLKQEFLKKKKKGKLPKEARQKLLDWWTRNYKWPYPSESQKIALAESTGLDQKQINNWFINQRKRHWKPSEEMQFVVMDSPNPHNAAFFLEGHLRTDGTAFSMDC

SEQ ID NO: 996 - protein, 216 aa, Glycine max
MAKTRPGRKDLDSYTIRGTNKIVRAGDCVLMRPSDTSKPPYVARVEKIEQDNRNNVKVRVRWYYRPEESIGGRRQFHGAKELFLSDHYDVQSAHTIEGKCIVHSFKNYTKLENVGAEDYYCRFEYKAATGAFTPDRVAVYCKCEMPYNPDDLMVQCEGCKDWYHPACVGMTIEEAKKLEHFVCSECSSDDDMKKPHATFSVSPGSDVKVEPKRRKR

SEQ ID NO: 997 - protein, 433 aa, Picea abies
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPSVKTEVGSGLRNQLEFHREQTGNGYTDQSSNTPVNPLVTSLASQARGEAQMIPSWDANSPHFNVDNEEYAIKSKILAHPQYPSLLGAYIDCQKIGAPPEAVARLDALTREYQNQQRRTVSIGMDPELDQFMEAYCEILTKYHEELAKPFKEAMTFLMKIEAQFNSLGKGTIRISPPAENDKKTEGGGSSEEVEDGSGGETDFQEVDHHAVEDRELKDHLLRRYSGYLSSLKQEFMKKKKKGKLPKDARQKLLDWWSLHDKWSYPSETEKIALAECTGLDQKQINNWFINQRKRHWKPSEDMHFMVMNSHSPHSAALYVERHLMTEGYHLDC

SEQ ID NO: 998 - protein, 429 aa, Arabidopsis thaliana
MEDQVGFGFRPNDEELVGHYLRNKIEGNTSRDVEVAISEVNICSYDPWNLRFQSKYKSRDAMWYFFSRRENNKGNRQSRTTVSGKWKLTGESVEVKDQWGFCSEGFRGKIGHKRVLAFLDGRYPDKTKSDWVIHEFHYDLLPEHQRTYVICRLEYKGDDADILSAYAIDPTPAFVPNMTSSAGSVVNQSRQRNSGSYNTYSEYDSANHGQQFNENSNIMQQQPLQGSFNPLLEYDFANHGGQWLSDYIDLQQQVPYLAPYENESEMIWKHVIEENFEFLVDERTSMQQHYSDHRPKKPVSGVLPDDSSDTETGSMIFEDTSSSTDSVGSSDEPGHTRIDDIPSLNIIEPLHNYKAQEQPKQQSKEKVISSQKSECEWKMAEDSIKIPPSTNTVKQSWIVLENAQWNYLKNMIIGVLLFISVISWIILVG

SEQ ID NO: 999 - protein, 499 aa, Arabidopsis thaliana
METEDDLCNTNWGSSSSKSREPGSSDCGNSTFAGFTSQQKWEDASILDYEMGVEPGLQESIQANVDFLQGVRAQAWDPRTMLSNLSFMEQKIHQLQDLVHLLVGRGGQLQGRQDELAAQQQQLITTDLTSIIIQLISTAGSLLPSVKHNMSTAPGPFTGQPGSAVFPYVREANNVASQSQNNNNCGAREFDLPKPVLVDEREGHVVEEHEMKDEDDVEEGENLPPGSYEILQLEKEEILAPHTHFCTICGKGFKRDANLRMHMRGHGDEYKTAAALAKPNKESVPGSEPMLIKRYSCPFLGCKRNKEHKKFQPLKTILCVKNHYKRTHCDKSFTCSRCHTKKFSVIADLKTHEKHCGKNKWLCSCGTTFSRKDKLFGHIALFQGHTPAIPLEETKPSASTSTQRGSSEGGNNNQGMVGFNLGSASNANQETTQPGMTDGRICFEESFSPMNFDTCNFGGFHEFPRLMFDDSESSFQMLIANACGFSPRNVGESVSDTSL

SEQ ID NO: 1000 - protein, 250 aa, Physcomitrella patens subsp. patens
MEGASISANPRTVDEVFKDFKGRRSGMLKALITDVEDFYRQCDPEKENLCLYGFPDEAWEVNLPAEEVPPELPEPALGINFARDGMQRKDWLALVAVHSDAWLLAVAFYYGARFDKNERKRLFNMINELPTVFDVVTGKKPVKEKLAVNNISGTKAKPAAKQQVTQAKPAKPAPLPQKDEEDALDDEDEEEHGDTFCGSCGGPYTADEFWIGCDICEKWYHGKCVKITPARAEHIKQYKCPSCTNKRART

SEQ ID NO: 1001 - protein, 280 aa, Oryza sativa Japonica Group
MAAAIEGNLMRALGEAPSPQMQKIAPPPFHPGLPPAPANFSSAGVHGFHYMGPAQLSPAQIQRVQAQLHMQRQAQSGLGPRAQPMKPASAAAPAAAAARAQKLYRGVRQRHWGKWVAEIRLPRNRTRLWLGTFDTAEEAALTYDQAAYRLRGDAARLNFPDNAASRGPLDAAVDAKLQAICDTIAASKNASSRSRGGAGRAMPINAPLVAAASSSSGSDHSGGGDDGGSETSSSSAAASPLAEMEQLDFSEVPWDEAEGFALTKYPSYEIDWDSLLNNNN

SEQ ID NO: 1002 - protein, 89 aa, Oryza sativa Japonica Group
MGGEAERCALCGAAAAVHCEADAAFLCAACDAKVHGANFLASRHHRRRSFRTTEAPAFSFIASVRWKKRLLIVLAEYKYATSNQFPTLN

SEQ ID NO: 1003 - protein, 139 aa, Theobroma speciosum
TEIIYKGTHDHPKPQPSRRYSSGNIMPGQEERSDKVSSFTSRDDKSSSMYGQMAHSIEPNSTADLSPVTANDDNIDEVDDDDPFSKRRKMDGGADITPVVKPIREPRVVVQTLSEVDILDDGYRWRKYGQKVVRGNPNP

SEQ ID NO: 1004 - protein, 139 aa, Theobroma velutinum
TEIIYKGTHDHPKPQPSRRYSSGNIMPGQEERSDKVSSFTSRDDKSSSMYGQMAHGIEPNSTADLSPVTANDDNIDEVDDDDPFSKRRKMDGGADITPVVKPIREPRVVVQTLSEVDILDDGYRWRKYGQKVVRGNPNP

SEQ ID NO: 1005 - protein, 407 aa, Oryza sativa Japonica Group
MSAAEDPAKPPPPPPPQLEASGSDPDDPLLRDRVVVIAPPPPPPPPPPPPAPAPALLAPAENASAEAAFAVPPAAIAAVVEANGNSEKKKKRKTDEGEGCKSCSCKKSKCLKLYCVCFASGSHCSESCGCDPCYNKSIHGVPRSTPALPLKAVQTLETGQDSVEQLIRSPMDFGRRKCTCKKSGCLKKYCDCYQGGAGCSINCKCDDCKNPYGRKVGVILDGKNILAGPTPNERNGTEADSSDDEEDDYYMNRPLSPVSPSPVSRESSFQQETLVGVEVQTMNGHLYPKPLTQVRPESWQLTRRPTEEVRGEAWHYLRRPSEDGTSDVMEGHADPKFQRDNKQLENHVDRYSIPRCIEVMNAMADLSPIEKSLAPDVFLDPSNREIFLSLTVDIRTMWLKRKMKSLV

SEQ ID NO: 1006 - protein, 211 aa, Aeropyrum pernix K1
MGGEASGGDILDRLLAESRKAPLRIAEVDNAVCPACGARAMKLSEYLYSVPYFNNIVISVGECRNCGYRYRDVRLAEATEPKKIVVAVRGEKQLRYLLAKSPLSAVYIPEMDLEMVPGVASVGFITTVEGILHRFHEVAQVACKEDVVEAEDLEKCRSVIRWLEEAIEGRRAFTLIICDFDGLSRVIGEHPYVAEEAIDERCQALKPGFME

SEQ ID NO: 1007 - protein, 760 aa, Oryza sativa Japonica Group
MDTPDRPPRAAATAAVEDSPVFNFINSLSPIPPPKPSDSAHNVQLFKSSDLAPVSSIFASPHVNPAKESKLPIREDSVQLSRESHSPNSVRTRTGATSSIIRMIRCKNIVSENCSITCYLNDSTSSKASQPIQLCGGSAESDTNQNTDGKKDPTTEQDRTDIEFVLLDQCGPEKMDSSQSGNNACENQLSEQHKDELGSFDGGYMFAHQPHSDMLRLAPPFESETQLVNETLQTDNVYCETLLTDGPSGSYTQNSAPDPHLYWAGAVEGCATDYTPQMLPGACQSQLVPNDQINNKLNEPSDYMPMDHNVSSQNLRGMRRRCLFNEKSGAANEGAKNSSARHSTNSTTPRRKISSSDNNLKTLRTPPCALPGIGLHLNALATVPKDKMVPHNDIQSSLNQASNVPSAVGSSPPTDDPHTINDDSSQTAVVAYVGESSQGSPKKKRHKFDNGDGTSCKRCSCKKSKCLKLYCECFHAGVFCSEPCSCQGCLNMPSNMETVLSTREQIESRNPLAFAPKVIRTEPGQELADDSNKTPASSRHKRGCNCKKSSCLKKYCECYQGGVGCSVSCRCEGCKNAFGRREGVALLGIEEAKRGCEEKDGGVKEETTDNDKQLVIYQDSINLTPAESVLATPSVVDYRPLVALPPLSSKKPRSSTKLGGYSSRLEGHLKSDILLSPFESYAEMMLGDGTSNVLKGESSPQTSVKVVSPNKKRVSPPRIGTGLSPICKSGRKLILKSIPSFPSLGVDITNEDPNTSSLAP

SEQ ID NO: 1008 - protein, 78 aa, Chlamydomonas reinhardtii
LCHVDDCNVDLSSLKEYHQRFRICDFHLKAEVVLREGIPQRFCQQCGRFHLLSEFDGTKRSCRARWVCGGSTHRSSTS

SEQ ID NO: 1009 - protein, 206 aa, Streptomyces avermitilis MA-4680
MISVVYGPERTRSAVAIRVLALVALVWILMGVPPETAVADACAYVSTGPDGIEVVAAAGDGLRCPVPSTPPPCPTPTPTLTPPPPPPPPPPPPAPTPTPTPSPTPTERPRPTPRPDPPPPRPAPPPPVAVAPRPTPTPTPTPTPTPTPTRTRAPRPSPPPEASPVSYPRYHASAHQRPPRGGPPLVTLALLITAPAVLAVAALRPR

SEQ ID NO: 1010 - protein, 86 aa, Physcomitrella patens subsp. patens
KRRVRRPFSVVEVEALVHAVEKLGTGRWRDVKIQAFEQAKHRTYVDLKDKWKTLVHTARIAPHQRRGEPVPQELLERVTRAHTYWT

SEQ ID NO: 1011 - protein, 315 aa, Zea mays
MDMDFNGDADSFALDFIRDLMLGGDSSIPVPSPVAASSDDVTCPVLPPQLEFQSVSFLPHQQRQGYIDLTTSECVGAAPAAATVVGEAVFRAQEPAPPVMIKFGTEPSSPLATTRQPLTISVPPSSYAWAAVEDYRKYRGVRQRPWGKYAAEIRDPKRRGSRAWLGTYDTPVEAARAYDRAAFRMRGAKAILNFPNEVGTRGADLWAAPTANKRKRQQMVEGEDDPEPEVEVVPMVNKAVKTEAQSSMTTQASSPSPSSTVAWTTTGTTGGAGWLPVTPSSGSSEQYWETLLRGLPPLSPLSPHPALGFPLLSVN

SEQ ID NO: 1012 - protein, 574 aa, Sphagnum palustre
MVDEGQLHNRNCNEYTSIVHSSDHQLAMAQRLEQLETVLTAAAAQEASIAHSSSDGSMALNSSDRRVWCWIEGMIEELTAANNVPAQRSSPFTADSPYNNTTVEGSSTSLDSSLDTDSPSQVPPLHYQEALLDNGFSSTGLPCATTSYPAYSKSCSMLLHQQSTDFSSETPVLPMMESRNHQRPQVNEDEQEDNGVQLVHSLLACAEAVQHGDLVRAEETVRHIQLLASPPGPMGKVAAHFIEALTRRIYGGTSSSQDSSSCSVVVGYESDNYLSELLHFQYYETCPYLKFAHFTSNQAILEAFEGEKRVHVIDFNLMHGLQRPALIQALALRPGGPPSLHLTGIGPPQAGGNNGLQEIGMKLAQLATSVNIEFDFRGVVALKLNEVKPWMLQVLPGEVVAVNSVLQLHQPLNSDEGPVLAIDEVLHSILGLKPKIVTVVEHEANHNVFGFLDRFTEALHYYSTTFDSLEACNLQPQSSEQLLAEMYLGQEICNIIACEGVARVERHENLEQWRQRIAKAGFRPLQLGSTALKQAKLLLSLFPGDGYRVEENNGCLTLGWHTRPLIAFSAWQCA

SEQ ID NO: 1013 - protein, 450 aa, Zea mays
MAVGSVLSHGALDIQVRHRTQSVDRCARSSRCSAGTPDSPVNYSGAPSEFPEGEEFSLECPGAPDTVRSCERGAADRPIGMWEGGGFHGSHEALLLQAAGSGAADYGHGAGPALLPWLGPAAGAAPGFSYMAPHHAQPGPSGAEAAASPFGFGGGGYSDGGVGGQFGVFGGPETALPAPHGLAAAAGGGTSAMQHGSRMVSGLLGTLQMELGRMAAKEIMDAKALAASRSHSEAERRRRQRINSHLARLRSLLPNTSKTDKASLLAEVIEHVKELKRQTSAVLDVEGEEAAAARQRLQLLPTEADDLAVDATEDGEGRLVVRASLCCEDRAGLIPDIARALAALRLRAHRAEIATLGGRVRNVLLITAAADDDDGEGEGDDDDDDVEGDGGCAGGNASSSRRHELVASIQEALRGVMDCKTASSDTSSSSNGGGSMKRQRMSGAHEQGSL

SEQ ID NO: 1014 - protein, 582 aa, Selaginella kraussiana
MESMLQAVYEGARSAAARRTTMEANESMAGGNGGGGGGHEQWKSTTTTEVDEHLARVGYNVRASELPHIAQQIEVLDSLIGAAPESLLGGVSQDTVHYNPSDLASWVECLLDELGPLPASMATTTTTTSMVRAESESSSVVTNSQHFGFAPQPQQQQQVLYNDLQSPPSSSSAVLQSMPSMAMPPTTTEELGVQLVHLLLACADAVQRREIPAAGDMARKLRSMLAGGAADSSGAMGRVAAHFVEGLCRRIFGGGGVGLGGIPGLDITGVSSATVDEILHFHYYETCPYLKFAHFTANQAILEAFEGQSQVHVVDFNLEYGLQWPALIQALALRPGGPPQLRLTGIGPPQPGGKDLLQEIGLKLAQMAESVNVEFTFHGVVAARLEDVRPWMLTCRSGEAVAVNSVFQLHATLLDGEGAAGSSPVAPSPVTEVLRWVRGLNPRIVTVVEQDADHNGVDFLDRFMAALHYYSTMFDSLEACNLAAGSLEQVVAEAYLGREVVDIVAADGPERRERHETLEQWRSRMISAGFQPLFLGSNAFRQASMLLTLFSGDGYRVVENGGCLTLGWHSRSLIAASAWRCS

SEQ ID NO: 1015 - protein, 553 aa, Physcomitrella patens
MAYQYSPGGSRWKPTGGTLVDGRLRHDKFTQASDAVQQLEELHTSLGSVSQDSLNIPAYYTLGSSSQAVSNCSTDLAGWIDCMIEELSSNTACPIMAPQQQHGLLEGSFLKNDHDASSCRDSLLETGSHRLSNVQFQDTSAARNKSSTAPHNGTSQVNAIRTTAAGLEQQLNKMGEDENNGIQLVHSLLACAESIQRGNLSFAEETLRRIELLSLPPGPMGKVATHFIGALTRRIYGVASSSGNNSSSNQSDSLLGLLHFYFYESCPFLRFAHFTANQAILEAVTGLKEVHVIDFNLMQGLQWPALIQALSLRQGGPPRLRLTGIGPPQPSGSDTLQEIGTKLAELAKTVRVDFEFRGVIAVKLDDIKPWMLQIRHGEAVAVNSVLQLHKLLYSAGPEAPIDAVLLLVRELKPKIFTIVEHEANHNQPSFLGRFIEALHYYSTMFDALEACNLPSENNEQVLIEMYLGREIYNIVACEDGARTERHENLFQWRLRLLKAGYRPIQLGLNAFKQASMLLTMFSGEGYRVEEKLGCLTLGWHSRPLIAASAWKCA

SEQ ID NO: 1016 - protein, 552 aa, Physcomitrella patens
MAYQYYPGSTRYEATGGALVDGQFRHANFMQPSDLVQHLEQLHSVLGTVSQDSPNIPAHHTLDAGAQTSNNRTSDLAGWIDGMIDELSFNNAGTMAAPQQRSLTEDSLHQNELEASSSHDSSLDTGSSRLPTLHYQNTPAVGNNFLATPQNDASQLNANRATGAVLEQQPSPMGEDEDNGVRLVHSLLACAESIQRGNLNLAEQTLRRIQLLSLPPGPMGKVATHFIDALTCRIYGVAFSSGNNVGSNQSDSLSELLHFHFYETCPYLKFAHFTANQAILEAFAGQKQVHVIDFNLMHGLQWPALIQALALRPGGPPRLRLTGIGPPQSGGSDVLQEIGMKLAQLAETVKVEFEFRGVVAVKLDDIKPWMLQICHGEAVAVNSVFQLHKLLYSAGSVIPIDEVLRSARALKPKIFTIVEHEANHNQPSFLGRFTEALHYYSTMFDSLEACSLPSDSSEQVLAEMYLGREINNIVACEDAARVERHENLVQWQMRMLKAGYRPIQLGLNAFKQASMLLTMFSGDGYRVEEKLGCLTLGWHTRPLISASAWQCA

SEQ ID NO: 1017 - protein, 210 aa, Gerbera hybrid cv. 'Terra Regina'
MGRGKVQLKRIENKINRQVTFSKRRGGLLKKAHEISVLCDAEVALIVFSAKGKLFEYSTDSCMENILDRYEQYSNIDRQHVAVDTDSPIRWTQECNKLKSRAELLQRNLRHYMGEDIESLGLREIQNLEQQLDTALKRIHSKKNQLLHQSISELQKKEKAIQEQNNTLIKNIKEKEKTITQKAQWEPHNYGPNTTPLLFSLPPHSSLNIG

SEQ ID NO: 1018 - protein, 1028 aa, Cryptococcus neoformans var. neoformans JEC21
MSRVPSGSQQPQYTQQPLYHPSSVHSQSTPIQQTHQQYHPHTGQPMTFQGDAHAYSYDRQSQINTWQANPGAAGSMEYHSAVAGSSRGADPYQPYSQSHRSSPSQSVTASRTQPASAQQYTPWAPVQTSATTPSSRGGGVKLEDLMSSDSRAGGKNQPLSGIPLSVSASFDTRSQFSAGPQGASAEKEKDKERDKATQQQGPSEFIKKLYKMLEEEQAQYGNSRTKKGEKGKRGSVGWGANGTSFVVWDMNDFTTKILPQTFRHSNFSSFVRQLNKYGFSKIWEFQHPNFQAGGKSDLESIKRKPVAPKKANNQEGDENSPRHIGLSNEDQTRMHLMEDRINMLEDALAKSRSEADEARMREMAMMGLVRDMIGHIAASESDNLARAYPPEMYHSNIARQPTTMPYTPAQPQSHQSFLNAAYNPAFSGNSVGGAVQAQASPHTDGTGSRGSFSGPSTGEIKPPASSSRLRAASNAGAAPSGSVNASVPLASQPSGNPPAGPVARAEDPAEDVIEIPNQMQDMYGGESVGIAPLFVETPAWLTEGTTVPLTMYRKQSDGQVLKAVYQAFAAGGKLPAGEGQDEDGNAIASGSSTSAAEIMAGSSQMGLQQSYGAGSSTSTGIPLPMDGSPSSESSSRKGKGKKSRGTSLKEQRESKLKPHWAQTPRILVVEDDIVYRTLSKKFLQKFGCETETVENAQGAVDKMNGTKYDLVLMDIFFGPNMDGRKATSLIRQFNNYTPIISMTSNAQPQDVDSYYQSGMNDILAKPFTKNHLFTILDKHLVHLRHAQLYERLIPLGVGVPPLSDQHVQEALAVSAANLQNTNGQLQLENGPTAETQNEQQDSNGELELGIRNPLAGSGWSDEAYQLVLAQFLQTGVMPDITTISAVSSSPNPNGIDGTIGTSIVFGESSGFSRKRSIEAISDDNWDGQAQTSASVQAQAQAQAQAQAQAQAQAQAQAQAQAQAQTQAQAQNTIMQGDQQQGMSLQMPMNVGMGMEVNMGNMPESGMMNQDISNGSDGREAKRARGMAG

SEQ ID NO: 1019 - protein, 330 aa, Arabidopsis thaliana
MGDTSPRTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIASQLEPLTEQQSLDINNLQQSSQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 1020 - protein, 264 aa, Glycine max
MVRAPCCEKMGLKKGPWTPEEDQILMSYIQKHGHGNWRALPKLAGLLRCGKSCRLRWINYLRPDIKRGNFSSEEEEIIIKMHELLGNRWSAIAAKLPGRTDNEIKNVWHTHLKKRLLNSDIQKRVSKPRIKRSDSNSSTLTQLEPTSSACTTSLSDFSSFSEGTKNMDNMIKSEDIESVETIMPPIDESFWSEATVDYESSTMMTSNSWTISNELAPPQYQFNSVESFQQRSVDYNGSNDDHDGMDFWYDIFIKSGESIELPEF

SEQ ID NO: 1021 - protein, 84 aa, Physcomitrella patens subsp. patens
MIPEETHSPEPAKKRKYRGVRQRPWGKWAAEIRDPKKAARVWLGTYDTAEEAAQAYDKAAKEFRGLRARLNFPDGVHMGIGSSS

SEQ ID NO: 1022 - protein, 296 aa, Daucus carota
MGSSPDHIADEGLALDVIRQHLLLDDFSFMENYVFPNSNSSIDQSATTSSDNTSLVSDLTFNNNVAVDSYVAGSHDATLNHFSFQPNSAIKRTNSSSFSERKPTLNIAVPPASKVGFQPAAKLSDRRVADSGEKRHYRGVRQRPWGKFAAEIRDPNRKGSRVWLGTFDTAIDAAKAYDRAAFRLRGSKAILNFPHEIAQSPETSPPVSNIGRKRVKENKAEQEREIKREKVSADSNCEVVAAGACPLTPSMWTEVWEGGEEKGGIFEIPPLSPLSPYLNFTQLNAGDVKKQQVAQQ

SEQ ID NO: 1023 - protein, 554 aa, Zea mays
MADTPTSRMVHPFGDVPRQTPKQFLYSGNPQHLCHPYQSAPDTHVVPQRRYTVRSQSHSPNNAGSQDHETHKQYTLESSAASGCSRHGSPSSQSVHAGSGSPVSHDDSHSGSTNGHGSPVSASCVTGEDPTDLKQKLKDLEAVMLGTSETDPEIVNSLEISAANQLSLEPEEWEHMVSMPRGNLKELLIACARAVERNNSYAIDLMIPELRKMVSVSGEPLERLGAYMVEGLVARLAASGSSIYKALKCKEPRSSDLLSYMHFLYEACPYFKFGYMSANGAIAEAIKGEDRIHIIDFHIAQGAQWVSLLQALAARPGGPPFVRVTGIDDSVSAYARGGGLELVGRRLTHIAGLYKVPFQFDAVAISGSEVEEEHLGVVPGEAVAVNFTLELHHIPDETVSTANHRDRILRLVKGLSPKVLTLVEQESNTNTAPFAQRFAETLDYYTAIFESIDLALPRDDRERINIEQHCLAREIVNLVACEGEERVERHEVFGKWKARLMMAGFSPSPLSALVNATIKTLLQSYSPDYKLAERDGVLYLGWKNRPLIVSSAWH

SEQ ID NO: 1024 - protein, 309 aa, Arabidopsis thaliana
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRTASGGGGVVVVTALSPTGSDVSEQSQSSGSVLPVSSSCHVFKPTARAGGVVIESSSSEEEEKDPMTCLSLSLPWVNESTTPVELFPVKREEEEEKEREISGLGGDFMTVVQEMIKTEVRSYMADLQLGNGGGAGGGASSCMVQGTNGRNVGFREFIGLGRIE

SEQ ID NO: 1025 - protein, 536 aa, Zea mays
  misc_feature (456)..(456): Xaa can be any naturally occurring amino acid
MASPAIPFAPLTSHRAAPFVLGCPPPWPPPPPPAARPRPPPPRPDAAAAARLLEEEAGAGSSRARSPGGPELESMVLDLNAESPTPGSASAASSSSVVVGGGFFRFDLLGGTPDEEGCSPSPPIVTRQLFPLPYPDAAGSTAASTASNGSPPPEVAGAWARRPADLGAPALAQGKVVSAPSSPAVVSPAAGKKSRRGPRSRSSQYRGVTFYRRTGRWESHIWDCGKQVYLGGFDTAHAAARAYDRAAIKFRGLDADINFQLKDYEDDLKQMRNWTKEEFVHILRRQSTGFARGSSKYRGVTLHKCGRWEARMGQLLGKKYIYLGLFDSEIEAARAYDRAAIRFNGPDAVTNFDSVSYDGDVPLPPAVEKDVVDGDILDLNLRISQPNVHDLRSDGTLTGFGLSCNSPEASSSIVSQPMGPQWPVHPHSRSMRPQHPHLYASPCPGFFVNLREAPMXKRRTGPSRACPQPFPSWSWAWQTQGSRAPVLPATTAASSGFSTAAATGVDAATAGHSVPPPSGSLRQFSGYHQLRFPPTA

SEQ ID NO: 1026 - protein, 259 aa, Daucus carota
MCGGAIISDFEPPPLTTGSRKVNKHDLWDQPGFASTLPQLSGSWTDHFEAKLPQLPLHGPPLKPKKIITKEEVSEEGDEKLSQEGNKRSRKNKYRGIRQRPWGKWASEIRDPQKGVRVWLGTFNTPEEAARAYDEAAKRIRGDKARLNFPEDQPPEPVPLPPLAKKQCTAKAITEINYPNFSSPLMGMEFSTTFQPPNYCASDELELKDRHQVSNTEPCLLGWEAEIMTQIGVTDSDVYQWMMMDNLDQIANHLMQEFE

SEQ ID NO: 1027 - protein, 249 aa, Oryza sativa Japonica Group
MDGEEDSEWMMMDVGGKGGKGGGGGGAADRKKRFSEEQIKSLESMFATQTKLEPRQKLQLARELGLQPRQVAIWFQNKRARWKSKQLEREYSALRDDYDALLCSYESLKKEKLALIKQLEKLAEMLQEPRGKYGDNAGDDARSGGVAGMKKEEFVGAGGAATLYSSAEGGGTTTTTTAKLMPHFGSDDVDAGLFLRPSSQHHPPPPHAGAGFTSSEPAADHQSFNFHSSWPSSTEQTCSSTPWWEFESE

SEQ ID NO: 1028 - protein, 492 aa, Kluyveromyces lactis NRRL Y-1140
MPEDLFKPVGEIVEDAEHANEGQQGTTQNGENQADDTGLVQTGAFDAMGHPVQEIPSLCMNCHKMGTTRLLLTRIPYFREVVLMSFACEHCGFKNCEIQPASEIQEKGSKYMLKVEEKDDFNRQVIKSETASCKFVELDLEIPGKRGQLTTVEGLLSEMVDDLESDQPLREKIDKPLYDQIQAFIDKVKDTIACKDGTLPITFVIDDPTGNSWIEYKPGEAAHKWSHAEYTRSDEQNVQIGLITRDQLEERRKEERERIEAERERNPSVAKKEGAAAQGFLSDATDIENFSNEVQTFRASCPNCLQQCDTHMKRVNIPHFKEVIIMSSICDHCGYKSNEVKTGGAIPEKGRKITLYCDEPDDLSRDILKGENCKMSIPELSLDIQEGTLGGRFTTLEGLLRQVYEELESRVFTQTSDSMDEPTKQRWVSFFGRLQDALAGKVKFTVHMEDPLAGSYIQNVYAPDPDPNMTIEDYERTPEQNEELGLTEMKVD

SEQ ID NO: 1029 - protein, 308 aa, Glycine max
MDGMYGVPAEYADKALMTPENLIFPPDYHHDFLAAGRIPLFGSDEFFSSSAGIHRQQEDDVAATTVMKAKIASHPHYPRLLQAYIECQKVGAPPEIARLLEEIRRENDPCKSDAVSSSTCFGADPELDEFMEAYCDMLVKYKSDLARPFDEATTFLNKIEMQLSHLCTGASVSNVSDDGGVSSDEDLSTGDGDAQDGQLKGEDRELKDRLLRKFGSHIGTLKLEFSKKKKKGKLPKEARQALLQWWNVHYKWPYPTEADKIELAKSTGLDQKQINNWFINQRKRHWKPSENMQFSMMENFNGRILADE

SEQ ID NO: 1030 - protein, 119 aa, Abelia x grandiflora
TAHGPRDRRMRLSLEVARKFFGLQDNLGFDKASKTVEWLLTQSKSAIEDLTRAIKGLNSNHSSSVGANSTSSTSECEVLSGTDELRGQLAKAKGKGSGSKDKKRKAIVRRVAFDSTARE

SEQ ID NO: 1031 - protein, 297 aa, Oryza sativa Japonica Group
MGAPKQRWTAEEEAALKAGVAKHGTGKWRTILRDPEFTALLRLRSNVDLKDKWRNLSVTAGGYGSRERARVALKGGKRGPKALAEPMDADEKNPDIDDNAIIDAQPLAVVVEPMQLESTPEKEKSVARLDDLILEAIKKLKEPSGSNRTTISSYIEEQYWPPEDFQRLLSTKLKALVATGKLIKVNQKYRIAPSSNSSGGKSIKVYSTGEMNIENNNVRQLSKPQVDAELDKMKSMSKEEAASFAARAVAEAEAAIAEAEEAARAAEAAEAEADAAKAFLDAVVTTMQNRNHASAVY

SEQ ID NO: 1032 - protein, 399 aa, Arabidopsis thaliana
MEGETHQSEPLPLASGDSDEGISAAIEAELAELAAGDSSGGGGCGGGGGGIRSKVKGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLRRKYADLWNNGQWMANSVTTASVKNENVDETTNPPSSKQQLPQGDINSSPPKPPQVSDVVMEEAANEPQEPQEQQEQAPPVVSNVPTENNVFRPVARVGAFSIYNPTSQKNGYRDYNIVPCEGPLIQAAKPDSLAGKFLQSLCDEPQIPSKCGHGCSTLPAETKFSRNSVLGPEFVDYEEPSAVFNQELISIATDLNNIAWIKSGLDNAVVREAEQSLKMDNYNYNDPRIKFTGMMPRQDFFCARS

SEQ ID NO: 1033 - protein, 175 aa, Taraxacum officinale
DQFMEAYCEMLIKYEQELSKPFKEAMLFLSRIESQFKAISFSPSDSGCGEGGMDRNGSSEEDLDVDVNNNNLVDPQAEESELKGQLLRKYSGYLGSLKQEFMKKRKKGKLPKEARQQLLDWWTRHYKWPYPSEAQKLALAESTGLDQKQINNWFINQRKRHWKPSEDMQFVVMDA

SEQ ID NO: 1034 - protein, 124 aa, Diervilla sessilifolia
TAHGPRDRRMRLSLDVARKFFGLQDMLCFDKASKTVEWLLTKSKSAIKDLTRGGGGLNSNHSSSVGGANSASSTCECEVEVLSGIEEPGGVDENDHTRKGKGSGAKEKKSKGARRIAFDPITRE

SEQ ID NO: 1035 - protein, 119 aa, Dipelta floribunda
TAHGPRDRRMRLSLDVARKFFGLQDILGFDKASKTVEWLLTQSKSAIKDLTRATKGLNSNHSSSVGANSTSSTSECEVLSGTDEPRGQLAKAKGKGSGSKDKKRKAIVRRVAFDSTARE

SEQ ID NO: 1036 - protein, 127 aa, Dipsacus pilosus
TAHGPRDRRMRLSLDVARKFFSLQDILGFEKASKTVDWLLSQSRSEIEELTRAHNSSIGAANSTSSASECEVLSGTDHEPKPKLGKSKEEGKDLGAAKDKEKAADKKKKKKRKGIVTRVAFDSTARE

SEQ ID NO: 1037 - protein, 377 aa, Arabidopsis thaliana
MTKKLNPLEDPPTATSSDEDDVETSEAGEASDDSSSSEEDAPIKIRIKSPSATTAAAPPAKSTAVSAAADSDSGSETETDSDSESTNPPNSGSGKTIALNAVNLKKKEDPTSSSATLALPAVKSGTKRPASEAAATTSTKRVKKDEETVKKPGGFQRLWSEEDEILVLQGMIDFKADTGKSPYVDTNAFYDFLKKSISFEVSKNQFMDKIRSLRKKYIGKEGRNEPSFVKAHDKKAFELSKFIWGPKGIALDSNVKSNGVSKKSVAKKKIDSVKQELVFVGGSSTNNGKKVEEDGGDDGCDWFDNSSLVRMIASLGVDEYYVKQQWSLVSVESKKIVEEKYKLLQAKELEFVLEKTKFLNEVASMFVEASKNKPLDT

SEQ ID NO: 1038 - protein, 114 aa, Heptacodium miconioides
TAHGPRDRRMRLSLDVARKFFGLQDMLGFDKASKTVEWLLTKSKSSIKELTRDGGGSSSVGANSASSTSECEVLSGIEDTRVADITKGKGTSGAKAKKVKGSSRRVAFDANARE

SEQ ID NO: 1039 - protein, 269 aa, Witheringia solanacea
MAREKIKIKKIDNITARQVTFSKRRRGLFKKAEELSVLCDADVALIIFSSTGKLFDFASSSMKNILGKYKLHSANLEKDDQPSLDLQLENSLNVRLSKQVADKTRELRQMKGEELEGLSLEELQQIEKKLEEGFNRVLEIKGTRFMDEIANLKRKGAELMEENKQLKQKMGMMKVGKLPLLTDMDCMAMEEGQSSDSIITTNNACSSNSGPPPEDDCSNASLKLGCNNGPAAVEDDCSNASLKLGCNNGPAAVEDDCSITSLKLGLPLS

SEQ ID NO: 1040 - protein, 451 aa, Oryza sativa Indica Group
MAICSTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQDKEFNVGFAQRVVFLEIAENIDMMNRLHPYCCYQQQEQQLGEPEDYVWEPYHHCKLPSSQQKPEGGDLEFMSKLVASIISC

SEQ ID NO: 1041 - protein, 478 aa, Parthenocissus himalayana
  misc_feature (210)..(226): Xaa can be any naturally occurring amino acid
GLSHLASETVHYNPSDLSNWLESMLSEFNPSPNCPLDNPFLPHISQSSAIPPLDYTNCSTQPKQEPSLFDSPSLDYDLKAIPGKALYSHIEQPPQQPPAPPLYQRENKRLKPTTSATTTANSVSSVTGGWGVPTESARPVVLVDSQETGIRLVHTLMACAEAVQQENLKLAEALVKQIGFLAVSQAGAMRKVATYFAEGLARRIYRLYPXXXXXXXXXXXXXXXXXETCPYLKFAHFTANQAILEAFDGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERGERHETLAQWRARLGSAGFDPVNLGSNAFKQASML

SEQ ID NO: 1042 - protein, 251 aa, Zea mays
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQPRGGAESESEPSPAPAQANRGNLPPWMLRTVK

SEQ ID NO: 1043 - protein, 383 aa, Nostoc sp. PCC 7120
MRLNLIPLFCFGLCGVMVLISPPQVNANTPLTRAEIQSIRNFVQLIQRASRNKRPAQKSDAIIPGDGLSTGRASLADLRFNDGSLARVGEQAVFQFMPRTRNFRLSNGTVLLLIPPGRGQTRIQTPSATAAIRGSALFIRYDQKTDTTIIGALTNSGIAVSNKDASQTQPLKAGQLLVLVKGKIQSLYDFDLQNFYETSDLTEGLDLTGKNSSATLDPAMIAVREEIKAALAAQSPVAGQGVMENPAFLELSTTSSEVIDEDNDEDDFITNDFPINSLVDIGEFLFQNGQQLGNDGDINDINNNINNVQPDPPPPSDPPPPPDPPPPPDPPPPDPPPPDPPPPPDPPPPPDPPPPPPPDPPPPPDPPPPDRPPPPPPEPPPPP

SEQ ID NO: 1044 - protein, 189 aa, Arabidopsis thaliana
MAKEGLALEITELRLGLPGDNYSEISVCGSSKKKKRVLSDMMTSSALDTENENSVVSSVEDESLPVVKSQAVGWPPVCSYRRKKNNEEASKAIGYVKVSMDGVPYMRKIDLGSSNSYINLVTVLENLFGCLGIGVAKEGKKCEYIIIYEDKDRDWMLVGDVPWQMFKESCKRLRIVKRSDATGFGLQQD

SEQ ID NO: 1045 - protein, 504 aa, Parthenocissus quinquefolia
  misc_feature (233)..(246): Xaa can be any naturally occurring amino acid
SDMAEVAQKLEQLEEVIVNAQEDGLSHLASETVHYNPSDLSNWLESMLSEFNPAPNCPLDNPFLPHISQSSAISPLDYTNCSTQPKQEPSLFDSPSLDYDLKAIPGKALYSHIEQPPQQPPAPPLYQRENKRLKPTTSATTTANSVSSVTGGWGVPTESARPVVLVDSQETGIRLVHTLMACAEAVQQENLKLAEALVKQIGFLAVSQAGAMRKVATYFAEGLARRIYRLYPXXXXXXXXXXXXXXHFYETCPYLKFAHFTANQAILEAFDGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLAL

SEQ ID NO: 1046 - protein, 413 aa, Vitis vinifera
MENYQGDLADIVRASGSGGARTSDEPVADWQFPSEPMIFSPVVDEPLDDFGDPFSNMRDPLLHELGIAGSGFFGSSNSSGGMFGQKILDEDMKRPCNIFSRMLQISPNARMPISPCESQIVAASPTGIKTSALAPNDMISGNSSKGCLMDSTALQISSPRNPGIKRRKSQAKKVVCIPAPAAANSRPSGEVVPSDLWAWRKYGQKPIKGSPYPRGYYRCSSSKGCSARKQVERSRTDPNMLVITYTSEHNHPWPTQRNALAGSTRSQPSKNNGASKNSGSCQSTQKATGLKEENKESYNNDDMSPIVGGSSTTGASVKEEMGNVEKQLEMDDSEFSEGFPRSYKPAMPDSNQSEDFFADLGEIEADPLNLLFAQGFSSGDHEERESKALDPFSLFDWTGNNSNTSFGEDKRGL

SEQ ID NO: 1047 - protein, 187 aa, Arabidopsis thaliana
SADMQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 1048 - protein, 642 aa, Debaryomyces hansenii CBS767
MVRMSSYDDDPIIEIFDNDNSDDIQVINRDNTQYDQNLMNSTGNTPHNYYNDIYDNSQHEHTQQNRQHQPQEQLSSLSSILQLQAETHSNQQEPSGLTPILSSNDYNQLTTVSQPKYTTSLPPLAPLSESVIPNNLNIPPTLSLPKASESQDKKTNTVTTTTKKRKEASSSKTRPAFVMKIWSMVNDPANHDYIRWNDNGKTFQVFHREEFMKLILPKYFKHNNFASFVRQLNMYGWHKVQDISNGTLNKDDKSNDEIWQFENPYFIRGREDLLDKIVRNKTISQESDHLEAGNLNFQSVLNELDQIKVNQFAIGEDLRRVRNDNKTLWQENFLTRERHQQQAQTLEKILKFLAAVYGNSAGKLLEVDNGSIGLDDFNSNNQMTTYNYQQPPQAHNQAPHQPIQVPSMTDQPSQPPSPFNRPRLMLMDQAYQKSPSNNPSPRETAQRNSNSGSIEEIIRSYENTPNDSPNSNVNKIYQQLMNNEPGVSSPRHYFPELNSQNNSYFGVPNTPGQQYIKSGTPLGSSNNTSEVMNGLEQNIFKQGQSIQQVQDWIQKLAAQQQQQQQQQQQLQNLQSLHQNHKQNSDDYEKPDIDEFDVNEFLDNSNASNSQASNSVNSDLNDASSNKRSIDEVNDGNAKRKKQ

SEQ ID NO: 1049 - protein, 497 aa, Parthenocissus quinquefolia
EVAQKLEQLEEVIVNAQEDGLSHLASETVHYNPSDLSNWLESMLSEFNPAPNCPLDNPFLPHISQSSAIAPLDYTNCSTQPKQEPSLFDSPSLDYDLKAIPGKALYSHIEQPPQQPPAPPLYQRENKRLKPTTSATTTANSVSSVTGGWGVPTESARPVVLVDSQETGIRLVHTLMACAEAVQQENLKLAEALVKQIGFLAVSQAGAMRKVATYFAEGLARRIYRLYPDKPLDSSFSDILQMHFYETCPYLKFAHFTANQAILEAFDGKKRVHVIDFSMKQGMQWPALMQALALRPGGPPSFRLTGIGPPSTDNTDHLHEVGWKLAQLAETIHVEFEYRGFVANSLADLDASMLELRDEESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASML

SEQ ID NO: 1050 - protein, 663 aa, Yarrowia lipolytica CLIB122
RRQKRVERASAAPKNHCSNTKLCERLHHHYPHLSIRQLATSPKAVVSLFATQPKSHRHKDPCSCFSSTFSKLLPTTLTNIMSNTLVKKGQGQAASNAKKIGYNKKKGGGQTKGRPAFVFKLWNMVNDPAYDEYIRWMPDGKSFQITGREQLEKIVLPRFFKHNNFSSFVRQLNMYGWHKVQDVTSGSMQSNDEVWQFKSPNFIRGREDLLDNIVRNKGTKGSDEEEEMDMTTLMDELQQIKLNQLNLTQEVNKLRTDNQLLWQENLGFKDKHKQHGETLERIMRFLASLYGNQGKVLGEAISGNRNQRLLLGNTDPAQATHMINEAAAAAAAENSGNFPFEMNDMFNNNNNNNNNSNNPNDSPSFARVQPLSSTNSPQTVTGSPREENNKTNNTNNTSNNYDKITAYDTDTGSELPDNLQDLTDLSDFTPSMLDPQTVQQSMEPPMGFGDLNKNSSLILSNNSNNSINMPQTPMRNNSTSSHSSQNMSHHNYNYQPSTPGALFPELEAFQGANDQLIRSAERPRNNLNINGNGKADDLQRQLQDHGRHIDQFTDRLKKQQGYQPQQLQHQQQPQQPQQQPTPMQAPAPTPASTISSAPTPDPTSDLFNVGDPNIVPMQDFNMDDYIDNEADMFDPEVKIEEDMPLVTELDSPAPRPKKRKAGE

SEQ ID NO: 1051 - protein, 643 aa, Catharanthus roseus
MNLGGGQLVKSMAVPSSSASWKSGGDGVSDQFPAGLRVLVVDDDPTCLRILEKMLKNCLYEVTKCNRAEIALKLLRDNRNGYDIVISDVHMPDMDGFKLLEQVGLEMDLPVIMMSADDSKNVVMKGVTHGACDYLIKPVRIEALKNIWQHVVRKGKHEWKEKDYEQSGSVEDGERQQKPNEDVDYSSSANEGNWKNSKKRKDDEEDQEEKDDSSTLKKPRVVWSVELHQQFVAAVNQLGIDKAVPKKILELMNVPGLTRENVASHLQKYRLYLRRVSGVSQHQNGLNNSFMGTPDATFGSMSSINGLDFQALAATGQIPAQSLASLQAAAIGRPTSKPTISMPVVDQRNLFSFEPHKLRFGEGQQQLNGSTKQISLLHGIPTNMEPKQLASLNQSAQTFGGINMQVSSQASQGNTLLMQMTQPMSRAPMLNENNASQISRLPSSVGQAILSNGIPSGVLGRNGIVDSVRGPVYTPVSQTSSLVDFSVSNSAELPGSTFPHASNSGISSLTPKGMMQEEVNSEGKGSRGFPSSYDIFSELQQHKTQDWGLQNVGSTFDGTQHSSIQGSLEGGRNNPPNFGQQFSSYMVDNSLRIKSERHPDANCQTNLFPQLFGQDDLMSALLKQEGIGSVESDFGFDGYALDL

SEQ ID NO: 1052 - protein, 495 aa, Physcomitrella patens subsp. patens
MTTRTACKSIVTAMAIAGQASRACDVCMNKSARWYCGADRAYLCEKCDIQVHSANALAQRHERVPLTPNAESTILARKDSPDTKNAKEILLRKPTMSKKLQAPPVNVLPSRKRFRTCRLHPFRQAKHSPGAKHAPNQLEEGDAKMKEDLLMFSETFETENFLVDVTQKVPSLIVVMQDSSPSSSELDVCSDFFQELRSDSQEVRSSPWSDSLAAFFKGKAAQEDCFPDDDTSDQFFLPDAFDDGINICCDMDGNISVAGDACFISNDIPGLSGFEDFGSREFVGDSLSFDFAFHDTLPRAFEGVGADTSEMGGISSKYNLVGAENDQFRTGPFVKFFSKIPRNEKKMHLTPENIKKEAKEILLCCREGLSEVNLGLAPTLRLNYEDVITAWSDRGEPWFYPHDCTSDATDAGLVPDMAQEGADDCQGSREASVMRFKEKRRSRLFSKRIRYEVRKLNAEKRPRMKGRFVKKNSSGFDFRLDPFLSSETHVLAHPH

SEQ ID NO: 1053 - protein, 119 aa, Kolkwitzia amabilis
TAHGPRDRRMRLSLDVARKFFGLQDILGFDKASKTVEWLLTQSNSAIKDLTRAVKGLNSNHSSSVGANSTSSTSECEVLSGTDEPRGQLAKAKGKGSGSKDKKRKATVRRVAFDSTARE

SEQ ID NO: 1054 - protein, 123 aa, Leycesteria formosa
TAHGPRDRRMRLSLDVARKFFGLQDMLGFDKASKTVEWLLTKSKSAIKDLTRGLNSNHSSSVGANSGSSTSECEVLSGTEDTRRVSNTTTTTTSTKGKGTVVGKAKKNKGVTRRIAFDANARE

SEQ ID NO: 1055 - protein, 859 aa, Arabidopsis thaliana
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTVSCRSEEEAVVGEGSDAKDAKSASNPSLSSAGNS

SEQ ID NO: 1056 - protein, 193 aa, Withania coagulans
IVFSATGKLFEFASSSMKDILGKYKLQSANLEKVYQPSLDLQLENSLNVRVCKQVADKTRELRQMKGEELEGLSLEELQQLEKRLEAGFNRVVEIKDRRIMDEIANLQREGAELMEEDKQLKHKMEMMKEGKLPLVTDMDCMVMEEGQSSESIITTNNICSSNSGPPPEDDCSNVSLKLGYNNGPAAVDDVCS

SEQ ID NO: 1057 - protein, 267 aa, Vassobia breviflora
MAREKIKIKKIDNITARQVTFSKRRRGLFKKAEELSVLCDADVALIIFSATGKLFEFASSSMKDILGKYKLQSASFEKVDQPSLDLQLENSLNVRLSKQVADKTRELKQMRGEDLEGLSLEELQQIEKRLEAGFNRVLEIKGARIMDEITNLQRKGAELMEENKQLKHKMEMMKEGKLPLVTDMDCMVVEEGQSSESIITTNNVCSSNSGPPPEDDSSNASLKLGCNSGPAVEDDCSNASLKLGCNSGPAVEDDCSITSLKLGLPFS

SEQ ID NO: 1058 - protein, 119 aa, Linnaea borealis
TAHGPRDRRMRLSLDVARKFFGLQDILGFDKASKTVEWLLTQSKSAIKDLSRAIKGLNSNHSSSVGANSTSSTSECEVLSGTDEPRGHLAKAKGKGSGSKDKKRKAIVRRVAFDSTARE

SEQ ID NO: 1059 - protein, 61 aa, Physcomitrella patens subsp. patens
HYRGVRQRPWGKFAAEIRDSSKNGARVWLGTFDSAEQAALAYDRAALNMRGSRALLNFPLK

SEQ ID NO: 1060 - protein, 140 aa, Brassica napus
SIEYDRAMDPNISYPSFYPQTFVDNQRTYPQSFVDNQSNILNPTPLSTIYPRNVNQFSFSSKQHHDQHVPHHQPVIKRRKFDEIFDGFDFEENGVYDGRTHSLPYEKYGPYTCPKCKNVFDTSQKFAAHISSVHYKNETV

SEQ ID NO: 1061 - protein, 192 aa, Atropa belladonna
IIFSATGKFFEFASSSMNDILRKYKLHSASLEKVEQPSLDLQLENSFNMRLSKEVADKTRELRQMRGEELEGLSLEELQQIEKRLEAGLNRVLEIKGTRFVDEITKLQRKGAELMEENKQLKQKMEIMNEGKLPLLTEMDCMVMEEGQSSESIITTNNVCSSNSGPSPEDDCSNASLKLGCNNGPAVEDDCS

SEQ ID NO: 1062 - protein, 192 aa, Atropa belladonna
IIFSATGKFFEFASSSMNDILRKYKLHSASLEKVEQPSLDLQLENSFNMRLSKEVADKTRELRQMRGEELEGLSLEELQQIEKRLEAGLNRVLEIKGTRFVDEITKLQRKGAELMEENKQLKQKMEIMNEGKLPLLTELDCMVMEEGQSSESIITTNNVCSSNSGPPPEDDCSNASLKLGCNSGPAVEDDCS

SEQ ID NO: 1063 - protein, 214 aa, Zea mays
MDAAAHWQQSLGLVKPLEEMLMAASAGAANPSQGSNPNPPPLAAPLTDAGSTERRARPQKEKALNCPRCNSTNTKFCYYNNYSLQQPRYFCKTCRRYWTEGGSLRSVPVGGGSRKNKRSSSSSSSSSSSAAAASASTSSSATSSSMASTPGAASKSPELAHEGAHDDLNLAFPHHGGLHAAEFAAFPSLESSNDMCDQGGGMTSNGRGGGAGPA

SEQ ID NO: 1064 - protein, 347 aa, Zea mays
MDCSNDWDLQALVRSCGGGNRSVQHSRAGADAPPREEAAMVRGGGRAAAQLELLGQPVGAVSSWRRGLDHFDDLVDRDRDPRRMPFSVSVTPSSSRETTATCGPMARAGQQLRHDDVLFSFSAAAAAGVVSRSGHQMVQPRRRQPGRKAGGRTPRPKRSKKRQVKKVVCEVPAAGGVVSTDLWAWRKYGQKPIKGSPYPRGYYKCSSLKSCTARKLVERSPAKPGVLVVTYIADHCHAVPAMLNALAGTTRNRPSSSSSASPDDGDHNQDQETSSDGAAPSADNNSKVDDDDGAAAVAVAVDENDACLLEDDGNCPFDGFFWPFDDDLDRFFDDDGGGVLGRRRLSL

SEQ ID NO: 1065 - protein, 279 aa, Oryza sativa Indica Group
MAAAIEGNLMRALGEAPSPQMQKIAPPPFHPGLPPAPANFSSAGVHGFHYMGPAQLSPAQIQRVQAQLHMQRQAQSGLGPRAQPMKPASAAAPAAAAARAQKLYRGVRQRHWGKWVAEIRLPRNRTRLWLGTFDTAEEAALTYDQAAYRLRGDAARLNFPDNAASRGPLDAAVDAKLQAICDTIAASKNASSRSRGGAGRAMPINAPLVAAASSSSGSDHSGGGDDGGSETSSSSAAASPLAMEQLDFSEVPWDEAEGFALTKYPSYEIDWDSLLNNNN

SEQ ID NO: 1066 - protein, 103 aa, Brassica napus
MDRMCGFRSAGDYSEKAELMMSSSESLMSLSDYHNLICSSAGENHVFGSNELFSAAASALSSEVSIAPPARRADQDNPSLGLIKSKIASHPLYPRLLQTYIDC

SEQ ID NO: 1067 - protein, 499 aa, Rhoicissus digitata
  misc_feature (231)..(244): Xaa can be any naturally occurring amino acid
SDMAEVAQKLEQLEEVIVNAQEDGLSHLASETVHYNPSDLSNWLESMLSEFNTTPNCPLDHPFLPPISQSPAISPLDYTNCSTQPKQEPSLFDSPSLDYDLKAIPGKALYSHIEQLPQQPPPPPLYQRENKRLKPTTSSTTNSVSSVIGGWGAPTDSARPVVLVDSQETGIRLVHTLMACAEAVQQENLKLAEALVKQIGFLAVSQAGAMRKVATYFAEGLARRIYRLYLXXXXXXXXXXXXXXHFYEACPYLKFAHFTANQAILEAFEGRKRVHVIDFSMKQGMQWPALMQALALRPGGPPSFRLTGIGPPSTDNTDHLHEVGWKLAQLAETIHVDFEYRGFVANSLADLDASMLELRDGESVAVNSVFELHSLLARPGGLERVLSAVKDMKPDIVTIVEQEANHNGPVFLDRFTESLHYYSTLFDSLEVAPVNTQDKLMSEVYLGQQIFNVVACEGPERLERHETLAQWRARLGSAGFDPVNLGSNAFKQASMLLAL

SEQ ID NO: 1068 - protein, 456 aa, Zea mays
MALKRSAAAASLGSASDASDGEAGAARNSHRRRVSPSRSRSESPRPNLGPSAAASDTNRERSPRDHLDSDADSDADAGAGAGRGARSSRLLGERSPSFHSNSDADVAGRSPSPRRNRERTLHLHSDSDSDNSTTAAAAASDDAGDASPLAIAHRASHIGTSNVKPVSTRPMDVPSRAAAGSSQRRSKRRPSPHSPEHQKRPPRVWSPEDEVTILSALIEFRAKKGRLPASIQDTSKVHSQIIHQLTANASTAQLSDKVRRLKHKYKLLLTRSKNGRDPDLPTKHDRDVYQLSKKVWGLKSLLLVRGSRVSHEDTEDAEESNEEQEIEESDEDIENEWGLRDRTGKKPRALTFENGNGNAIVTAGRACHGDGSGRDDAEKGKQMYPYLWEAVEELSKEHPSGPIFRKAFGVLEKSKAGAVEEKLRKFRMLEIRQQLRRMDLMKETVGLVLDALEGAY

SEQ ID NO: 1069 - protein, 192 aa, Nicotiana langsdorffii x Nicotiana sanderae
MDKKPCNSQDVEVRKGPWTMEEDLILINYIANHGEGVWNSLAKSAGLKRTGKSCRLRWLNYLRPDVRRGNITPEEQLLIMELHAKWGNRWSKIAKHLPGRTDNEIKNYWRTRIQKHIKQAENMNGQAANSEQNDHQEGSSSHMSSAGPTEAYSPTSYSANIDTTFQGPFLTETNDNIWSMEDIWSMQLLNGD

SEQ ID NO: 1070 - protein, 499 aa, Rhoicissus rhomboidea
  misc_feature (231)..(254): Xaa can be any naturally occurring amino acid
SDMAQVAQKLEQLEEVIVNAQEDGLSHLASETVHYNPSDLSNWLESMLSEFNPTPNCPLDHPFLPPISQSPAISSLDYTNCSTQPKQEPSLFDSPSLDYDLKAIPGKALYSHIEQSPQQPPPPPLYQRENKRLKPTTSATANSVSSVIGGWGVPTESARPVVLVDSQETGIRLVHTLMACAEAVQQENLKLAEALVKQIGFLAVSQAGAMRKVATYFAEGLARRIYRLYPXXXXXXXXXXXXXXXXXXXXXXXXFAHFTANQAILEAFEGRKRVHVIDFSMKQGMQWPALMQALALRPGGPPSFRLTGIGPPSTDNTDHLHEVGWKLAQLADTIHVDFEYRGFVANSLADLDASMLELRDEESVAVNSVFELHSLLARPGGLERVLSAVKDMKPDIVTIVEQEANHNGPVFLDRFTESLHYYSTLFDSLEVSPVNTEDKRMSEAYLGQQIFNVVACEGPERLERHETLAQWRARLGSAGFDPVNLGSNAFKQASMLLAL

SEQ ID NO: 1071 - protein, 192 aa, Nicotiana langsdorffii x Nicotiana sanderae
MDKKPCNSQDVEVRKGPWTMEEDLILINYIANHGEGVWNSLAKSAGLKRTGKSCRLRWLNYLRPDVRRGNITPEEQLLIMELHAKWGNRWSKIAKHLPGRTDNEIKNYWRTRIQKHIKQAENMNGQAANSEQNDHQEGSSSHMSSAGPTETYSPTSYSANIDTTFQGPFLTETNDNIWSMEDIWSMQLLNGD

SEQ ID NO: 1072 - protein, 761 aa, Candida albicans SC5314
MIMNMTTDYRDPLLDLFGTESNSGNETSSPSDIPVINRSGTFNQQQFSPLLTQQSLYNTPNSGSTPNIFDPNYTQMQEEQTSPSSNKLQPEDPPRKKRNTRSQTKIHQQSEGDEYNSNDYKDSIDLDKPPVVEPSPPFFVESDTTPEFVIPTPTSEQQQQQHHELIAQDYQRSNNSNQFGNLTHYEPNLPPLPPLSESILPQTNTFHPLVLPHDPRHAITAGPANNSQQQQQRQQQDSSIPSDGISSKIQQLHAPSLSNNQSASQRKKKESSGPKTRPAFVMKIWSMVNDPANHEYIRWNDDGKTFQVFHREDFMKVILPKYFKHNNFASFVRQLNMYGWHKVQDVANGTLNQNSDKNGQDEIWQFENPNFIKDREDLLDKIVRNKSSSNQDDVSGVSFNGINNSANLSLILQELETIKMNQYVISEDLRRVRQDNKMLWQENYLNRERNQVQGRTLDKILKFLSVVYGNNANKILNGHGFADFSDSNNIMTQYRPSPMGSPLLSRPQTQPPPSNSRFARDNNQTAQPTYESPLSTSDTNNNNNNSTFEYQQAVNRPRLMLTNRAHSRRPSMSRTKSTPEGSIEEIIRSYSNDKAAESNVNRMYEQLVGHQPGATTNNNNHSSSTAISAPSPRHSFLQELNLPGTPRNLDDLEKHINNEGQSIQQVQDWIDKLAQEQHEKQQQQQGNEDDDDFDVNEFLKDATTTPGSNVPNGGHYNNGNINFVDSPIAMTPGSNVSSNINDSNGNEKKSKKRSIEEVSDH

SEQ ID NO: 1073 - protein, 329 aa, Oryza sativa Japonica Group
MQEPKHTDPAAMRGAHHRRARSEVAFRLPDDLDLGGGGAGAFDEIGSEDDLFSTFMDIEKISSGPAAAGGSDRDRAAETSSPPRPKHRHSSSVDGSGFFAAARKDAAASLAEVMEAKKAMTPEQLSELAAIDPKRAKRILANRQSAARSKERKARYITELERKVQTLQTEATTLSAQLTLFQRDTTGLSAENAELKIRLQAMEQQAQLRDALNDALKQELERLKLATGEMTNSNETYSMGLQHVPYNTPFFPLAQHNAARQNGGTQLPPQFQPPRPNVPNHMLSHPNGLQDIMQQDPLGRLQGLDISKGPLVVKSESSSISASESSSTF

SEQ ID NO: 1074 - protein, 63 aa, Triticum aestivum
MSSESLGKNSKIMGGRERKEAEEDLVFRMHRLVGNRWELIAGRIPGRTAEEVEMFWAKRHQDQ

SEQ ID NO: 1075 - protein, 122 aa, Patrinia triloba
TAHGPRDRRMRLSLDVARKFFGLQDLLGFEKASKTVEWLLTQSKSAIKDLTRAINGLNSSNRSSSNLGVANSASSTSECEVLSGIDEPRVQLTKAKGKGSGSKDKKRKEIVRRAAFDSTARE

SEQ ID NO: 1076 - protein, 308 aa, Zea mays
  misc_feature (189)..(189): Xaa can be any naturally occurring amino acid
MGAEAAERDRIRGPWSPEEDEALRRLVERHGARNWTAIGRGVPGRSGKSCRLRWCNQLSPRVARRPFTADEDAAIARAHARLGNRWAAIARLLPGRTDNAVKNHWNCSLKRKLGAAAAASGSAVSADDSAAAAETEARRGKMMMMSISPPDSPSGSGSGSDRSDLSSHGAGSGSGSGSGQIYRPVAARXGGFEPADCAMSRPQEEDPLTALSLSLPGTDQRFHHHSAAADSHFQELPPSPSSPAPSAYPFSPEFAAAMQQLIRTEVQRYMASAGLRAGCGAVGATDLCMPQLVDGVMRAAAEQVGRMQ

SEQ ID NO: 1077 - protein, 120 aa, Sambucus canadensis
TAHGPRDRRMRLSLDVARKFFGLQDMLGFDKASKTVDWLMTKSKSAIKELTRGFPQMKPSCSVGANSPSSTSECEVLSGIDEPVFLTSVAVDTPIEPPSVTKEKRVRKYRKTAFIPVARE

SEQ ID NO: 1078 - protein, 686 aa, Glycine max
  misc_feature (449)..(449): Xaa can be any naturally occurring amino acid
SGRFFFFFFFFFECFVKREKMKSMENDDNADLNNQNNWLGFSLSPQMHNIGVSSHSQPSSAAEVVPTSFYHHTAPLSSYGFYYGLEAENVGLYSALPIMPLKSDGSLYGLETLSRSQAQAMATTSTPKLENFLGGEAMGTPHHYECSATETMPLSLDSVFYIQPSRRDPNNNQTYQNHVQHISTNQQQQQQELQAYYSTLRNHDMILEGSKQSQTSDNNNLHVQNMGGDDAVPVPGLKSWEVRNFQASHAHESKMIVPHVEENAGESGSIGSMAYGDLQSLSLSMSPSSQSSSVTSSHRASPAVVDSVAMDTKKRGPEKVDQKQIVHRKSIDTFGQRTSQYRGVTRHRWTGRYEAHLWDNSCKKEGQGRKGRQVYLGGYDMEEKAARAYDMAALKYWGPSSHINFPLENYQNELEEMKNMTRQEYVAHLRRKSSGFSRGASMYRGVTRXHHQHGRWQARIGRVAGNKDLYLGTFSTQEEAAEAYDIAAIKFRGANAVTNFDITRYDVEKIMASSNLLSSELARRNRETDNETQCIDQNHNKPSAYEDTQEAILMHQKSCESENDQWKMVLYQSSQQLEQNPPTIESDRTNQSFAVALDNMFHQEVEESSKARTHVSNPSSLATSLSSSREGSPDRTSLPMLSGMPSTASKLLATNPNNVNSWDPSPHLRPALTLPQMPVFAAWTDA

SEQ ID NO: 1079 - protein, 235 aa, Musa acuminata
MGRGKIEIKRIENTTNRQVTFCKRRNGLLKKAYELSVLCDAEVALIVFSSRGRLYEYANNNIKSTIERYKKACADSSSSDAIVDVNSQHYYQQESAKLRHQIQVLQNANRHLMGDALSSLNVKELKQLENRLERSITRIRSKKHELLFAEIEYMQKREVELQSDNMYPRAKIAENERVQQLSIVEAGAEYDAIPGAFDSRNYYHANILEAAAHYSHHQDQTALQLGYETKADSAA

SEQ ID NO: 1080 - protein, 300 aa, Brassica napus
  misc_feature (191)..(191): Xaa can be any naturally occurring amino acid
MGVREKDPLAQLSLPPGFRFYPTDEELLVQYLCRKVAGYHFSLQIIGDIDLYKFDPWDLPSKALFGEKEWYFFSPRDRKYPNGSRPNRVAGSGYWKATGTDKIIMSDGHRVGIKKALVFYAGKAPKGTKTNWIMHEYRLIEHSRSHGSSKLDDWVLCRIYKKTSGSQRQAVASPVQACLEDQSTNMSSSPXSSSQLDDVLDSFPEMKDRSFDLPRMNSLRTILNGNFEWASLAGLNPMPELAPMTYGLSNYGGYHAFQSAESGCRSSQVDQEQNSTELTQSLGYSSSGFGLSGQMYEFRQ

SEQ ID NO: 1081 - protein, 370 aa, Solanum tuberosum
MNSSTYTQFVASKRMGICDPIHQIGMWGDFKGSSFPDTLILEVENCLENEMPIMEKRLENEIEEPSQVTVGMSNRYEPETTKRIDKVRRRLAQNREAARKSRLRKKAYVQQLENSKLKLLQLEQELERNRQQGLYVGDGLDASQIGCSGTANSGIASFEMEYGHWVEEQDRQTDDLRNALNSQMGEIELRILVESCLNHYFDLFRLKATAANADVLYLMSGTWKTSAERFFLWIGGFRPSELLKVLTPHVEPLSDQQIQEVSNLTQSCQQAEDALSQGMVKLHQILAEAVAAGTLGEGIILPQMTATIEKLEALVRFVNQADHLRQETLLQMSCILAAHQSAQGLLALGEYFKRLRALSSLWAGRLSEPA

SEQ ID NO: 1082 - protein, 176 aa, Oryza sativa
MGFPSVCYCVILPQPLVLVLQLLDLLRHAFLLCLSALGLAAPPPPDEHPAYAPPPPPPASMAALPADLVWAFQPAPEPVAIKARLPAVRYADFVRCRRAAAAAAASCVVCLGALEARHRVRELGNCAHAFHKACIDKWVDKGQATCPLCRAALLPSADDADAAAIAATTRHHLPSF

SEQ ID NO: 1083 - protein, 192 aa, Atropa belladonna
IIFSATGKFFEFASSSMNDILRKYKLHSASLEKVEQPSLDLQLENSFNMRLSKEVADKTRELRQMRGEELEGLSLEELQQIGKRLEAGLNRVLEIKGTRFVDEIKKLQRKGAELMEENKQLKQKMEIMNEGKLPLLTELDCMVMEEGQSSESIITTNNVCSSNSGPPPEDDCSNASLKLGCNSGPAVEDDCS

SEQ ID NO: 1084 - protein, 127 aa, Scabiosa columbaria
TAHGPRDRRMRLSLDVARKFFSLQDMLGFEKASKTVDWLLDQSRSAIEDLTKLALSSNHSSSVVGAVKNLTRTTSSASECEVLSGTDYEPKPELAGKVKGKSLGAGSKDKKRKGIVTRVAFDSNARE

SEQ ID NO: 1085 - protein, 192 aa, Atropa belladonna
IIFSATGKFFEFASSSMNDILRKYKLHSASLEKVEQPSLDLQLENSFNMRLSKEVADKTRELRQMRGDELEGLSLEELQQIERRLEAGLNRVLEIKGTRFVDEITKLQRKGAELMEENKQLKQKMEIMNEGKLPLLTEMDCMVTEEGQSSESIITTNNVCSSNSGPPPEDDCSNASLKLGCNSGPAVEDDCS

SEQ ID NO: 1086 - protein, 496 aa, Ceratopteris thalictroides
  misc_feature (294)..(294): Xaa can be any naturally occurring amino acid
VYLGGFDTAHAAARAYDRAAIKFRGPEADINFNLSDYEDDMKQMASLSKDEFVHILRRQGTGFSRGSSKFRGVTLHKCGRWEARMGQFLGKKYIYLGLFNSEIEAAKAYDRAAIRCNGREAVTNFDPNSYEEDLFAEASNGLDQTLELSLRTTLQPEEVSSRFDFPPYYGITGFHDHVPRREGFHGMSVGNSGYLPTSLSAAARDNWRMAGLSGHIVHDQLDGLLSRPLAPAPFLSTKVPMLGDRDGNGSYLGFARDPSTVLHGLPQMDDPCHQRHAALLKHMSSPFLHTTKLXPIVDDGGPRLPLPSPHEHAVPGLVPGSSVEGATTTNYGWPWQANHNLVPKGAAAATAAMKLPTAASSGFSHISKEPPLSEPALAPHLPCPSLSVKVSASTGMQVPLANPPSSTKSSSPQLAGAASAFCGWLTGNSSSVPSLVNSNVVSNMAASSSSGSKSTMSTAMMIGNVVVTEDKNASHALSPIPKEHNFLGLSLGLERS

SEQ ID NO: 1087 - protein, 203 aa, Capsicum baccatum
IIFSSTGKLFEFASSSMNDILGKYKLQTSSHEKVDQPSLDLQLENSLNMRLSKQVADKTRELRQLRGEELEGLSLEELQQIEKKLEAGFSRVLEIKGTRIMDEISNLQRKGAELMEENKQLKQKMEMMREGKLPLLTDMDCMVMEEGQSSDSIITTNNVCSSNSGPPPEDDSSNASLKLGCNNGPAVEDDCSITSLKLGLPFS

SEQ ID NO: 1088 - protein, 124 aa, Symphoricarpos orbiculatus
  misc_feature (38)..(38): Xaa can be any naturally occurring amino acid
TAHGPRDRRMRLSLDVARKFFGLQDMLGFDKASKTVEXLLTKSKSAIKDLTRALNSNHSSSVGANSASSTSECEVLSGTEDARVLNEEHTRVFNTSTKGKSTVGKAKKSKAVTRRIAFDANARE

SEQ ID NO: 1089 - protein, 193 aa, Datura inoxia
IIFSATGKLFEFASSSMKDILGKYKLQSANLEKVDQPSLDLQLENSLNMRLSKEVADKTRELRQMRGEELEGLSLEELQQIEKRLEAGFNRVLEIKGKRIMEEITNLQRKGAELMEENKQLKHKMKMMKEGKLGPVTDTECMVMEEGQSSESIITTNNVCSSNSGPPLDQDDSSNASLKLGCNNGPAVEDECS

SEQ ID NO: 1090 - protein, 364 aa, Oryza sativa
  misc_feature (52)..(52): Xaa can be any naturally occurring amino acid
  misc_feature (61)..(61): Xaa can be any naturally occurring amino acid
MWEGGSHDAAAQLLPWFVGEPAAAAVGGYGGCVDVVGQGGVFGFGFEAAAAXPVVTRQQRXGAAAAEGSSRGGGGKPAVVSGLLGSLQAELGRVTAREIMDAKALAASRSHSEAERRRRQRINGHLARLRSLLPNTTKTDKASLLAEVIEHVKELKRQTTAIAAAAAAGDYHGNDEDDDDAVVGRRSAAAQQLLPTEADELAVDAAVDAEGKLVVRASLCCEDRPDLIPDIARALAALRLRARRAEITTLGGRVRSVLLITADEQQQQHCDDVDDDEDGHRLLLRHGIDGAGAAADDDDECAASHRRHECIATVQEALRGVMDRRAAASSGDTSSSGGAVVAGGGGGSIKRQRMNYGVHEQCSV

SEQ ID NO: 1091 - protein, 1065 aa, Cryptococcus neoformans var. neoformans B-3501A
MSRVPSGSQQPQYTQQPLYHPSSVHSQSTPIQQTHQQYHPHTGQPMTFQGDAHAYSYDRQSQINTWQANPGAAGSMEYHSAVAGSSRGADPYQPYSQSHRSSPSQSVTASRTQPASAQQYTPWAPVQTSATTPSSRGGGVKLEDLMSSDSRAGGKNQPLSGIPLSVSASFDTRSQFSAGPQGASAEKEKDKERDKATQQQGPSEFIKKLYKMLEEEQAQYGNSRTKKGEKGKRGSVGWGANGTSFVVWDMNDFTTKILPQTFRHSNFSSFVRQLNKYGFSKIKHVDAGTGSIKENIWEFQHPNFQAGGKSDLESIKRKPVAPKKANNQEGDENSPRHIGLSNEDQTRMHLMEDRINMLEDALAKSRSEADEARMREMAMMGLVRDMIGHIAASESEAIGSPAATTGHSPRVLHLLKSLDNLARAYPPEMYHSNIARQPTTMPYTPAQPQSHQSFLNAAYNPAFSGNSVGGAAQAQASPHTDGTGSRGSFSGPSTGEIKPPASSSRLRAASNAGAAPSGSVNASVPLASQPTGNPPAGPVARAEDPAEDVIEIPNQMQDMYGGESVGIAPLFVETPAWLTEGTTVPLTMYRKQSDGQVLKAVYQAFAAGGKLPAGEGQDEDGNAIASGSSTSAAEIMAGSSQMGLQQSYGAGSSTSTGIPLPMEGSPSSESSSRKGKGKKSRGTSLKEQRESKLKPHWAQTPRILVVEDDIVYRTLSKKFLQKFGCETETVENAQGAVDKMNGTKYDLVLMDIFFGPNMDGRKATSLIRQFNNYTPIISMTSNAQPQDVDSYYQSGMNDILAKPFTKNHLFTILDKHLVHLRHAQLYERLIPLGVGVPPLSDQHVQEALAVSAANLQNTNGQLQLENGPTAETQNEQQDSNGELELGIRNPLAGSGWSDEAYQLVLAQFLQTGVMPDITTISAVSSSPNPNGIDGTIGTSIVFGESSGFSRKRSIEAISDDNWDGQAQTSASVQAQAQAQAQAQAQAQAQAQAQAQAQAQAQTQAQVQNTIMQGDQQQGMSLQMPMNVGMGMEVNMGNMPESGMMNQDISNGSDGREAKRARGMAG

SEQ ID NO: 1092 - protein, 299 aa, Zea mays
  misc_feature (42)..(42): Xaa can be any naturally occurring amino acid
MGVPKQRWTPEEEAALKAGVAKHGPGKWRTILRDSDFSALLXRLRSNVDLKDKWRNLSVTAGGYGSREKARMALKKGRRVVPKLTAEPMDVDEKDMDNAHDTVIDVEPLAMAFEPLPFLESPDKSVARLDDLIVEAIRKLNEPSGSNKAVISGYIEDQYWPPADFQYLLSTKLKSLVNSGKLIKVNQKYRIAPSSSLGGISTKVSSSEGMNTENNNVKRLTKPQVVAELEKMKGMTREEAAAFAAKAVAEAEVAMAEAEEAARVAEAAENDAEAAKAFLDAVILSMRNRNAASMILRAC

SEQ ID NO: 1093 - protein, 165 aa, Brassica napus
MQPETSDQMLYSFLTGNEISGGGFSVSGDYMSTMQSLCGSSSSTSSYYPLAISGIGETVAQDRALAALRNHKEAERRRRERINSHLNKLRNVLSCNSKTDKATLLAKVVQRVKELKQQTLEITDSDQTLLPSETDEISVLHYGDYSNDGHLIFKASLCCDDRSHL

SEQ ID NO: 1094 - protein, 350 aa, Triticum aestivum
MAPLSEHHMRITRALAKRPKTKMLTGFGVKPTAAFSKPAQLQAQALLPGAQPPRRRVRVLYEDPDATDSDTDDEEAVAAPASSKRCFELFLGKAPPAKLFAKPVTPTAAASAVAACTTSSAEGHRGVRLRKWGKWAAEIRNPFSGKREWLGTFDTADLASAAYQAASRSFIEEKRRRRGQSVAAASPAQSAASTTPTSSSTPTASSSSSTSAAPFAHPSPSSVLEATKPAAESLSPEPTPVPVMVSTPVVSTTAETAQLPDDPEFYQDLLRGLQLPDIDPMDFRAGLDALDVSEASAYLDGEQDLLLGDLADEDLELDMDLDIGDDFLDMPGCDFGRGMDDFLQTVDFCV

SEQ ID NO: 1095 - protein, 261 aa, Arabidopsis thaliana
MTTSMDFYSNKTFQQSDPFGGELMEALLPFIKSPSNDSSAFAFSLPAPISYGSDLHSFSHHLSPKPVSMKQTGTSAAKPTKLYRGVRQRHWGKWVAEIRLPRNRTRLWLGTFDTAEEAALAYDKAAYKLRGDFARLNFPDLRHNDEYQPLQSSVDAKLEAICQNLAETTQKQVRSTKKSSSRKRSSTVAVKLPEEDYSSAGSSPLLTESYGSGGSSSPLSELTFGDTEEEIQPPWNENALEKYPSYEIDWDSILQCSSLVN

SEQ ID NO: 1096 - protein, 242 aa, Picea sitchensis
MGRGPCCANGDRNKGAWTREEDDRLIQYIQAHGEGCWRSLPNASGLLRCGKSCRLRWINYLRPNLKRGNFSEDEDDLILKLHALLGNRWSLIAGRLPGRTDNEIKNYWNSYLKRKLISMGVDPLNHRPFQKNSRHRPSASGNVGEPGTAQSREIVPDFFHCPPELSTKSEQVSDAASGLARKELPRFNLNLNLELSITRPSIHAAGKEAVVNSEQGESSLSEGKGYLCRHGECPPPLSPTDG

SEQ ID NO: 1097 - protein, 174 aa, Arabidopsis thaliana
MANESNNLGLEITELRLGLPGDIVVSGESISGKKRASPEVEIDLKCEPAKKSQVVGWPPVCSYRRKNSLERTKSSYVKVSVDGAAFLRKIDLEMYKCYQDLASALQILFGCYINFDDTLKESECVPIYEDKDGDWMLAGDVPWEMFLGSCKRLRIMKRSYVPGFGRTKPRIKLG

SEQ ID NO: 1098 - protein, 299 aa, Vitis vinifera
  misc_feature (123)..(123): Xaa can be any naturally occurring amino acid
  misc_feature (135)..(135): Xaa can be any naturally occurring amino acid
  misc_feature (226)..(226): Xaa can be any naturally occurring amino acid
  misc_feature (229)..(229): Xaa can be any naturally occurring amino acid
  misc_feature (234)..(234): Xaa can be any naturally occurring amino acid
MDFSMLSSDHFGFVCDQYENPSSDFLPLSSSTFDLHHLHESVLVSPHLTNPPFQWYENNSFRSSFNGLNHVDSTLVSHQLIVADHNHNELQWQQNLHHFSTALQRPPATLPQGQFGASFGSQXGVIVRRSVVEMXTYQQIQSLPHVTAPSPYYQAQSPTPPKNYMLMEVEDDDDYDIKPNLLHFPALPQNNSVCLPQVLQIEGQNQMPEDDDPNDNBGHKNQTDKXGTXSLKHXKYGPYTCPRCKMEIETSQSFASHMKSHYSSETEDERKKRIEAKYKKKNLRVAYSYDGQLTLVPEE

SEQ ID NO: 1099 - protein, 334 aa, Oryza sativa Indica Group
MALEAVVFPQEHLSCAAAMYEAPPSSLGCGVDMDEFEENGGVVLQEEAGVAVHGGGGGGAGGMMSVWVNAATCARSIAASGAVEEFWDERQYPVSSPPAAPTPAASGGGGGHAKAAARRRRRRPKVVKNKEEAESQRRNHIAVERNRRRQMNEYLAVLRSLMPPSYAQRGDQASIVAGAINFVKELEQLLQSLEAQKRRAEHAPPAPPFAGFFTFPQYSTTVGDNNAAGSGAGDGEGGCGARPGAADIEVAMAESHANVRVLAPRRPRQLLRMVVALQCLGLTVLHLNVTTTADHLALYSFSLKMEDECRLSSVDEIAGAVNQMVTKIAGECIS

SEQ ID NO: 1100 - protein, 307 aa, Gentiana triflora
MNSGLKRGPWTQEEDRLLRNYINKEGEGRWRTLPKKAGLRRCGKSCRLRWMNYLRPSVKRGQIAPDEEDLILRLHRLLGNRWSLIAGRIPGRTDNEIKNYWNTHLSKKLISQGIDPRTHKPLNSNQSFNSTSTNKNSSSQQAPQLSANYIDQPINNHHAQNDDNTLINAATFTLPVPPDYHHFQSSGGPGGGYSYGDMGSTSLRFRDTGGCPRSTTDQYMHDDDDDMMMNDDDGFSSFLESLINEDDALISQSNKNLVQQSYNHHLNMDTEADFMLNIPPAEQWDGTAIFMEESSSATFHQPNRWSP

SEQ ID NO: 1101 - protein, 122 aa, Gossypium herbaceum
RNPELCLLSSSQLDEKPLFPLHPSSDGHCFASQKNVVSGNKRGFSDAMDGFSEGKFLADSKVDVMLSPRPSSNFGAQSMKAKEITSQNVVHDRPHAADKIRPNPNASANNNSGAPANKAQVV

SEQ ID NO: 1102 - protein, 383 aa, Saccharum arundinaceum
MCGGAILSGFIPPSGVAAAAAAKKKQQQQRRVTADLLWPGPGKKGAPQEEDFEADFREFERGLSEGGDDEVQELPAPQPARFAFAAAPKAPRPEVDGVMTPKDAYGDRPTANSIKRNRKNQYRGIRQRPWGKWAAEIRDPSKGVRVWLGTYNTAEEAARAYDAEARKIRGKKAKVNFPDEVSGAQKSTAKPTAANATKLAQPPKACADEVFNNLNNDNNDLFAMFAFNDNKVPVKPAEGARFLPAVKPLVPSKRSATYMLSDQSSNSYGSSDFGWDDDTMTSDYTSVFAPNNVIPAPYMQGGVSKRMRNNYGVAMLQGNGVPSLTQVMPCFDPEMNYQPLPYVESSSSDASMDSLLQTDIPQDVASNGDIWSLDELLMAAGAY

SEQ ID NO: 1103 - protein, 122 aa, Gossypium raimondii
RNPELCLLSSSQLDEKPFFPLHPSSDGHCFASQKNVVSGNKRGFSDAMDGFSEGKFLSDSKVDVMLSPRPSSNFGAQPMKAKEITSQNVVHDRPHAADKTTPNSNASANNNSGAPANKAQVV

SEQ ID NO: 1104 - protein, 123 aa, Triosteum himalayanum
TAHGPRDRRMRLSLDVARKFFGLQDMLGFDKASKTVEWLLTKSKSAIKDLTRGLNSNHSSSVGANSASSTSECEVLSGIEDTRVLNEDTLVSNTSTKGKGTVGKAKKGKGVTRRIAFDANARE

SEQ ID NO: 1105 - protein, 240 aa, Oryza sativa Japonica Group
MKSSSQEAGEEVSEISSQAASNNNETCNSSSGKVSLDLSLTVAAAAAAAASATESSTTDSGGTRPAATATATAREPARVFTCNYCQRKFFSSQALGGHQNAHRRERTLARRAVRLDAFPYGYADVASLPLYGAGLYPIGIQAHASVHHHHPGVAAPAGRAELRSARALLGPMPFFVQAAGDEDASFGWPGSFRPPPTAATTIPAAAAAPVAVNSGSSNSNHGGSVVVQAAADEPDLTLRL

SEQ ID NO: 1106 - protein, 122 aa, Triplostegia glandulifera
TAQGPRDRRMRLSLDVARKFFNLQDILGFEKASKTVEWLLTQSKSTIEDLTRAIRGLNSNHSSSVGAANSVSSTTSECEVLSGTDEPRFQLAKPKGKGSSGAKGKKRKGIVRRVAFDSTAKE

SEQ ID NO: 1107 - protein, 334 aa, Arabidopsis thaliana
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGSHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 1108 - protein, 233 aa, Zea mays
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSK

SEQ ID NO: 1109 - protein, 589 aa, Physcomitrella patens subsp. patens
MEGIGNLVRQGSMSRLRGSQWTSEHCVLKVEEMLSKAIVHQEDLLRMLTSNLPDCLAGSQDGSPHMAPVAITDVIYPSVLVSLKSKVENSMDWCQLALCRLREIVLHTSSLARSPTAQHSTGSSVGSGHLPLFPKGSDAESAAVQLRGNHAHSLSRLCVPTPLSPLKALRKEPLVPHSFAVQDRNCSAWKAGNRLSHDYFAPQLNKPPSVPPGEDSSSPKGQHQQRRNSARLPASMHMAVSDWPTTLSDTGSPIHSASVPRSLPSNPQQCSPSYHMSNVALEPSLDGAEVMDYKNQSIAEDQSYFNKLPRENRTRNSFRKSEVRKFSGNEAKVEVVLQRLNGNKKGIPDDGHRGWKKYGNKSIQNSNHCRGYYKCSVKECRAKKMVQPTDKDPMVFEITYVGKHTCSSTGYKRNRSTRGSAGSPAQLESIQDHLQGHDKPGVTMDDKLTTFQDSHISSTDCKKRSNVEMDQVENSRIWTGSNSVDGGLTEPLHGSPSGKRVRRSKDDKDCPDNYSYMNNMAISTITTASEDREQAVEDEDGSLDTYLHQSSRHHQAVYWFQESLSWADFDIEGNLSTGQKSVNIDNHSS

SEQ ID NO: 1110 - protein, 222 aa, Lycianthes biflora
IIFSSTGKLFEFASSSMKDILGKYKLQSTSLEKVDQPSLDLQLENSLNMRLSKQIADKTRGLRQMRGEELEGLSLEELQQIEKRLEAGFNRVLEIKGTRIMDEITYLQRKGAELMEENKQLKHRMEMMKEGKLPLLTDMDCMVMEEGQSSESIITTNNVCSSNSGPPPEDDCSNASLKLGCNNGLAVEDDCSNASLKLGCNNGLAVEDDCSITSLKLGLPFC

SEQ ID NO: 1111 - protein, 127 aa, Weigela hortensis
  misc_feature (47)..(47): Xaa can be any naturally occurring amino acid
  misc_feature (75)..(75): Xaa can be any naturally occurring amino acid
TAHGPRDRRMRLSLDVARKFFGLQDMLCFDKASKTVEWLLTKSKSAXKDLTRGGGLNSNHSSSMGGANSASSTCXCEVEVLSGIEEPGGTVDENDHTRTKGKGSGAKDKEKKSKGARRIAFDPITRE

SEQ ID NO: 1112 - protein, 281 aa, Glycine max
MMNNPALLSRLFPGINREREMSAMVSALTHVVSGEVPTGDSSSVLHHQPHDDDAVTVKPNMPSTTPFSSTYVVATSSLKRSRQHDTYTPSFSHPPSSFPAMPTSAECSKSGMGNAVYEYRTRGTENVKKEEGRRKYRGVRQRPWGKWAAEIRDPFKAARVWLGTFETVEAAARAYDEAALRFRGSKAKLNFPENVTLRQPQFTVSTSTDPFQLSGTNLYDHRMFLTSNTMASHHLQSSLPLPPATSSSLTSPPQNITSLSSLYSAQLPPWSASGHSSSSSP

SEQ ID NO: 1113 - protein, 192 aa, Lycium barbarum
IIFSATGKLFEFASSSMNDILGKYKLHSAGLEKVEQPSLDLQLENSFNTRLSKEVADKTREMRQIRGEELEGLSFEELQQIEKRLESGLNRVLEIKGTRIMDEISNLQRKGAELMEENKQLKEKMAIMNEGKLPLLTEMDCLVMEEGQSSESIITTNNVCSSNSGPPPEDDCSNASLKLGCNNGPAVEDDCS

SEQ ID NO: 1114 - protein, 239 aa, Pyrus pyrifolia
MGGGRVQLKRIENKINRQVTFSKRRTGLLKKAHEISVLCDAQVALIVFSNKGKLFEYATDSCMEQILERYERYSYAERQLVEPDFESQGNWTFEYSGLKAKVEVLQRNHRHYLGEDLDSLNLKEIQNLEQQLDTALKQIRLRKNQLMHESISELQRKRKAIQEENNLLAKKIKEKEKAAAQPQVQNWEQQNHGLDLLPQPLPCLNNGGTQQDEFLQVRRNQLDQTLEPLYECHLGCFAA

SEQ ID NO: 1115 - protein, 187 aa, Anisodus luridus
IIFSATGKLFEFASSSMNNILGKYMLHSASLEKVEPPSLDLQLENSFNMRLSKEVADKTRELRQMRGEELEGLSLEELQQIEKRLEAGLNRVLEIKGTRFVDEITKLQRKGAELMEENKQLKHKMEIMNEGKLPLLTELDYVVMEEGQSSESIITTNNSGPAPEDESSNASLKLGCNNGPAVEDESS

SEQ ID NO: 1116 - protein, 239 aa, Pyrus pyrifolia
MGGGRVQLKRIENKINRQVTFSKRSTGLLKKAHEISVLCDAQVALIVFSNKGKLFEYATDSCMEQILERYERYSYAERQLVEPDFESQGNWTFEYSRLKAKVEVLQRNHRHYLGEDLDSLTLKEIQSLEQQLDTAHKQIRLRKNQLMHESITELQRKEKAIREQNNLLAKKIKEKEKAAAQPQVQNWEQQNHGLDLLPQLLPCLSTGGTQQDEFLQVRRNQLDLTLEPFYSCHLGCFAA

SEQ ID NO: 1117 - protein, 701 aa, Zea mays
MGCSNSKVDNEEPVRRSKDRRQLMKQLVRRRPELAAVHIAYLHALRNTGATLRQFVELESALSQQPPVDLVVPPSPTPQPPPPPPPELSVTSSLPPSPCPPPPVPFSPVTTIRKMEKRDGELPPPPPPLVLSPIRLRKMEDEFHGGDFTDDDDTDSCSTPLPPPLPPGIDWEDLDPYNVCPLSFPSPFADRNDKEVASHVTMDNDPEVDTEFYGEEDESMLGNNDVIVDRVHVNPAKGRALGDGNSSTVSWVTKDSDSMAVPWRSKKSLVEIVKEIDEYFLKAAASGNDVVIFLDSAGGRPDALEVEAKKGAGKNSKPAKVFSTLSWSWSFKSQQASREASVLNSSASGYGYHGKTLEKLYDEEQKLYKLIKDEEFARLQYKKHVSVLQKLESGGHDRLHAERLRDSIEELQTRIISLEEAVSLACFSISNLRDEELYPQIIELSAGLVHMWKNMHECHQVQNHIAQQVSLLGNRPGSEPTSDTHRQATSQLEIEVSGWHTAFCNLITSQREYVSILSQWIGLTDCLPDDGGLMRSSSGILSLSEELQRALDRLPEKVAAEAIKTFMSVIHSIVVQQSEERQLKKKSDNMDSKFQTQLEKHGENTMQNSAQPPNKNNYSASKNGTKLDAFRKQVEEEKARYLTSVRVSRAMTLNSLQTSLRNVFHALEGFSGVCVQAFEGISRCSEVAVIHSGAASPAISS

SEQ ID NO: 1118 - protein, 288 aa, Hordeum vulgare subsp. vulgare
EEGSTGTASLAGVPVDAAECKILVAHIHSHGHGNWRALPKQAGLLRCGKSCRLRWINYLRPDIKRGNFSDEEEQSIIQLHQLLGNRWSAIAARLPGRTDNEIKNVWHTHLKKRLDPSAQEQQEEAGAAKKRKKPAAAAAAPRKRDGKVKMRNLNALTARAAAAAPVSSPERSVSSTVTESTSTASAAAEQHGNSGSSSASASASVKEECFTSSEESEEFQIDESFWSETLSMPLDDLNDVCMEPHDAFGKPDGDMDYWLRLFMEGGGGSGSGSDDNNNHDGALDLPQI

SEQ ID NO: 1119 - protein, 343 aa, Brassica napus
  misc_feature (210)..(210): Xaa can be any naturally occurring amino acid
STHASAEFSSHFFSSVDHLDGPNHPKKPLTIKEAAKPEAKAMAPPKFRPPVVSVGPSHCGSNQSTNDHQVTHPPVSMSDRSKNVEERLDTSSGGSSGCSKETESGRSVSISRKRKHAMDTDQESMSQSDVRLMPTDDQTMGNKSSQRSGSTRRSRAAEVHNLSERRRRDRINERMKALQELIPHCSKTDKASILDEAIDYLKTLQMQLQXVMWMGSGMAAAAAAAATPMMFPGVQSSQYINQMAMQSQMQMPQFPVMNRPAAQNHPGLVCQNPAVQFQMQAQNQMLSEQLARYMGGFPPMPATTQTQTVQQPMDMMRFGSQVGQQSQLSTPVTTDSLRMGKTG

SEQ ID NO: 1120 - protein, 428 aa, Oryza sativa
ILKQFSAKQNGHQELHLVDHPFNNVTDGHEYYSPSAGGSFLPFATYYDLGHEYYPQGGEKDAVVVDRASPTIRKASPHLPLFTPKSEVSHLIGGGVVGSYKAFEMNSRLIRRKRASGKSLKKANVVKGQWTLEEDRKLVKLVEQFGLRKWSHIAQILPGRVGKQCRERWHNHLRPNIKKDTWSEEEDIVLIQTHKEVGNKWAEIAKHLPGRTENSIKNHWNATKRRQFARRRSRASSKNPKSGTLLQNYIKSLGIGPIKSSVRQAPPESTAVSSSSPASTQKLAEVNGKIRPDSNPSNQMVTQGILTMDENSYIQTNSCEELLVSTYDDLCLDMCDHLFETKDEMPYQVYNIDDDVDMNYIFNHIDYANKIGHEIDMEMAWDDDVLQDDESAGSSPLETPAGLAQINTVHVKEEMDLIEMVTRTQSCG

SEQ ID NO: 1121 - protein, 345 aa, Vitis vinifera
MNTFAHVPPGFRFHPTDEELVDYYLRKKVTSRRIDLDVIKDVDLYKIEPWDLQELCRIGTDEQNEWYFFSHKDKKYPTGTRTNRATAAGFWKATGRDKAIYSKHDLIGMRKTLVFYKGRAPNGQKSDWIMHEYRLETDENGTPQAKGWVVCRVFKKRIATVRKMSEHESPCWYDDQVSFMPELESPKQNSHSNMAYHLPYSCKKEIDLQYQIPHEQFLQLPLLESPKLLQTAATTVSCNSMSPSLTQDEHIRQQAHEQNLHPIYVYNNNELAVDQVTDWRVLHKFVASQLSHEDVSKENNYSSNAATLFHAAEHPNLLVQHLNKEEAVPENASTSTSSCQIELWK

SEQ ID NO: 1122 - protein, 333 aa, Oryza sativa
  misc_feature (243)..(243): Xaa can be any naturally occurring amino acid
MDGRFPLPPASGGGRGHHRRAHSETFLRLPDADLLLDPEGDFSFSDLDFPSLSDDSPAISDPTPPPPPPMAATPAPAPRPPGGAHMRSLSLDTAFFEGFSLQGGGGGGGGGGGGGSGGSGGHKRSGSMDGVNSPFEGESALSGGLPDYAKKAMPAERIAELALIDPKRAKRILANRQSAARSKERKIKYTSELERKVQTLQTEATTLSAQLTLLQRDTSGLTAENRELKLRLAVHGKSKLNYXDALNEALREEVQRLKIAAGQAPNMNGNPFNGGLQQQIPPYYTQQQQQQQQQMPYLGGHHAQQRHPSHQQSSSNGGQSLSGQSLNDSMDFM

SEQ ID NO: 1123 - protein, 189 aa, Brassica napus
  misc_feature (93)..(93): Xaa can be any naturally occurring amino acid
DDDDAVDPHLERIRNQAADESDEEDEDFVGAEDDDGGSPTDDSGEDDDSDASDADGGEKEKSVKKEPKKEASSSKGLPLKKKALATEEGSSKXKTQKKKKDPNAPKKAMSGFMYFSQMERDNIKKSNPGIGFGDIGKVLGDKWRQMSAEEKEPYEAKAQVDKKRYKDEISDYKNPQPMLVDSGNDSDSN

SEQ ID NO: 1124 - protein, 262 aa, Zea mays
SRPAGRQLRQSGVLFSVLAFFFLLLFLLPNRLDFIKIILKLEPTSRQRKKSKKTGSQPIQGLNRTGKSCRLRWVNYLHPGLKRGRMSPHEERLILELHARWGNRWSRIARRLPGRTDNEIKNYWRTHMRKKAQERKRNMSPSSSSSSLTCQSGYPDTPSTIGVEGQELHGGSGCITSILKGTPPDMDGYPMDQIWMEIEAPQMPSEESFVGGNHNVCSSLATPLPPPTVWEYYPDACWKVDDEIKMATQYQFGYSEGVGPCF

SEQ ID NO: 1125 - protein, 589 aa, Chlamydomonas reinhardtii
MDTSIPFPRPINARGPAPGQTPSQLSSLPPSLQARLGLGATHDSPVLLPLLQQVEASPTTGIHQLCPPLFQPAQPARVPLPIPARTEAASAAPEPTRAIKREYEPRAGNGKQSVANSDGWQWRKYGEKLVKGSPNPRSYYKCSHPGCLAKKIVERSDSDGTVLSTEYKGDHCHPAPSAMLPIPEALKSDFPVPHAAGAAAAHEDDTDTSEPEPAAALKAAPQDTRAAQAAATAIRKVRDSAESPSKRLDMLAAYAEEAERQLKSSSNSPEQGPSAKRQRTEAGAMRTRANPDDDDDGSGAPSTSGMQRVVDITNMDDGYRWRKYGQKQVKGSPFPRAYYKCTHMGCSVRKHVERSAEDETRFVVTYEGTHSHRLPTGSRRRSARDMAEDDEDYEGEDAEEDSSQPTSPQYGNVNGSGGPGQHAASKAAAQGAQLVHPSGAQPASADFGQQLQQLSTSLLASTVLQQAALSGVLPLLQYNSLSSEALASLGVNSEALQGVEQLNLASVGNLADLTNLLRQHAQMDLALAAQAQAIDAANANWDPLACLITPRPNVSPAGQGHAMGQAPSAGTGRQTKAAVFQKQVATTEA

SEQ ID NO: 1126 - protein, 122 aa, Gossypioides kirkii
RNPELCLLSSSQLDEKPLFPLHPSSDVHCFASQKNVVSGNKRGFSDAMDGFSEGKFLSDSKVDVMLSPRPSSNFGAQPMKAKEITSQNVVNDRPHAADKTRPNPNASANNNSGAPASKAQVV

SEQ ID NO: 1127 - protein, 253 aa, Triticum aestivum
  misc_feature (141)..(141): Xaa can be any naturally occurring amino acid
MVRAPCCEKTGLKRGPWTVEEDMTLVAHIEQHGHSNWGALPKQAGLLRCAKSCRLRWINYLCPDIKRGNFTSEEEDAIIQLHAMLGNRWSTIAARLPGRTDNEIKNVWHTHLKKRLDSSSSKPSGQAAPKRKAKKPAVVCXALEGPTSKPASSPGQSLSMSPEQSLSTSSATDYSMASSLENTGSSSSWEEFQIDDSFWSETLGMSVDSSSSGMETSDTFSVDSASPSSSNDEMDFWVTLFMQAGDMQSLSQI

SEQ ID NO: 1128 - protein, 380 aa, Oryza sativa Indica Group
MSSGGGGGGGGGDRHGPYHQHGHLVRGEGADYVYSSSDMESFFFSQPGGVGIVGVVGGVVGAGGADEIMPYSSITDYLQGLLDPSGLARHLDVACPSSQDTAVKQELSVDVTSHDSQGTGGVAGEGVAQATPNSSASFSSSDGEAEGGKSSRRCKKGQAKAEEEDDKDEEDGENSKKPNKPKKKAEKRQRQPRVAFLTKSEVDHLEDGYRWRKYGQKAVKNSPYPRSYYRCTTPKCGVKKRVERSYQDPSTVITTYEGQHTHHSPASLRGGGGGVGIVGGHHHHHLFMPGVHGLPPSHLMPAGFHPELMGLMHHHPAMAAAAANPSMYFPGVAASAPPPPAVAGGGAMPPNDHPPLQQHHFTDYALLQDLFPSTMPSSNP

SEQ ID NO: 1129 - protein, 229 aa, Oryza sativa Indica Group
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEEGQSSESVMTALHSGSSQSQDNDDGSDVSLKLGLPCGAWK

SEQ ID NO: 1130 - protein, 351 aa, Arabidopsis thaliana
MEDNDAAYDQVKSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAKHFYTTSESLLRHELLPSYGYLSNTQEEDEFYLKTIMTSEGNDWPSYVTNNVYCLHPLELVDLQDVMFQSYGTCIFANGTCGESDKCDGGYWKILHGDKLIKSNFGMVTGFKKEETERLGHQRCQGLLLPHRRGHVQTKSCGVVTVKEKRSLVEQPEEIVAAPETPRQGKSEHNDPLKRKKAIGCVGEKAEM

SEQ ID NO: 1131 - protein, 217 aa, Pisum sativum
MDKKPCNSSQDPEVRKGPWTMEEDLILINYIANHGEGVWNSLAKAAGLKRTGKSCRLRWLNYLRPDVRRGNITPEEQLLIMELHSKWGNRWSKIAKHLPGRTDNEIKNFWRTRIQKHIKQVDNPNQQNFQQKMSLEINDHHHHHPHQPSSSQVSNLVEPMETYSPTSYQGTLEPFPTQFPTINNDHHQNSNCCANDNNNNNYWSMEDIWSMQLLNGD

SEQ ID NO: 1132 - protein, 179 aa, Brassica napus
HPPIMSAERNPYREDYFKESEVAGGSSQKPGQFQDQELGPGMGRETPTASVVPQPMWAVAPGSTNGGSAFWMLPMSGSGGREQMQQQQPGHQMWAFNPGSYPVGTGRVVTAAPMGSMMLGGQQLGLGVAEGNMAAALRGGRGGDGLGMTLEQHQHQHHQQHQEPNNQGEASENGGDDKK

SEQ ID NO: 1133 - protein, 394 aa, Zea mays
MDSASSLVDDTSSGGGGGASTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASASAATASSLANNPPSYASLSPATATAAAAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVAAASTAGPSPPAPVAKAVRLFGVDLLTAPVTAAAPAEAVAVAGCKRARDLGSPPQAAFKKQLVELALV

SEQ ID NO: 1134 - protein, 445 aa, Zea mays
MPFPPVAVKEMSREARKTKSRSSPSPSSWLDRSMKFYYPSSTSRKSRAQAAPAAATEGKSTDGGDKPSNGSSGKKKKKKKRSISIGRSMACGSSICSTSTKESSVMSRDSSSGASSRSLRSPNVDAVYASAAAAISATSSFSSVTTTAATTVTSSTSSSSPLSSALSSPLSSIGRSFRGVQIRRLSGCYECRHSVFDPSGFAASFPCADCDEVFSKPESLELHRATRHAVSELAPEDTSRNVVEIIFQSSWLRKQTPPVCRIERVLKVQSSDRTVKRFEQYRESVRERARSDDQGQGKKNPRCVADGNELLRFHCATFTCSLGLAGSTALCRAPSAQCMLCSIIKEGFRVDGDGKIATMATSGRAHDTAQLVLPDGSDKRAMLLCRVVAGRVKKASGEKCSEDSTNFDSVSLSPSTEGVYSDLDELFVFNPRAILPCFVVIYSGY

SEQ ID NO: 1135 - protein, 523 aa, Physcomitrella patens subsp. patens
MAGSWSHDNCGRDGGTQQLPRGQKQLNGSSPGGSVEAWGGDYPTASIGDAAVDVDFTMRSGEGSKKLGRQSPIWLPSSSAHARPAPNTTPWPSALLLIARVLHSKSYALFAFSVQIHLHITPLLHFSPVPLSRQLSPVPPRVEVWQLRKSMTADQQKVKMKIQCGVCQRNPASVLCCAEEAALCTKCDARTQTANKHGRVALHSVPEPAKCDICQEKRGFFFCLEDRALLCRDCDVSIHTANTLSCNHRRYLVPGTRVHLEDVKGVPVKPIAPEVYLPVASPAASSMSQSSHSSRSSNLSSSTSTLPGPRILSKQTSNAKPSGSVCSPSPVQTFTLEMVQAAYSGKVNAQAVAEATKPTQQFSASQTPPLVSLPSMGVSSSGSMRKSSISEFLTDAVPGWRVDELLNFADCNEQFNPTDFSTSKMMEGETAVEGDYDWTADLSLFEAQMFSMHEVPQFPPPPPTLSASPKSNRVARQLQRISHIKQGSYLQDAFLVPDVRIASAPTSQSVPKRFKRDLYHMLN

SEQ ID NO: 1136 - protein, 242 aa, Arabidopsis thaliana
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 1137 - protein, 248 aa, Triticum aestivum
  misc_feature (232)..(232): Xaa can be any naturally occurring amino acid
MGRSPCCEKEHTNKGAWTKEEDQRLVAYIRANGEGCWRSLPKAAGLLRCGKSCRLRWMNYLRPDLKRGNFTDDEDELIIRLHSLLGNKWSLIAGQLPGRTDNEIKNYWNTHIKRKLLSRGMDPHTHRPLTPVDGAAASRPAHIAVPARAAPPTMFAPLPTKQPPMESSSDDGSSGATSTGEPRCPDLNLDLSVGPPAADTPTSHPVCLCRHLGLRGGAVCSCRQADSPGSQXGGGFRYFRPLEEGQYI

SEQ ID NO: 1138 - protein, 382 aa, Zea mays
MGSSGADTSSKPNKASAPQEQQQPATSGAATPAVYPDWSSFQAYPPIPPHGFFPSPVASSPQGHPYMWGAQPMIPPYGAPPYVMYPPGVYAHPSMASGAHPFTPYAITSPNGNADATGTTAVACDTDGKPSEGKDKSPTKRPKGTLGSLNMLTGKNPSEHGKTSGASANGATSQSGESGSDSSSEGSEGNSHNDSYKHSGQEQDGDVRSSQNGASRSPSEGKFNQAMAIMPMPSSGPVTGPTTNLNIGMDYWANTASSAPVIHGKVTPTTVPGAVVPAEQWIQDERELKRQKRKQSNRESARRSRLRKQAECEELAQRADVLKQENASLRDEVNRIRKEYEELLSKNNSLKEKLEGKQHKTDEAGLNNKLQHSGNDIQKKGN

SEQ ID NO: 1139 - protein, 250 aa, Oryza sativa
MKVQCDVCAAEAASVFCCADEAALCDACDRRVHSANKLAGKHRRFSLLQPLASSSSAQKPPLCDICQEKRGFLFCKEDRAILCRECDVTVHTTSELTRRHGRFLLTGVRLSSAPMDSPAPSEEEEEEAGEDYSCSPSSVAGTAAGSASDGSSISEYLTKTLPGWHVEDFLVDEATAGFSSSDGLFQGGLLAQIGGVPDGYAAWAGREQLHSGVAVAADERASRERWVPQMNAEWGAGSKRPRASPPCLYW

SEQ ID NO: 1140 - protein, 183 aa, Avena sativa
YRVSIGLPGNGGWCSGWGRGDDGGAANARASVQGRGETWVRRRSGRQGCGGGGGRREEEGAGPAAKAQVVGWPPIRSYRKNTMATSLSAPRSKDEVEAKQAPVAGCLYVKVSMDGAPYLRKVDLKMYKNYKDLSLELEKKFSCFTVGHGESNGKSGRDGLSDCRLMDPKSGAELVLTYEDKDG

SEQ ID NO: 1141 - protein, 543 aa, Zea mays
  misc_feature (408)..(408): Xaa can be any naturally occurring amino acid
MVAREEQAMTREVKGKGLLVDILDDHEEVSIDNSKLLDLNEGFDVEDEGGEAAGDDEDEEDEGEEGDDGGSTTDVGGSASSSNNRSSNNNNSESEKADAKGGSKSEVSGEQRVPSVRQYNRSKLPRLRWTPDLHMAFVHAVERLGGQERATPKLVLQMMNVRGLSIAHVKSHLQMYRSKKLDQDGRPRGAVSSVYSPMDFHFMRADHRRFHNMSFFQRAAASASSSGGQERGGFFASRNFSTPELSRLYGLLHHRPAPTQTFDFRNSSFRNHEWPWAASSNQQEAMTISRKHVVMPPSTSPQTHASLASSAALRSDRRWWPFTEAGAAVAAGEHRAGTGVTSVKFDNCVGSSSRPLPLPMSPAVCGDRRLPFRWRHGGSSRDVVVGYPGSSSMVAKRSSSDPVVIDDXINSRYRTRQNSKRVVEPTRASTATPAEEDEACLKRRPSSPVEAQDATTTTLDLQLGLSPTTASAKKRKTSGPFFIDDTSCEFSTSLSLSPPVAAPAVSTQQRQEKTRRSSDDNGGGGGVLGQSTLDLTMSIRALE

SEQ ID NO: 1142 - protein, 334 aa, Malus x domestica
MEEQAQHYTSCCSATMSNISSPHVMPCLTEQWGNLPFQVDDSEDMIVYNSLRDAFSLGWSPDHTFPFQVDDWEDMINNNSDALSLGWSPDHTLECIKPEQAYDLDHLFDQYHDQLPPDLFTQSQPHDFDVSINGNKPSQALVLPPDTDIPPLDHDDRDQNQVQVGDAVAEQEELNVNVPKLQKSGVARGRHYRGVRQRPWGKFAAEIRDPAKNGARVWLGTYETSEEAALAYDRAAFRIRGSKALLNFPHRIGLNEPPPVRVTGKRKEPDQEAAASSSTSSSSSATPTAATKRSKLDKSVSSSADHDHQANVCHTRQKNNTSYMLAIGEQLLVS

SEQ ID NO: 1143 - protein, 120 aa, Avena sativa
GSVVGWPPVRSYRRNAMTVQSVKIKKEEETEKQQPASAVAAAAAAATAGGNGSAFVKVSMDGAPYLRKVDLKMYNTYKDLSIALQKMFSTFTATGNEGKMVEAVNGSDVVTTYEDKDGDW

SEQ ID NO: 1144 - protein, 255 aa, Petunia integrifolia
MSTSNASTSGVRKGAWTEEEDLLLRECIEKYGEGKWHLVPVRAGLNRCRKSCRLRWLNYLRPHIKGGDFSLDEVDLILRLHKLLGNRWSLIAGRLPGRTANDVKNYWNTHLRKKLIAPHDQKQESKNKAMKITENSIIKPRPRTFSRPAMNHVSCWNGKSCNKNTIDKNEGDTEIIKFGDEKQKPEESIVDGLQWWANLLANNIEIEELVSYNSPTLLHEETAPSVNAESSLTQEGGSGLSDFSVDIDDIWDLLS

SEQ ID NO: 1145 - protein, 345 aa, Oryza sativa Japonica Group
MGRSPCCEKEGLKKGPWTPEEDQKLLAYIEQHGHGCWRSLPSKAGLQRCGKSCRLRWTNYLRPDIKRGKFSLQEEQTIIQLHALLGNRWSAIATHLPKRTDNEIKNYWNTHLKKRLAKMGIDPVTHKPRSDVAGAGGGGGGAAGGAAGAQHAKAAAHLSHTAQWESARLEAEARLAREAKLRALAASATPGAPHLPAPPASAAAAAAAHGLDSPTSTLSFSESAVLATVLEAHGAAAAAAARAAMQPMQAYDEACKDQHWGDVDAADVGFPGAGAGFTGLLLEGSLNQIPRPAGRDAEADGEFQETEEEKNYWNSILNLVNSSSAPMSTAVVVPASHAYSPAPDF

SEQ ID NO: 1146 - protein, 315 aa, Brassica napus
MGIQETDPLAQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGKRVGIKKALVFYIGKAPKGTKTNWIMHEYRLLEPSRANGSSKLDDWVLCRIYKKQSSAQKQAYEHVVTSTRELSNNGTSSTTSSSSHFEDVLDSLHHETDNRNFQYANSNRLSSLRPDLTVGEKTGFNGFADTNSFDWGSFVGNVEHNSGPELGLSHVVPSLEFNSGYLKMEEEFNNPDDFGFAQNGYGIDSVGFGYSGQVGGFGYI

SEQ ID NO: 1147 - protein, 255 aa, Petunia integrifolia
MSTSNASTSGVRKGAWTEEEDLLLRECIEKYGEGKWHLVPVRAGLNRCRKSCRLRWLNYLRPHIKRGDFSLDEVDLILRLHKLLGNRWSLVAGRLPGRTANDVKNYWNTHLRKKLIAPHDQKQESKNKAMKITENNIIKPRPQTFSRPAMNHVSCWNGKSCSKNTIDKNEGDTEIIKFSDEKQKPEESIDDGLQWWANLLANNIEIEELVSCNSPTLLHEETAPSVNAESSLTQGGGSGLSDFSVDIDDIWDLVS

SEQ ID NO: 1148 - protein, 496 aa, Vitis aestivalis
  misc_feature (225)..(238): Xaa can be any naturally occurring amino acid
SDMAEVAQKLEQLEEVIVNAQEDGLSHLASETVHYNPSDLSNWLGSMLSEFNPTPNCALDNPFLPPISPLDYTNCSTQPKQEPSIFDSPSLDYDLKAIPGKALYSHIEQPPQQPPAPPLYQRDNKRLKPTTSATANSVSSVIGGWGVPTESARPVVLVDSQETGIRLVHTLMACAEAVQQENLKLAEALVKQIGFLAVSQAGAMRKVATYFAEGLARRIYRLYPXXXXXXXXXXXXXXHFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLAL

SEQ ID NO: 1149 - protein, 103 aa, Yarrowia lipolytica CLIB122
MPKDASAPRRTRKTTGKKKKDPNAPKRALSAYMFFANDNRDAIRADNPGIAFGQVGKALGEKWKTLTDAEKVPYEEKATADKKRYEDEKAAYKANAAEFDEEE

SEQ ID NO: 1150 - protein, 333 aa, Zea mays
MALEAVVFPKEHLAGTAKARSASSLACGFRTEEVEDNGGVVLQGEAGAATTWEYWDAALCPCSTAPAGAVEECWDVRHRLSASPPPPAPSAAVAAPSSGHGKAAAAARRRRRQRPKAVKNTEEVESQRRNHIAVERNRRRQMNEYLSVLRSALPPSYPQRGDQASIVAGAINFVKELEHLLQSLEAQKRRRQGCTEPPAPAPFAGLFTFPQYSTAATGVVAGSGDGAGCGAAGARRGVADIEVAVAESHASVKVVTPRRPRQLLRMVVALQCLGLTVLHLNVTTTADQLVLYSLSLKMEDECRLSSVDDIAAAVNDILAKISDERASRHLVAA

SEQ ID NO: 1151 - protein, 72 aa, Physcomitrella patens subsp. patens
EPRFAIKTRTDVDIMDDGFKWRKYGQKAVKNSPHPRNYYRCTTPQCPVRKRVERSSEDAGLVITTYEGTHTH

SEQ ID NO: 1152 - protein, 496 aa, Vitis flexuosa
  misc_feature (225)..(239): Xaa can be any naturally occurring amino acid
SDMAEVAQKLEQLEEVIVNPQEDGLSHLASETVHYNPSDLSNWLGSMLSEFNPTPNCALDNPFLPPISPLDYTNCSTQPKQEPSIFDSPSLDYDLKAIPGKALYSHIEQPPQQPPAPPLYQRDNKRLKPTTSATANSVSSVIGGWGVPTESARPVVLVDSQETGIRLVHTLMACAEAVQQENLKLAEALVKQIGFLAVSQAGAMRKVATYFAEGLARRIYRLYPXXXXXXXXXXXXXXXFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLAL

SEQ ID NO: 1153 - protein, 413 aa, Oryza sativa Japonica Group
MSSETAASPPPPPPNPPAADSTHSSPASMTDETHGAGAHPDESQPHRSSSSSSSPPVAVDGETRVPLPVRSLPQPSHPSPPPSGEDEDDVVITGQIAVGDAAGAAMEERVKGPWSSDEDTLLSNLVEKLGPRNWTLIARGIPGRSGKSCRLRWCNQLDPQVKRKPFTEEEDRIIMAAHAIHGNKWAAIAKLLVGRTDNAIKNHWNSTLRRRHCTGGRCTQGGVMKRAIPERPRSVSEEPWPLGNLSSLNVREAMEAPAQTVSESYVGAWQIGDQSCKTEVVDPPYLARPVAKVGAFKPYNVGPAQSSQKEMLSFATKFDSNLHPFKPENGVCKFVDPTSFAAEVPNKCGHGCCSSHGQLRKNSLLGPEFNEFEDHPPISDSSFASLVSEISSIAWMKSGLQSSDTLARSVPPA

SEQ ID NO: 1154 - protein, 485 aa, Arabidopsis thaliana
MDLSAKDEFSAEKRNPDNYDSVNNPSGDWRVDSYPSENLISAGPASCSPSQMMDSFGQTLWYDPTSVQAVGYAGFNGGNASSSSFRGSIDRSLEMGWNLPNLLPPKGNGLFLPNASSFLPPSMAQFPADSGFIERAARFSLFSGGNFSDMVNQPLGNSEAIGLFLQGGGTMQGQCQSNELNVGEPHNDVSVAVKESTVRSSEQAKPNVPGSGNVSEDTQSSGGNGQKGRETSSNTKKRKRNGQNSEAAQSHRSQQSEEEPDNNGDEKRNDEQSPNSPGKKSNSGKQQGKQSSDPPKDGYIHVRARRGQATNSHSLAERVRREKISERMKFLQDLVPGCNKVTGKAVMLDEIINYVQSLQRQVEFLSMKLATVNPQMDFNLEGLLAKDALQLRAGSSSTTPFPPNMSMAYPPLPHGFMQQTLSSIGRTITSPLSPMNGGFKRQETNGWEGDLQNVIHINYGAGDVTPDPQAAATASLPAANMKVEP

SEQ ID NO: 1155 - protein, 244 aa, Hordeum vulgare subsp. vulgare
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRARKNQLMHESISELQKKERSLQEENKVLQKELVEKQKAQAAQQDQTQPQTSSSSSSFMMRDAPPVADTSNHPAAAGERAEDVAVQPQVPLRTALPLWMVSHING

SEQ ID NO: 1156 - protein, 1781 aa, Chlamydomonas reinhardtii
MQDEDGGDDAGAPEHEAQDVRNGDSGRGDGGGGGHMYASEPPRGPEPMTLISGCSETASGHRIDGGEAPSVSHSPSGAGGGASAPGAAGGASGATRPEQAETAPSRMSANHQLPGADPTAGASPRNGSGIAAADGDAEGSGDGDGDEEEEEEDDEELGDALAGAPAEGAVSGSRPAKAARSKAQPRGRRPKAAKQDGGGEGGSDSEDEDGGESRHLGRRVIEYAEKIVEQAWAANQLSDVPHTATLDCNELPGIGFKKAGRILATAAVRLLVRGEEAQKKGTLRTLLRSAENAGILAQQGGPAGAAGIAAGGGAARGTAGGADMGASAAAAAAAAAAVASMPNLASMDPETLRVCLAAAAAAAAAAAGTPSATSGVTQQPQTHAQANAIVNLASELQQHGLGQWAVQAAAEVAMKAAAAVLQQQQQHAAAAAAADPRGAGSSVDAGPSSLNLLTAAAVGPPDMRHFGGFAAAPSHAAAGGNMATLYSAQGNPRVEPAAAPGPFQQMVLEAALADDCNPDGGAGAGLTTGGELECTLSGPRSSTDELLQAVFDGMGDPGGARALTGNSGGGPSGGSNVVAGVAEPRKSDGAAWDLLGQMFDSYCGGGAPAAATDTQASVSLPHRQHHQPLQLPLPHVSLQHPALAMIAAAEAAGPTGGFRLNGGSITMLDAWVDAQNDEHVDAAVVAAMVAGDDDVPRLHDTLGPVVGGAATAACADGAGLSTASRQHQHQHPQQQAAPTPTLLAPMPVRGGGGAGVSALADVSPGDHSPGSDGGGLMAPPQPRPPICISPPPEDLDPSELRDDFPDLPLTASMFRISNMSIADGPPAPGSARPSASAFGANPFGQFGAAGGVGGGGTPNRLSNALSILRAGSAGCMDMLMSNDFMDALAAADPLLAAEVSAGGAAGGGGRASHADKFLMSIDALPPVPPLLPPSLIPPGYANALVMTTGDAGAGLSNSGPLSAAAGAAGYRRHQQGMEAHAALERVAEEQPDVDAEGTEEPEEEWGQGRRPRRGAASRAVTARSGAPREVLQEGEDEGEDDGGTVAAAPWAAPPARTFVEGPTAAAAVAAAGAIMAPQCRAVAGVLGGGTTSIALGGNGHRGAPPQAAPGPSSFSAPFGGGGGGSSLSGNSQGGPVTARALFMMDGAGGLAGGGGGAGVTFADGLGGDCAPSLMPPPPPFQHGHGHGHHNLFADPRYGAAAHDLEAMNRQQLSAPAVLEHPGAAMLCAGAGDATATSTSGVSGGGCGGGVGGGSVVSSAADPSGGLFAGPAAMLASLTAAAAAGGGVMGMAASAPQPQVPVGLVSMGTGHSSGSQLYASAASVAPGGGGGLWAEQPQAVVKAASASPSPSPLARGSDGRVIRRGAGAAAAAGFAEMGLAAYDGVTAAGVADGAAAAAEEAKEASTLAAAIAAATTGGGSVDGFTRKKGGAKAAGGGRAGRGAKRGGAGSADIGSGSDDMDAGSAPSGGGAAPTAERPSGVGRLGAAAPSGRGSQMDSGDEESGGGGGGDEEGDGGGVSGGGEGVSVVNLRKVTQDGAPRQLTKQSLKDVYHLPINEAAAALNIGVTVLKKYCRKFSIPRWPYRKLNSVNKLMETFERYKRDALLGGNVTGGEECEVVLQSLGKMKVELYEDPDKDIDERIKKLRQANFKVEYRARQDTTGKQQQPQQQQHQDEFQQLLQQQLQQHLMQQQQQQMFLPQQQQQQQQQQELPGAQGQQMLMPVGDGFGMHGGMPQGAAGMLPAMPPPFLLPPFNPAALPSQFLPEGSAQGFGGGCPAANPTNF

SEQ ID NO: 1157 - protein, 346 aa, Arabidopsis thaliana
MAAEDRSEELSSNVENGSCNSNEGINPETSSHWIENVVKVRKPYTVTKQREKWSEEEHDRFLEAIKLYGRGWRQIQEHIGTKTAVQIRSHAQKFFSKMAQEADSRSEGSVKAIVIPPPRPKRKPAHPYPRKSPVPYTQSPPPNLSAMEKGTKSPTSVLSSFGSEDQVNRCSSPNSCTSDIQSIGATSIDKKNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRARIC

SEQ ID NO: 1158 - protein, 544 aa, Chlamydomonas reinhardtii
MPTGPLFVGSYGPTQQQQQQQQQNLMRALEEARRSAGQQQPAGSSGGHGGGAGDNGVPCRGFARTSSGSTAGGGSAHHHQQHQQQHQQQQPYQQQQQPALADGCNSPPAGPASRNPSGRSLLIRHTSGLARTTSAAATAAAGGASGITSPRSPAAAAAAGGGPGTPRSRSFRQQQSQQQRSDVPPPSSLLGSGTFLAGDMGIKLEDGSTAPVGYLGAAAAAVPTGAAPTAALAAALAAGVMRRGGGSDDGGAGAPAAASGDSGEGSGADADAAGGTVRRSRREPRGGVKTSRSGGAGGRRRRAGDDDDAPYETDDAEEEESSDGSDSDLDDDFLGGGGGGRRSRKLGRDGGDDDVDGGYYVDDNSVLVVRAVKDGQRREITKHALRKVYHLPINEAAAALNIGVTVLKKYCRKFRVPRWPYRKLQSMGKLIESFQRYKKGALGAGNTDEAERCEAVIQSLYRFREEVYDNPDKDIDESVKKLRQANFKIEYRQRQGQTQGAPSTAAAAADILIEDGIGMEGVAMEAGRGGAEGGSSSTSEAVAA

SEQ ID NO: 1159 - protein, 352 aa, Oryza sativa Japonica Group
MAMGMEGSGGGGSAKKKEESLPPGFRFHPTDEELITYYLRQKIADGGFTARAIAEVDLNKCEPWDLPEKAKMGEKEWYFFSLRDRKYPTGVRTNRATNAGYWKTTGKDKEIFTGQPPATPELVGMKKTLVFYKGRAPRGEKTNWVMHEYRLHSKSIPKSNKDEWVVCRIFAKTAGVKKYPSNNAHSRSHHPYTLDMVPPLLPALLQQDPFGRGHHPYMNPVDMAELSRFARGTPGLHPHIQPHPGYINPAAPFTLSGLNLNLGSSPAMPPPPPPPPQSILQAMSMPMNQPRSTTNQVMVTEQMIPGLANGVIPQGTDGGFTTDVVVGGTGIRYQNLDVEQLVERYWPGSYQM

SEQ ID NO: 1160 - protein, 610 aa, Solanum lycopersicum
MMMFEEMGFCGDLDFFPAPLKEVEVSAPQSQTEPDSVVDDDYSDEEEIEVDELERRMWRDKMKLKRLKEMSKSKEGVDPAKQRQSQEQARRKKMSRAQDGILKYMLKMMEVCKAQGFVYGIIPEKGKPVSGASDNLREWWKDKVRFDRNGPAAIAKYQADHAIPGMNEGSNPVGPTPHTLQELQDTTLGSLLSALMQHCDPPQRRFPLEKGVPPPWWPTGKEDWWPQLGLQKDQGSLPYKKPHDLKKAWKVGVLTAVIKHMFPDIAKIRKLVRQSKCLQDKMTAKESATWLAIISQEEALARELYPDRCPPLSSAGVSGNFMLNDSSEYDVEGAQDEPNFDVHEQKPNHLNLLNISAERFKETMPLQQQSHPNKDELVTNLDFSLKRKQANEPTVMMDQKIYTCEFLQCPHNELRHGFQDRSSRDNHQFACLYRSSTCFGVSNFQINEVKPVVFPQQYVQPKSSALPVNQGPPSFDLSGIGVPEDGQRMINELMSIYDSDVQGSKRQNRGNIALTKEQPHQQPRVHQDNYLLSQGIMDGNIFKNTNISTTQSMLPQVDPFDQSKAFNAGSNDNFHFMFGSPFNIQSTNYNGNLPSIGYDTTPKQDAPIWY

SEQ ID NO: 1161 - protein, 614 aa, Solanum lycopersicum
MMMFEDIGFCADLDFFPAPLKEAETVAAVPPIVPEPMMDDDDSDEEIDVDELEKRMWRDKMKLKRLKEMSKGKEGVDAVKQRQSQEQARRKKMSRAQDGILKYMLKMMEVCKAQGFVYGIIPEKGKPVTGASDNLREWWKDKVRFDRNGPAAIAKYQADNAIPGKNEGANPIGPTPHTLQELQDTTLGSLLSALMQHCDPPQRRFPLEKGVSPPWWPNGQEDWWPQLGLPNDQGPPPYKKPHDLKKAWKVGVLTAVIKHISPDIAKIRKLVRQSKCLQDKMTAKESATWLAIINQEEVLARELYPDRCPPLSSGGSSGTFTMNDSSEYDVEGAIDDPIFDVQEQKPNHLSLLNVNVEMFKEKLPLLQQSQPMKGDIFANLDFTRKRKPADDLTFLMDPKTYTCECLHCPHSELRNGFPDRSSRDNHQLTCLFRNTSQFVVPNFHMEEVKPVVFPQQYAEPKRASLPVNPAPPSFDTSGLGVPADGQRVINELMSFYESNVQGNKSSMAGNSVMSKEQPLQQPSIQQNNYLQSQGNVLEGSIFGDTNISANNSMFVQGDRFDQSKVLTSPFNASSTDDFNFMFGSPFNMQSTDLSECLSGISHDDVTKQDASVWY

SEQ ID NO: 1162 - protein, 601 aa, Solanum lycopersicum
MGIFEDMGFSGNFEFLSDSMGCGAQEVEHKPVGLEEDDYSDEEMDVEELERRMWRDRMLLRRLKEKNKNKVVGDGAKQRQSQEQARRKKMSRAQDGILKYMLKMMEVCNAQGFVYGIIPEKGKPVTGASDNLRAWWKEKVRFDRNGPAAIAKYQADNQIPGRVEESSVIVSTPHTLQELQDTTLGSLLSALMQHCDPPQRRFPLEKGVSPPWWPSGKEEWWGQLGLPNDQVQPPYKKPHDLKKAWKVGVLTAVIKHISPDIAKIRKLVRQSKCLQDKMTAKESATWLAIINQEEALARKLYPDSYPQGSLAVGNGSFFISDASDYDVEGVDNERNNEVECKPHDINLQTGIMLPKDRVLMPGLAPVKGEIIDLTSDFIQKRKEPCFEESVDQKIYTCEYLHCPYSNYQAGFLDRTSRNNHQMSCPFRFNSAQTLTTPKYQINYEHNTVFPAQTATSKPAVSSVTASSSMSASGLGLPEDDQRIISDLITSYDNNFQQNGSICSGISEILVNQSLPQQQTVELPMDGNINLGHMETSAQETSMPVYRSTEFQYDQCKMSFDAPFGGNINDITDYRFGSPFNLGGSDYAVEQLTKQDISTWYL

SEQ ID NO: 1163 - protein, 179 aa, Rosa hybrid cultivar
MLKMMEVCKAQGFVYGIIPEKGKPVSGASDNLREWWKDKVRFDRNGPAAISKYQADNSIPGLMEDCISVASTPHTLQELQDTTLGSLLSALMQHCDPPQRRFPLEKGVSPPWWPTGNEEWWPQLNLANQGPPPYKKPHDLKKAWKVSVLTAVIKHMSPDINKIRKLVRQSKCLQDKMTA

SEQ ID NO: 1164 - protein, 162 aa, Cichorium intybus
VQQLESSRMKLSQLEQELQRARQQGIFISSSGEQSQSTSGNGASSFHVEYSRWLEEQNRRISELREAVSSHAADGELRLIVDGVITHYEDIFRIKNDAAKADVFHILSGMWKTPAERCFLWLGGFRSSELLKLLITQLEPLTEQQLLAINNLQQTSQQAEDA

SEQ ID NO: 1165 - protein, 246 aa, Oryza sativa Japonica Group
MAGGGGGGGRGEGEGRAATGKRERIAIRRIDNLAARQVTFSKRRRGLFKKAEELSILCDAEVGLVVFSATGKLFQFASTSMEQIIDRYNSHSKTLQRAEPSQLDLQGEDSSTCARLKEELAETSLRLRQMRGEELHRLNVEQLQELEKSLESGLGSVLKTKSKKILDEIDGLERKRMQLIEENLRLKEQLQVSRMSRMEEMQPGPDSEIVYEEGQSSESVTNASYPRPPPDNDYSSDTSLKLGLHS

SEQ ID NO: 1166 - protein, 180 aa, Cichorium intybus
NREAARKSRLRKKAYVQQLEASRLKLLHLEQELEQTKAQAALLSGGVNASHLGLPGTTNSGIAAFEMEYEHWVEEQNKKTNALKTALHAPLPDTELDVLVKDTLNHYANLFTIKATAAKVDVCYLISGMWKTSTERLFLWIGRFRPSELLKVLVPQLKLLDQQSHDLCNLIQACQQAEDA

SEQ ID NO: 1167 - protein, 220 aa, Oryza sativa Japonica Group
MALDGKPPVPPPSTPPMDSWACGGRRSKRRGGGGGSSGSSGSSGGGGGGESEEEYLAACLLMLAHGVRDEAEVVGVAAATAKPQHGYECSVCGKVYGSYQALGGHKTSHRKPPSPAAEPAAGEEPSSGGVAGEAKVHRCSICLRTFPSGQALGGHKRLHYEGGAVGDAVKEKNSLKTKAAVATAVLKDFDLNLPAAATTAGDEAESSPPEAKRARLLLLV

SEQ ID NO: 1168 - protein, 372 aa, Oryza sativa Japonica Group
MEAKSGEASVAPVAVATEATAATVSFQPQAAVAEQGSSSGGVLVPPPPMAAGGGGVVVAAAPVAGVVKVGKKRGRPRKYGPDGSLIRPLNATPISASVPMAASAVGPYTPASAVGAAMKRGRGRPLDFASTAKLHHHHQHQHHHQQQQFGFHFDSIGEMVACSAGANFTPHIITVAPGEDVTMKVISFSQQGPRAICILSANGVISNVTLRQPDSSGGTLTYEGRFELLSLSGSFMPTENSGTRSRSGGMSVSLASPDGRVVGGGVAGLLVAASPVQIVVGSFLPSYQMEQKNKKPRVEAAPALAQTPPAVPISSTDTHSSEQGQHSSVAPRTTNIVTSAYNPDQSWASPAQSIPDSARTPSGDVKVTASGA

SEQ ID NO: 1169 - protein, 273 aa, Ostreococcus tauri
MHDVDAIDDAVKRLKSKATFIDACHDIETIARARVGDENDGVLIDSLMSSSKRVDTTLRARYGDGATTEWSVGASVLEAIARAVERSTRDDGGVCAAAAARAKAKAESDASAGNRMRAVKGDKIAFEGQFTRDASTLDVEGASETSDSVNEALRLILAARRRFTLEVGDERQLMERFASTLGVSGDGAGERHAASTVSIEALRYRKPTEKETSDGKCAICFDGYAAHDSVISMPCAATHSFHEACVKEWLLRDDSCPLCRSSLPVWLGRPLYQ

SEQ ID NO: 1170 - protein, 262 aa, Oryza sativa Japonica Group
MEKEIISARSTTTTTTTAAAGDVNLDLRLVHSTAAGRQHTAATRNPAPPLAAAGDDRAFSCTYCRRRFYSSQALGGHQNAHKLERSLAKRSRELSAGVTTAAAPPPPHPEPRLALPARRAAPPRPSSAGSPTAGAATGTACTPRQPAATPRTSTFLSSCDTNRGKHPPITRMQGLSVLVASSMASWGLRYLMDHMVLPSYEANGQMGLVTIISAYHDICQMLDGIGLPEKDLALIKHTGLVNGMKRSVELNQDKNSEDPGIG

SEQ ID NO: 1171 - protein, 788 aa, Aspergillus oryzae
MSPQGLASRKRPAPGTSPIVHPQLGPVSNYPQNSGAQLSNDQFLQWGQNTSSNVVSPASFSDANPYGATAYSAGQDVPASTATASTQLARRQTPNQLVSRNRGYEQTPSSMSDHGSNTGEPGGWGESLDELYQRALVAKREVQAKRKQIPPFVQKLSSFLDESKNTDLIRWSDDGNSFIVLDEDEFAKTLIPELFKHNNYASFVRQLNMYGFHKKVGLSDNSMRASERKNKSPSEYANPYFKRGHPDLLWLIQKPKNTAGQGSKSGKANVRVKTEEVDEHDNDDYDDVPGARDDRSRNRQLSLIQGGSIMPKDQLAGVYRELQAIRQQQQVISNTITKLRREHEQLYAQAANFQEQHTRHENSINAILTFLATVYNRSLQGQEGPQNLANSFAGAISQDQGNVVDMGDDYSLSTLGAQHMNSPGGPRAMKKQPLLLKAAPSERQSRATTLSPAASAYDGPQPRGHARHPSAPQHGHVEEVFDTSPQPKEAQPPQTEQFPQRDIMSVIQNSNARNGVPPTSFADFPNVLSSLETSNGNVPLTPNQRADMLRLMANETSAGDSNVPVSQNNALVTPTPPPMPLGYSNRLANTRAEIDNLVKMQAEQDRSVQNLTNLLQPLSPTGTIPGMVTGDGSVPPPPLDLDQIFNNDYFTDIGDLEKNKNNLDFGNTTTSVPATAPIEPVTTGADDSVINDGNDLFDFDHIPDNGDLFDGPGQQQQNPGFYNGYDGSGFDNTINPGAGRIIETLTDSEATSPSNTVDEPAQYGVSNGGKDFQGGKGNGGSAKRRKKA

SEQ ID NO: 1172 - protein, 288 aa, Ostreococcus tauri
MPASSRNRRRGDLSEHPVGIIATPGSNENLNAPSTSGTKRKHNQNENSSTSTKFRGVTRSGNNYRAFIAREGKRYTLGQFTSAEAAAEAWDRASLTLGGTPKNFDEARYERERAKLIDPSYTIDDLRREYGMGAVVKAKSSYRGVTRDMRSGKWRAEIHRDGASLSLGVYESEREAAEAFDRAVLAVKGPNGKTNFSPENYPERLIPKTLEEYRDSLANLKTRKGGGKATSKYEGVRRYVHEWKNGEVTVKWRVELTINGKKKQIGYFKTEEEAAREVERRRFELKQS

SEQ ID NO: 1173 - protein, 129 aa, Petunia axillaris
MSTSNASTSGVRKGAWTEEEDLLLRECIEKYGEGKWHLVPVRAGLNRCRKSCRLRWLNYVRPHIKRGDFSLDEVELILRLHKLLGNKWSLIAGRLPGRTANNVKNYWNTHLRKKLIVPHDQKQESKTKP

SEQ ID NO: 1174 - protein, 272 aa, Arabidopsis thaliana
MAAIDMFNSNTDPFQEELMKALQPYTTNTDSSSPTYSNTVFGFNQTTSLGLNQLTPYQIHQIQNQLNQRRNIISPNLAPKPVPMKNMTAQKLYRGVRQRHWGKWVAEIRLPKNRTRLWLGTFDTAEEAAMAYDLAAYKLRGEFARLNFPQFRHEDGYYGGGSCFNPLHSSVDAKLQEICQSLRKTEDIDLPCSETELFPPKTEYQESEYGFLRSDENSFSDESHVESSSPESGITTFLDFSDSGFDEIGSFGLEKFPSVEIDWDPISKLSES

SEQ ID NO: 1175 - protein, 633 aa, Magnaporthe grisea 70-15
MSGTGSRQPLDASAGRDVVYCHACENEWFQDQNGLVCPQCHSEATEIVTPENDPRPVNTHDSRTEPQGHRDRYDDSDPEEEDIEEHSHRAPGGIYFTSRVFRMPVNHGAGTESPHVHPSDGNAVMERFYEMMNRDMGSSAAPGASNSDGTRSATGQGASENSGTRHYTTRTTMFPGGSTSFTITTAPLQRDGNNPPIGEFDAYADPHPRTRRRIVIVMLDSRGADSNASILSTIMGNITNPVGNTPHRGGETSSNDEASGLPPHGFPIAFQQLLGALMTGYGGTRNWGDVVTSQEEFDRIISQMMEANPMSNAAPPASEAAIEKLERKKLDEKMLGTDETVECTICMDDLSLGDEATVLPCKHFFHGECVTIWLKEHNTCPICRTPMEQRSSAERTQAPQNQSSSGPRAARPEPPRGIFPWAFQPSGSGTGSFVNSSSQRPSQSSQQSPIDIQQNDSGHTSHRRELLRSPSTNEERLRAIRDLANSDRHGGSDRPTTPPFAGRRRNSLSPPSPSMQAPWNLSYDPVHDFTSASRDRTRERDGDRSNSQSSSRFTSTNRDQEGHRDRERYRQQTYESSQPPSREQRDQERNDDNGSRRGDPNQTSSGSTFDPFSWIRDRLPGGGNSSGDSHRRG

SEQ ID NO: 1176 - protein, 203 aa, Vitis vinifera
MAEKEVKSIGSVKDVRKEMNRGAWTAEEDRKLAEVIEVHGAKRWKMIATTAGLNRCGKSCRLRWMNYLRPNIKRGNISDQEEDLILRLHKLLGNRWSLIAGRLPGRTDNEIKNYWNSHLSKKIKQEKQSGGSTRGCSKLQRTRVVEEVNVVEVKREDTSNGGDQCSKMSFNVDEFFDFSEEGPLNLEWVSQFLELDEGLCHPS

SEQ ID NO: 1177 - protein, 120 aa, Petunia axillaris
MSTSNASTSGVRKGAWTEEEDLLLRECIEKYGEGKWHLVPVRAGLNRCRKSCRLRRLNYLRPHIKRGDFSLDEVDLILRLHKLLGNRWSLIAGRLPGRTANDVKNYWNTDLRKKLIAPHD

SEQ ID NO: 1178 - protein, 494 aa, Vitis riparia
  misc_feature (225)..(238): Xaa can be any naturally occurring amino acid
SDMAEVAQKLEQLEEVIVNAQEDGLSHLASETVHYNPSDLSNWLESMLSEFNPTPNCALDNPFLPPISSLDYTNCSTQPKQEPSIFDSPSLDYDLKAIPGKALYSHIEQPPQQPSAPPLYQRDNKRLKPTTSATANSVSSVIGGWGVPTESARPVVLVDSQETGIRLVHTLMACAEAVQQENLKLAEALVKQIGFLAVSQAGAMRKVATYFAEGLARRIYRLYPXXXXXXXXXXXXXXHFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLL

SEQ ID NO: 1179 - protein, 252 aa, Olimarabidopsis pumila
MEGGAALYNPRTVEEVFKDFKGRRAAIVKALTTDVQEFYQQCDPEKENLCLYGLPNEEWEVNLPAEEVPPELPEPALGINFARDGLSEKEWLSLVAIHSDAWLLSVSFYFGSRFSFHKEDRKRLFNMINDVPTIFEVVTGMAKKQSKDKSSSANQNGNKSKSNSKVRTSDGKSSKAMQVKDEDEEVDEEDEDDHGETLCGACGDSDGADEFWICCDLCEKWFHGKCVKITPARAEHIKQYKCPSCSNKRARA

SEQ ID NO: 1180 - protein, 496 aa, Vitis rotundifolia
  misc_feature (225)..(238): Xaa can be any naturally occurring amino acid
SDMAEVAQKLEQLEEVIVNAQEDGLSHLASETVHYNPSDLSNWLESMLSEFNPTPNCALDNPFLPPISSLDYTNCSTQPKQEPSIFDSPSLDYDLKAIPGKALYSHIEQPPQQPSAPPLYQRDNKRLKPTTSATANSVSSVIGGWGVPTESARPVVLVDSQETGIRLVHTLMACAEAVQQENLKLAEALVKQIGFLAVSQAGAMRKVATYFAEGLARRIYRLYPXXXXXXXXXXXXXXHFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLAL

SEQ ID NO: 1181 - protein, 519 aa, Pinus thunbergii
MPETNKEPQVVVPMEADQGNLCLGNGNFRDENVSGSSSSSSAACASELAEMDARSSQETGNGNGPGSEARVQTGKLFGFSFSNITKGNCAELSKGVSNGGGSGCGTNSVTRQFFPAGQEFDSQVMIPGRPQLPRAHWVGLTFRQAESFRSPTPKESAQPIKKSRRGPRSRSSQYRGVTFYRRTGRWESHIWDCGKQVYLGGFDTAHAAARAYDRAAIKFRGVDADINFNIDDYEEDVKQMNKLTKEEFVHVLRRQSTGFPRGSSKFRGVTLHKCGRWEARMGQFLGKKYVYLGLFDNEVEAARAYDKAAIRCNGREAVTNFSPELYESELALTEEKGRDPDLDLSLGNSTPKEGSLVSKDNTDGSMRPESDLSTLSEANWKTLTQPTVPSLMDGLNQSAQSLSCEVPSLQRYQQPAGSCEVPSLQRYQQPPGWVWQLPTNRPAPPSPMIESAASSGFSPQIFSSTTSPSSEWLQKRGFHFLFQPALMQTKNILHSTTAPALINTYGKKTGDHSLNLSLG

SEQ ID NO: 1182 - protein, 554 aa, Pinus thunbergii
MTVNTSAASEINTHSKGEQDTCITHQFSVVNRAPDSASSLPLEEIRGPVNQFSRSLWGDHLASSQTDSSGTPNPPTVPIQPVKKSRRGPRSRSSQYRGVTFYRRTGRWESHIWDCGKQVYLGGFDTAHAAARAYDRAAIKFRGQDADINFNLSDYEDDLKQLNNLTKEEFVHILRRQSNGFSRGSSKYRGVTLHKCGRWEARMGQFLGKKYIYLGLFDYEIEAARAYDQAAIRCNGREAVTNFDPSVYQNDLLTEGIDQNLDLSLGISAPTLPDTTVSRDNKIGGSKVKTSTNIVVEPDWKKARCAISTPEDASQQTQLEAPFSYGQLGPYTGLQDRETFSSQGKQTPITFLPRYQVHHPNSEKIQVNGTLNHNPMRLLPNPKDDSIHLTLEQQGLWSRVCPPSFANYKLYSPNGGLQGQGGSGLSSPLSSSIEHQSSWPWKLYTNGSSASMLAAASSGFSPQAQITVAHPSDWLHKLQGAQSMGTTQLSAPKSASQRQNLHSIQASLSGQVLGLGLNLSTKSKAELCSSKDTVRSKSLKGVVGDGRSFGVKDR

SEQ ID NO: 1183 - protein, 163 aa, Triticum aestivum
MASKHSSAVVPNLLAPAEKQRRAHREYIASITLNDIAQYFHLPIREASRTLKIGLSILKKKCRQYGIPRWPHRKLKSLDSLIHDLEYVIDDETERDGVKQEDHMQDEKENQDAIEALAKRKRMLETEKATIQQKPTLDLMAETKQFRQYVFKRKYRAKTLVSE

SEQ ID NO: 1184 - protein, 436 aa, Arabidopsis thaliana
MDPRLQHAAETGSINDFYALIEENPYILDNINAVPFVNTPLHVAAASDNIPFAMEMLNLKPSFARKLNTSGYSPLHLAVEKDHREFITWLLWRDPGLVRVKGREGITPFHLLAIRGDVNLVAECLKYCPVCIQDVSVNGHNALHLAVMNDRFEILQVLTGWLQRMSQKDSASTESDFLNRKDLAHNTPLHLAAYKEDHQAVKLLLQCQLVKLNEVNADGLTFLDILRNNGQSRDLDKDLEQVVVKTGCKEAASLPQLEKPSDQFKSPVTFLAHCSIGIRRLRSDTSEEGRAVFLIICTLILTSTYQTALQPPGGVHQSEGGGTAVMKQTFFIVLWVSNTIGFCCALLYTFCLLPIGSLFTTWFFWIGASLGVSYALAMAIISPNPLLFLCAAFTLYLLFPMYLFMEIFIALRLSHLKAAVNRMFVTFVKQRGTLRI

SEQ ID NO: 1185 - protein, 280 aa, Glycine max
MATTTQLHLPPGFRFHPTDEELVIHYLCRKCASQHIAVPIIAEIDLYKYDPWDLPGMALYGEKEWYFFTPRDRKYPNGSRPNRSAGTGYWKATGADKPVGKPKPVGIKKALVFYAGKAPKGEKTNWIMHEYRLADVDRSVRKKNSLRLDDWVLCRIYNKKGAIEKQQLPPPSGVRKIECSEMEDEKPEILPPDPPYTAATVADCLYFEASDSVPRLHTTDSSCSEQVVSAEFASEVQSEPKRGSNNNNEFAYNYVDATLGNNQMSPLQDIFMYLSKSFCN

SEQ ID NO: 1186 - protein, 218 aa, Oryza sativa
  misc_feature (23)..(23): Xaa can be any naturally occurring amino acid
MVTVREEMRKGPWTEQEDLQLGXNRTGKSCRLRWVNYLHPGLKHGRMSPQEEHLIIELHARWGNRWSRIARRLPGRTDNEIKNYWRTHMRKKAQERRGDMSPSSSSSSLAYQSCLLDTVPIISMDGGDIHDDRSCMARVLKSTQSVMDGYTLDQIWREIEAPGAPSLLGIDEGKDKACSNLPCPLLTSTMSDYSCPEVFWKIDHEGTRMLATQSGYGK

SEQ ID NO: 1187 - protein, 341 aa, Zea mays
MDFSGELDDFSLQLISDQLLGGEACLPVVPNAAAYTASSVHYHHPTQAAFLQQPAQQVAYVDLTNEYAADATACDCEAAFRAAEPVMIRFGGDPSPVSDSDPSRRPLLLTVSLPPPASHAWGPAAAVPLPLEAAAAALDANDFRKYRGVRQRPWGKFAAEIRDPKRRGSRVWLGTYDTAVDAARAYDRAAFRMRGAKAILNFPNEVGSRGADFLAPPPPPPPVAAAATSSSSQNKRKLRDAEATAGGAAEPAAANKSVKAAEASGSPAPPSLSPATTTTTTTTTTTASTVTTCCSPSSGSAAAAHEVFPMTPSSWTWEQLEGVFGSLSPLSTTHPQLGFPE

SEQ ID NO: 1188 - protein, 514 aa, Ostreococcus tauri
MRARGANARDGTSVVVVRDDGRDDARGAKGQGASGLDAIFAAIPENELRSTDNANEKKMTHEKRTSKRREGERESAEARAKTNAAASTPVVSQRRGEEGRKATAKVDAKGKAREPLPKPEYTPQCPRCKSEDTKFCYYNNYNIKQPRFYCKECCRYWTEGGLLRNVRVGAGRRKSKSAKDKEAANTVTDKPAVGDDALGAKRSRRTGDDNRGREKSARNQKRDGSSDGSATEAEQGEGTFEYARGFPHGSNTGSDTAVRGRSPPEEQGSAEGEGSQRPGDHMRFLGGWGIDPSVARYVSTGLLPPNDDAIQAQAAAAAAASAAILNEATRWGMHFWNKQSTFPYNMPSSSSTSTMSEFPGNAQVGRGGVPTPIALAALKCERVAQPTPLHPTAAAAASTYGTVPRTQGTTTPTTAVMPSSPMAMQYVSMFQNPWAQFCVHSDKGNKCLTSKWRTLCSYTEECSPRSEVFQARRSHSRVHNHSSRKVKAKQSPLSEDKTLANNLQNVEYRCDANI

SEQ ID NO: 1189 - protein, 271 aa, Nicotiana attenuata
LAQSPLFMIPPGLSPSELLNSPGFLSPLQSPFGMSHQQALAHVTAQAAFSNSNMQMQAEDQCSSQVASAEAFGHELTTELKEASLQLKEPSQTRMDSEPSDKQGKKFELLEFSQSENKPSFITVEKPACDGYNWRKYGQKKVKASECPRSYYKCTHLKCPVKKKVERSVDGHITEITYNGRHNHELPQPSKQRKDGSALNGTDCSEVRPDIQTHDWTVMNSSDGSSPSRSDQVPTQMASELLVKREHDETKNILVAVDEGHDEPNAKRTKT

SEQ ID NO: 1190 - protein, 519 aa, Zea mays
MEGRMTSLEATMKVSSSMASSISRNADPDQQTLRPNSVEQFYFPRPGQSLPGIPPFFGPPSSSLYLPNDNEAKFGNQFESNPSQNTDWDPQAIVSNLTFLEQKIKQVKDIVQSMSNRENQLAGGSSELAAKQHLVTADLTSIIIQLISTAGSLLPSMKNPLLSSNPAVRQLGNTLGSPMGLGMNANQRPSVDSKTDIPDTGKTSDYDELMNSLNPAQDERDEMIKCPNPCGGEGSEPTPMEDHDVKESDDGGEGENLPPGSYVVLQLEKEEILAPHTHFCLICGKGFKRDANLRMHMRGHGDEYKTPAALAKPTKDSGADHAPVTRYSCPFVGCKRNKEHKKFQPLKTILCVKNHYKRSHCDKSYTCSRCNTKKFSVIADLKTHEKHCGRDKWLCSCGTTFSRKDKLFGHVALFQGHTPALPMEDVKVSEASEQPQDSEPMNEMARSNMYSFPCSSSDGISNLDMKMADDVRGYFSPLNFDPCFGALDDFTRPGFDISENPFSFLPSGSCSYGQQNGDS

SEQ ID NO: 1191 - protein, 441 aa, Triticum aestivum
  misc_feature (373)..(373): Xaa can be any naturally occurring amino acid
GLVDTMDLDVKPSVLNSESSSGVHLGGHDNGHKASPLYPVQVQHAADIDNDEKSTRCVLPSTSGSKGGYLSYKGDCRTRRLLSTRMRKAARNKMCGDILFKGSKFCGKKISATRRRAQMQRMLKTKKVVECYSAQPSDEGVLTETSGTSCSRGGQDPTCASESSQRKPCASEGCNVKFIIKSFNIPELSIEVPENATVGSLKRIVMDAVTSKIEGSLSVSVLLQGKIIQDDNKTLHQAGICHGAKPDSIGFTLECEAKQDSRPSGLAPEEMDSAGPSVVNPLSKIKFEQPFISCTLGDYPYEGAAQVRSEICQAIVPYGTSNPDALAIVPVVPRSRQRDFGQRRKRRPFSVAEVELLVEAVELLGFGRWKNVXNHAFRDNEERTYVDLKDKWKNLVHTASIPPQLRRGRAIPPQDLLDRVLAAQAYWTVHHAKRDEEEGRD

SEQ ID NO: 1192 - protein, 698 aa, Solanum demissum
MSLNRTCNSSFWTKEEDKAFENALAVFSGDNDKFLKIAAAVPGKSLQEIIDHYNVLVEDINDIESGKVPLPKYERMQSSSSCRRRSLGAGVERRKGLPWTAEEHRSFLQGLAKHGKGDWRGISRNFVFSRTPTQVASHAQKYYSRLNDNNAKRRKSIHDVTSVGAANITEPSQGQKSDELTGPCGGQSQWPIADYVTEAFDTGMLSLPGSVTNCTTDAIEGPSAVNPEKFPLVAALGSELNSSFPGVDEFLQSVEDLIIVPAEGTSGVCHGVDTRTSPSLSVQPSVTGGTGMYTHPVSFPDVHEFLQEVEDLITVPAEGTSGACHGIDTRTSPSLSLQSSVAGGTRMYTHSVTVPAEGTSGVRCGIDTRTSPSLSLQPSVAGGTRMYPHPVNVLAEGTSGASHGVDTRTSPSLSLQPSVAGGSRIYPHPVNVPAEGISGVSHGVDTRTSPSLSLQPSVGGGTGMYTHPVTVRVEGTSGARRGVDTRTSPSLSLQPSVVGGIGMYTHPIIVPAEGTSGTRRGVDTRTSPSLSFQPSVGGGTGMYTHPVTVLAEGTSGVRCGVGTRTSPSLGLQPSVAGGTRMYTHAVNNVGYDLEELMTKQLVGASQEGPSINTASLPSPIADHIGLHGCTTSSSVAKNGFVSTMEAPGGGFSVDSMQTPSIPGHIGGGTYPCWEPSSKDDSIFDLEYLYTDHMFGFRK

SEQ ID NO: 1193 - protein, 208 aa, Vitis vinifera
  misc_feature (163)..(163): Xaa can be any naturally occurring amino acid
  misc_feature (171)..(171): Xaa can be any naturally occurring amino acid
  misc_feature (189)..(189): Xaa can be any naturally occurring amino acid
MILDHASLEASNLCNHKGKSPNRKLFAQDNNDEISNDGKKKKKKIVHRDVERQRRQDMATLYTSLRSLLPLEYIKGKRAISEHMNGAVNYIKHLQKKIKELGEKRNELKSLANSSSRNSSGNFVTVCPCWGGVEIVLSSGGEKEGMPLSRALETLLEEGLSVXSCISTKVXDITSIDLHGLQQQLSDQXLPHLDKLPSNTALRNIPTI

SEQ ID NO: 1194 - protein, 495 aa, Vitis thunbergii
  misc_feature (224)..(237): Xaa can be any naturally occurring amino acid
DMAEVAQKLEQLEEVIVNAQEDGLSHLASETVHYNPSDLSNWLGSMLSEFNPTPNCALDNPFLPPISPLDYTNCSTQPKQEPSIFDSPSLDYDLKAIPGKALYSHIEQPPQQPPAPPLYQRDNKRLKPTTSATANSVSSVIGGWGVPTESARPVVLVDSQETGIRLVHTLMACAEAVQQENLKLAEALVKQIGFLAVSQAGAMRKVATYFAEGLARRIYRLYPXXXXXXXXXXXXXXHFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLAL

SEQ ID NO: 1195 - protein, 421 aa, Glycine max
  misc_feature (381)..(381): Xaa can be any naturally occurring amino acid
FVHINKELKLEVILIEQQQINMSDEYERSEHADDDSSMGSSQKCSSFDLNEEASSKDNNDNDDKGFEEAREEGTSTNKSSSMTKEGSNERRGGVRQYVRSKMPRLRWTPELHLSFVHAVERLGGQERATPKLVLQLMNVRGLSIAHVKSHLQMYRSKKLDEAGQVLGQTYKSTHELGRISHVAHQSMNPRQHFKMGNGGIILASDYNDHSYFHGLMHPCSLSHSHTKAIDSRRQQWYFNNHQPFRRPSYFSNEVVSSTALQTQGRSLSSNQINLMDATSIAPMRPSQFLEEKKWPPLDIMNNHHWKKRLPANITSNAVSQPIVHEFGTTAASLLRPSELNFGNNTRIKEHLSNSDEHRNYSNSFKLEFEPPFRIKSNQEKXKEKQWAPDLRLSLSQRDGNNDGKTDHCRETQEINTKLSLS

SEQ ID NO: 1196 - protein, 502 aa, Leea indica
  misc_feature (229)..(244): Xaa can be any naturally occurring amino acid
SDMAEVAQKLEQLEEVIVNAQEDGLSHLASETVHYNPSDLSNWLESMLSEFNPNPNCPLDNPFLPPISQSSTISSLDYANCSTQPKQEPPLFDSPSSDYDLKAIPGKALYSHIEQPPQPPPPPLYQRESKRLKPTTSATPSSVSSVAGGWGVATTDSPRPVVLVDSQETGIRLVHTLMACAEAVQQENLKLAEALVKQIGFLAVSQVGAMRKVATYFAEGLARRIYRLXXXXXXXXXXXXXXXXHFYETCPYLKFAHFTANQAILEAFEGKKRVHVIDFSMKQGMQWPALMQALALRPGGPPSFRLTGIGPPSTDNTDHLQEVGWKLAQLAETMHVEFEYRGFVANSLADLDASMLELRDGESVAVNSVFELHGLLARPGGIEKVLSAVKDMKPEIVTIVEQEANHNGPVFLDRFTESLHYYSTLFDSLEGCGMSPVDSQDKLMSEVYLGRQICNVVACEGAERVERHETLAQWRARLGSAGFEAVHLGSNAFKQASMLLAL

SEQ ID NO: 1197 - protein, 327 aa, Oryza sativa
  misc_feature (224)..(224): Xaa can be any naturally occurring amino acid
  misc_feature (263)..(263): Xaa can be any naturally occurring amino acid
  misc_feature (276)..(276): Xaa can be any naturally occurring amino acid
MDPRFPPPAPSGGAPPRGHHRRAHSETFIRLPDADLLLDPDGEFGFSDLDFPSLSDDSPAASDPTPPPPPPALPQAAPRPPGGAHLRSLSLDAAFFDGLAFQGGGGGGGAGSGSSGGGAGHKRSGSMDGESSLFEGESAPPDYAKKAMPADRLAELALLDPKRAKRILANRQSAARSKERKIKYTGELERKVQTLQTEATTLSTQLTLLQRDTSGLTAENRELXLRLQSMEEQAKLRDALNDALPEEVHRLKIAAGPVPNMNXNSFNERIQQQQPXTKCPTYFSQQQQMHYLSGHQGRHHHPNNPHNSLNGGQSMSGQTLNDSMDFM

SEQ ID NO: 1198 - protein, 526 aa, Arabidopsis thaliana
MEATQKHMIQEGSSMFYHQPSSVKQMDLSVQTFDSYCTLESSSGTKSHPCLNNKNNSSSTTSFSSNESPISQANNNNLSRFNNHSPEENNNSPLSGSSATNTNETELSLMLKDLETAMMEPDVDNSYNNQGGFGQQHGVVSSAMYRSMEMISRGDLKGVLYECAKAVENYDLEMTDWLISQLQQMVSVSGEPVQRLGAYMLEGLVARLASSGSSIYKALRCKDPTGPELLTYMHILYEACPYFKFGYESANGAIAEAVKNESFVHIIDFQISQGGQWVSLIRALGARPGGPPNVRITGIDDPRSSFARQGGLELVGQRLGKLAEMCGVPFEFHGAALCCTEVEIEKLGVRNGEALAVNFPLVLHHMPDESVTVENHRDRLLRLVKHLSPNVVTLVEQEANTNTAPFLPRFVETMNHYLAVFESIDVKLARDHKERINVEQHCLAREVVNLIACEGVEREERHEPLGKWRSRFHMAGFKPYPLSSYVNATIEGLLESYSEKYTLEERDGALYLGWKNQPLITSCAWR

SEQ ID NO: 1199 - protein, 334 aa, Arabidopsis thaliana
MSSLPWKRPKSSRILRFISEFQQSPFVETGFPTSLIDLFFKNRDRLKKSPSKRFQRIERQIRTAPNASSLSNQDTIFEKPSRIKTVRSKVEKVNCVKGKSAALKKNAIKNSVFGGSGEVVLMAFKVLIVALLALSTKKKLTLGITLSAFALLLTELVAARVFTRSNNTDKDKNAIAREKIETFDETRVPKAIPCPEETEHVVSETEVSKLKGLTIRDLLSKDEKSTSKSWRLKSKIVKKLRSYNKKDKKTMKIKEESLIEVSSLVLEDKPKKIESERDEEETLNPPVVGSNLNGIVLIVIVLTGLLCGKVLAIVLTLSCLVLRLGAVKKVNLCI

SEQ ID NO: 1200 - protein, 156 aa, Glycine max
MIKIESCAKGDLNIVSSLEDTSTNNNMSKCRALVAVPAINMEALAVVPFWRKSGNPDFAQRRIRRPFSVLEVEALVQAVEKLGTGRWRDVKQRAFDHAKHRTYVDLKDKWKTLVHTARISPQQRRGEPVPQELLDRVLAAHAYWSQHQCKHQLKPL

SEQ ID NO: 1201 - protein, 268 aa, Brassica napus
MEAAMNMYNSITFQQPDSFGGGELMEALVPWLSRLSSSPPHPLPPMHHQSHNNTFSNLLSPKPLLMKQTGATGSCFAYGAPAKPTKLYRGVRQRHWGKWVAEIRLPRNRTRLWLGTFDTAEEAALAYDKAAYKLRGDFARLNFPNLRHNGSHIGGEFGEYKPLHSTVDAKLEAICQSMAEAEKQGKTTTKASKKRASKTVSSPEKVKAEDNSNSVGGSPPVTEFVESAGSSPLSDLTFADTEEPPQWNETFSLEKYPSYEIDWDSILS

SEQ ID NO: 1202 - protein, 240 aa, Arabidopsis thaliana
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 1203 - protein, 169 aa, Oryza sativa Japonica Group
MFEGSSEEDQEGSGGETELPEIDAHGVDQELKHHLLKKYSGYLSSLKQELSKKKKKGKLPKDARQQLLNWWELHYKWPYPSAYSTANTCDVCTVDSVISIKESQKVALAESTGLDLKQINNWFINQRKRHWKPSDEMQFVMMDGYHPTNAAAFYMDGHFINDGGLYRLG

SEQ ID NO: 1204 - protein, 358 aa, Oryza sativa Indica Group
MSQRRVAGPMGVMSKQQQEAMAEEMMELRRGPWTLEEDNLLMNYIACHGEGRWNLLARCSGLKRTGKSCRLRWLNYLKPDIKRGNLTPEEQLLILELHSKWGNRWSRIAQHLPGRTDNEIKNYWRTRVQKQARQLKVDANSTVFRDAVRCYWMPRLLEKMAGAATDPTPPPPPPLHHHAAMATASSSPFDFDTHLQQAEAATACVVPNNVYHHHIDPSPSTSTSAGSTAAAAAFQPLPCFSELRWDQQMQSSGELDDGAAGLFVDSASALGSLSLDGLDLGPAEYYSDSTLLDYLNSSCTGSAMMTMMTASGNAGSYNYCGGAMDGGDTWRSDELMDELFHHIDQDRSTSDRSSKNQK

SEQ ID NO: 1205 - protein, 188 aa, Brassica napus
  misc_feature (4)..(4): Xaa can be any naturally occurring amino acid
  misc_feature (14)..(14): Xaa can be any naturally occurring amino acid
  misc_feature (24)..(24): Xaa can be any naturally occurring amino acid
IIFXEWWKDKVRFXLNGPIAIAKXQESNNMVCESNEEGNNIANQLSQKLLRDLQDPTLGWLLSALMPHCDPPQRRFPFEKRVRPPWWPTGEEYWWPKDQGPAPPYKKPHDLKKSWKIGVLTSVIKHLSPICRNRNGLFASSKFHVMPMHDRNINGNQSCLVEGNQSVNLQPEAQNHQEHWHFGRTEGN

SEQ ID NO: 1206 - protein, 801 aa, Zea mays
  misc_feature (107)..(107): Xaa can be any naturally occurring amino acid
MDTPDRAAAQSAASRTEDSPVFSFLNNLSPIEPLRSSAYSTNSLQGFQSINITSISSIFTSPHDNVSKEPRLPKSPLGEICEKEVRADANAAGTNGPPEPSNAARFXACASTVTRETRTGTCTGVAGPPPTTGGPCDLALPRQFDNNGSPDHNTTPCHGVRSDLKQDKARKLLQAAQNAKNALEKRKCLFSTEVRLLDGGGGGGGEPGSDSDGVLGCEWSDLVSPTSAKLLAFDATMDEHHRGVHLAAQNAESCGYLLSKLAGDGGVSDGAYPTASAQVYYQELVMGDDQSENAAPQMDAQETISAEEIQDNIYEADVCVPLEYKVVESQQQRGIRRRCLVFEAAGGFSNSAVKRGTIEDRSVSTCSKGKSPAESQPRGLRGIGLHLNALALTPKGKMACQDPPPTASALLPSSASEKDARGELLCAGENFAHSGGELLEFPLDGCSAGGGFPVNDHHVSGQSVSPQKKRRKTDNGDDGEACKRCSCKKSKCLKLYCECFAAGVYCSEPCSCQGCMNKPIHEETVLSTRKQIEFRNPLAFAPKVIRMSDAGLETGEDPNNTPASARHKRGCNCKKSSCLKKYCECYQGGVGCSSNCRCESCKNAFGRRDAETELPEEMKQEESDQTENPQQEKENDQQKANVQGEDHPLLDLVPITPPFDFCSSLLKLPNFSSAKPPRPTKARSVTSRSSASKATAAVQPCRSSKLAASASASGIDEETPDILHEPDSLSNCVKTTTSPNGKRVSPPHNALGSSPNRKGGRKLILKSIPLFPSLTGDTNSGSAMNSTDSAFCASPLTLGPS

SEQ ID NO: 1207 - protein, 217 aa, Brassica napus
  misc_feature (90)..(90): Xaa can be any naturally occurring amino acid
VAQRLDPTTCARTSRPRSVPLRSNLKPQREYTEVKRHQNTQSTRERTPLNSYLRIFDHKKGTDLGWPPVRSFRKNTLATTCNNSDEVDGXPGSAAFFVKVSMDGAPYLRKVDLKSYTNYGELSSALEKMFTTFTLGQCGSNGAAGKDMLRETKLKDFLNGKDYVLTYEDKDGDWMLVGDVPWEMFIDVCKKLKIMKGADAIGLTSAPRGMEKSKMRA

SEQ ID NO: 1208 - protein, 292 aa, Oryza sativa Japonica Group
QKWTAEEESALKAGIAKHGAGKWRTILKDPDFSNVLRYRSNVDLKDKWRNMNVTVNASGARDRVKAPVVKKPRSAPKHEGHSTSTAIAAVTSDGDDDVAEPVPLATSTSSKRSLSRLDNIIVEAVRSLNEPTGSYKTAIANYIEEQYWPPADFDHVLSSKLNDLTASGKLIKVNRKYRIAPSSSLSEGRSSKVVLLEDIKKEPTKLDREDVAVLTKSQIDAELARMRTMTAEEAAAAAARAVAEAEAIMAEAEAAVREAEAAEADAVAAQAFAEAAMATFKNRSSAKLIIRA

SEQ ID NO: 1209 - protein, 342 aa, Brassica napus
  misc_feature (115)..(115): Xaa can be any naturally occurring amino acid
  misc_feature (296)..(296): Xaa can be any naturally occurring amino acid
MEVSSVDESTTSTGSICETPAMTSAKSSVNLHRMGSGSSVVLDSENGVEAESRKLPSSKYKGVFPQPNGRWGAQIYEKHQRVWLGTFNEEDEAARSYDVAVYRFRGRDAVTNFKXDARLDDGEVEFLSSHSKSGIVDMLRKHTYSEELEQSKRRRNGNGNAVRSTTQNDGVSTTEFRSAVSLFEKTVTPSDVGKLNRLVIPKHHAEKYFPLPPSSNVSVKGVLLNFEDVAGKVWRFRYSYWNSSQSYVLTKGWSRFVKEKNLRAGDVVSFSRSDGQDQQLYIGWKSRSGIGCGNGXRVLRLFGVNVSPAGSRNDVVGNKRVVNDTEMLSLVCSKKQRIFHAL

SEQ ID NO: 1210 - protein, 300 aa, Arabidopsis thaliana
MATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 1211 - protein, 239 aa, Triticum aestivum
MAVEAVLEAATMIPSPPSKEMEASSSTSEEASALLGQAEGWSKRKRSRRQRALDPSEEEYLALCLLMLAHGHRDSAPAAAPEQQHGCSVCGKVFASYQALGGHKASHRKPTAAPAGAEDQKPLAAVAAASSSGSGEAAVSAGGGKVHECNVCRKTFPTGQALGGHKRCHYDGTIGSAAAGPTQKLAAKAAAASATAASQGFDLNLPALPDIPERCAVTEDGEEVLSPASFKKPRLMLAA

SEQ ID NO: 1212 - protein, 547 aa, Arabidopsis thaliana
MVSHKVLEFGDDGYKLPAQARAPRSLRKKRIYEKKIPGDDKMCAIDLLATVAGSLLLESKSPVNACLVVQNTVKNEYPADENPVKAVPYSESPSLFDNGKCGFSSVITNPNHLLVGDKVGKEVEGFSSLGVSGDVKPDVVASIGSNSSTEVGACGNGSPNESRDDVNLFSRNDDDENFSGYIRTRMTRPVPRIGDRRIRKILASRHWKGDAKPWYCSKRSYYLHHHQRSYPIKKRKYFDSVYDSNSDDYRLQGKTHKGSRTISSMKSRNASFVSRDHHVKLRIKSFRVPELFVEIPETATVGSLKRMVMEAVTTILGDGLRVGLMVQGKKVRDDGKTLLQTGISEENNHLDSLGFSLEPSLETTPQPLLSSYLSDHACDDVTLCHDNALDSSHEPEPSPADSFGKLGTSDHSRALIPVASAAMLAPRPPNRKFKRTEQQLAAQRRIRRPFSVTEVEALVQAVEKLGTGRWRDVKVRAFEDADHRTYVDLKDKWKTLVHTARISPQQRRGEPVPQELLDRVLKAHAYWSQHLMHQLQTEPPSTQVEAL

SEQ ID NO: 1213 - protein, 161 aa, Brassica napus
  misc_feature (86)..(86): Xaa can be any naturally occurring amino acid
  misc_feature (157)..(157): Xaa can be any naturally occurring amino acid
FFQFLWATYGLWWLKGDQASIVAGAINYLKELEHHLQSIEPPLKSATVPVDTGSAAAAADQINTIAASSLGQFSEFFAFPQYSSRXSSSSVAEGMAEIEVTMVESHASVKILAKKRPKQLLKLAASIQNLKLTVLHLNVTTCDDSVLYSISLKVEEXSQLN

SEQ ID NO: 1214 - protein, 323 aa, Arabidopsis thaliana
MQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDSGSSSSSSQIASDFGQNPSTLSPSSLKIVSFDQNSYSSLEPSSQVTTCFDQNPVFSVGSESSSDQSRYLVNEDSGFVDGLLCETEEENNGMRLPQETQTQPMFTEEDQSFWENLDVDDVFGLFKDDNNLEVPLQDHSSTNEDDELLIDISEYLSEEAMECPCFS

SEQ ID NO: 1215 - protein, 673 aa, Oryza sativa Indica Group
MSFPCYFPELQPAKVNPSGTSAGGLPYIQGFRAESSMLLLLQLQIHTLSSSFFSSPRVLCWVLSVLGSSYRLQASSLSAGELTDLQACCKNFIVLVFTEYFNSSGESFSWKPFSGKQGETQVKRRNKKSRSQIVQHDKDIPTIRNVKIYSSKELRKATKNFCSGHKLGQGSFGCVYLGKLRNGQKVAIKVLSSESRQGTREFLNELSVISNINHHNLVKLHGCCVDGDQKMLVYNYLENNSLAQSLFGNSHSSIQLDWKTRVKICIGVASGLKYLHEEVRPVIVHRDIKASNILLDKDLSPKISDFGLAKLFPGNMTHISTRVAGTLGYLAPEYAIRGQLTKKADVYSFGVLLLEIVSGRCHTDPRLPLQDQFLLERAWALYESGDLKSLVDSTLKGVFDTEEAQRLLKIGLLCTQDTPKIRPSMSTIVKMLKGECAIGDKIMRPGLITDVMDLKIRTVEPVQFSASPPKSPSDSNSQVSMLAVAGSTVKTRQRILLLRSMKPMLQIQRFLIRHAEPDRVPWVQEHSALPERGTERLLRGVPCRVQHSAVSWYRLHFHLDGMDIAHLICGGCRTLLMYTRNATSVRCSCCDTVNLVRPVSSIAHLNCGQCQTVLMYPYGAPSVKCAICNFITNTGPTAQSQNVTVVVENPMTVDAKGNLVSNVVVGVTTGGKK

SEQ ID NO: 1216 - protein, 162 aa, Physcomitrella patens subsp. patens
MQGSNMELPPGFRFHPTDEELVSYYLTRKIRNPDFSVRAIGEVDLNKCEPWDLPVKATFGEKEWYFFSLRDRKYPTGLRTNRATEKGYWKATGKDKDVLRSGDHSLVGMKKTLVFYRGRAPKGEKTSWIMHEYRVEMDFLNLRSLLQDEWVVCRVFYKNGGG

SEQ ID NO: 1217 - protein, 295 aa, Arabidopsis thaliana
MGAPKLKWTPEEETALKAGVLKHGTGKWRTILSDPVYSTILKSRSNVDLKDKWRNISVTALWGSRKKAKLALKRTPLSGSRQDDNATAITIVSLANGDVGGQQIDAPSPPAGSCEPPRPSTSVDKIILEAITSLKRPFGPDGKSILMYIEENFKMQPDMKRLVTSRLKYLTNVGTLVKKKHKYRISQNYMAEGEGQRSPQLLLEGNKENTPKPEENGVKNLTKSQVGGEVMIMGMTEKEAAAAAARAVAEAEFAMAEAEEAAREADKAEAEAEAAHIFAKAAMKAVKYRMHSQTR

SEQ ID NO: 1218 - protein, 161 aa, Oryza sativa Japonica Group
MEMMEAAEDEDLGIIDPRSDDKALKRHLLRKYSGYLGGLRKELSKKRKKGKLPKEARQKLLTWWELHYRWPNPSEMEKIALAESTGLEQKQINNCFINQRKRHWKPTEEMEFAVMEAYHHQSTDAAAAFYVDVDARLVGATAAAPASAVYTARPDHGVWRA

SEQ ID NO: 1219 - protein, 261 aa, Volvox carteri
MSETEAAPVVAPAAEAAPAAEAPKAKAPKAKAPKQPKAPKAPKEPKAPKEKKPKAAPTHPPYIEMVKDAITTLKERNGSSLPALKKFIENKYGKDIHDKNFAKTLSQVVKTFVKGGKLVKVKGSFKLSEALKAKAKKSTPKKAKADGEAKPKKSEAKPKKAEAVKKTKAPKEKVERPKKEKKEKVEKKKATPKAEKPKKAATPKSAGKKKATPKPKAAPKSPAKKDAKPKKATPSKKAAPKKAPAKKSTPKAKEAKSKGKK

SEQ ID NO: 1220 - protein, 241 aa, Volvox carteri
MASDAPEVKAPKAKTQKKPKTAPTHPPYIQMVTDAILSLKERDGSSLPALKKFIEAKYGKDIHDKKFPKTLSLALKTFVKNGKLVKVKNSYKLSDAQKSKAKAAAKPKAAPKKAAAPKKAAAPKKAKAPKKEGEKKAVKPKSEKKAAKPKTEKKPKAAKKPKAAKKPAAKKPAAKKPAAKKATPKKAAAPKKAAAPKKAKAATPKKAKAATPKKAKAAAKPKAAAKPKAAAKPKAKAAKKA

SEQ ID NO: 1221 - protein, 603 aa, Oryza sativa
  misc_feature (72)..(72): Xaa can be any naturally occurring amino acid
  misc_feature (301)..(301): Xaa can be any naturally occurring amino acid
  misc_feature (459)..(459): Xaa can be any naturally occurring amino acid
  misc_feature (470)..(470): Xaa can be any naturally occurring amino acid
GRPPWCSSPAGTSASAAIASPPATWTWPWRAPSAIASGQGAWRPSSVELSSSHLGWRFSVLRRHADECLPPXDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKRNYSIGMRFKMRFEGEEAPEQRFTGTIVGMGDSDPAGWPESKWRSLKVRWDEASSIPRPERVSPWQIEPAVSPPPVNPLPVPRTKRLRPNATALPGXSSAIAKEAATKVVVESEPNGTQRTFQTQENATPKSGFGNSSELESAQKSIMRPSGFDREKNNTPIQWKLGSDGWMQMSKPESYSEMLSGFQPPKDVQTPQGFCSLPEQITAGHSNFWHTVNAQYQDQQSNHNMFPSSWSFMPPNTRLGLNKQNYSMIXEAGVLSQRPGXGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 1222 - protein, 196 aa, Zea mays
MGAAGDAAAAGTRCELCGGAAAVHCAADSAFLCPRCDAKVHGANFLASRHVRRRLPRGGADSGASASSGSCLSTADSVQSRAAPPPGRGRGRRAPPRAEAVLEGWARRKGVAAGPACRRRVPLRVAMAAARWSEVSAGGGAEAAVLAVAAWWMTRAARARPPAAGAPDLEEGWAECSPEFVVRQGPHPSATTCGRR

SEQ ID NO: 1223 - protein, 215 aa, Glycine max
HICLYHTTAVVIPSQSGIGVVKQPTMEGGSKPPPPPMLERRARPQKDQALNCPRCNSTNTKFCYYNNYSLSQPRYFCKTCRRYWTEGGSLRNVPVGGGSRKNKRSTPSAPPPSSASAQAKKLPDLTTPNFPQSASQDPKIHQGQDLNLAYPPAEDYNTVSMSKLIEVPYNTELDKGGLHQNPTSSSTPTSASSHHQLSAMELLKTGIAAASSRGL

SEQ ID NO: 1224 - protein, 85 aa, Chaetium bromoides
ECQKVGAPPEVSARLTAMAQELEARQRTALGGLGAALEPELDQFMEAYHEMLVKFREELTRPLQEAMEFMRKVESQLNSLSISGR

SEQ ID NO: 1225 - protein, 85 aa, Chaetium bromoides
ECQKVGAPPEVSARLTAMAQELEARQRTALGGLGAASEPELDQFMEAYHEMLVKFREELTRPLQEAMEFMRKVESQLNSLSISGR

SEQ ID NO: 1226 - protein, 210 aa, Glycine max
MGRGGTAAAAAEVAEPGLRPVYFKEQRYRGVRKRPWGRFAAEIRDPLKKARVWLGTFDTAEEAARAYDTAARTLRGPKAKTNFPLSPPFYHPDPFSDHRHFANTGEDFHDHRRPTSSGMSSTVESFSGPRAAVPATAPVATGRRYPRTPPVIPEDCRSDCDSSSSVVDDGEGDNVASSFPREPLPFDLNALPLDDADVATDDLFCTVLCL

SEQ ID NO: 1227 - protein, 1003 aa, Nicotiana tabacum
MESDKTSTTPSDDISSLQRVQPSHGRTSGPKRRSSQWTPEEDEILRQAVQQFKGKSWKRIAECFKDRTDVQCLHRWQKVLDPELVKGSWTKEEDDKLIELVNRYGPKKWSTIAQELAGRIGKQCRERWHNHLNPAINKEPWTQEEELTLIRAHQVYGNKWAELAKVLHGRSDNAIKNHWHSSVKKKLDSYLASGLLAQFPALPNVNHQNQSVPSSSMTLQQNSEDESVHKEGTEAEDSSVKKKLDSYSASGLLGQFSALPNVNHQNQSVPSSSMTLQQNSEDESVHKEGMEAEEVPECSQGSNFAGCSQSTSDLGNTFVHIRENGGMSEESICKKDATSSTAPCCRNYSPVFQDVSCSMLKVPSELADSKFLEHNLSHDWGNSMEEDWQFNRDDIPNISPPEFIQESSGISVHCLTGNDNHDMVATANVGNVVEDPYKPNEMFVSVDGSMMVYPEEGIPQCSPSETGVNGCGQPSYSLFYQSSNYQIPEAGDMVPQNCNALNFDDFEASFHQPFSVPSQFSSEDRSSVFDIVLNQFHNPPLEGPDHMKDSSRIVPVNDIGSTTSNTVQTCLLNENSFVQEEQKDGGALCYDPPRFPSSDVPFFCCDLIQSGSDTQEEYSPFGIRQLMMTSANCLTPLRLWDSPSRDDSPDAILKSAAKTFTGTPSILKKRHRHLLSPLSEKRCEKKLESNLNQESFYNMSTNFSRPDDMFDESANEKASMEDKENLHPSSEDGRKEEGEISGANDATGMVKQHPGVLVELSSNDLFFSPDRFLIKCDRATSLSNKALGRQYARRLEAASNQVTVSSSFETSCLSVVCSPDICGKHRGSVVIATSTALENTAEDSENGFGAETLSIFGETPFKRSFESPSAWKSPWFMSSFPPSTRYDTELEFEDFALFMSPGDRSYDAIGLMKQLSEQTAPSIADAHQILGSETPETNLSKRNSKKPKADENCTLLASNATSERRTLDFNECGIPGKGKETTKFGSNNNSFSSPSSYLLKYCR

SEQ ID NO: 1228 - protein, 491 aa, Zea mays
MASSPSDLTLDYKPNGNGAAYAVTTPKPPQETLVVDGHHHHHHLTAAEQTTQKLREFLARLEEERLKIDAFKRELPLCMQLLNHAMESYRQQLEAYQMGSLQGAPARPLVLEEFMPLKNIGIDAAADKMGNPTSEKASWMESAQLWNGPAATADVAARGPQTPKESAECAHGAAGAGHGQRNGGGGGGAFLPFAKDKTASAAEGAALPELALAPADKDAADADRKPYLDAAAGSNNGGVLGSRRDAVQSGVVNVKPAPNAPEGQQAAPPQTHRKARRCWSPELHRRFVNALQILGGAQVATPKQIRELMKVDGLTNDEVKSHLQKYRLHTRRPMPAPPAPATAAPQLVVLGGIWVPPEYASQAAGQAIYGAHPATQPHYTAAAAQEYYPSPAAVHHLQHHPAAALEYPSRGPSLRVPSFLYKVSKSKRTLRPRPSGAHASINACMHWPAGPWPKWLNFLIKRGGHASTPALGTLPGPHLEGHPKRETPQGP

SEQ ID NO: 1229 - protein, 1042 aa, Nicotiana tabacum
MESDRISTPSDGTSSSLQRVRPLHGRTSGPTRRSTKGQWTTEEDEILRKAVQRFKGKNWKKIAECFKDRTDVQCLHRWQKVLNPELVKGPWSKEEDEVIVELVKKYGPKKWSTIAQHLPGRIGKQCRERWHNHLNPGINKEAWTQEEELTLIRAHQIYGNKWAELTKYLPGRTDNAIKNHWNSSVKKKLDSYLASGLLAQFPALPNVNRQNQSIPSSAKLQQSSEDDSVRKEGTEMEEASECSQGSNLAGCSQSTSDMGNKFVHTREEGKLLEDSNYRKDPSSSSAPCSEYYTPAFEDITFSMAEVPSELDESKLLEHTFSHDWAASIGKEWQFNPDDIPNISPLELMQDSSGLFMQCLTGNGNHDMVTFPQQNAVKFETTNVGSMVVGFDKPNEMFTSVEGCRMVYPEAGIPQYIPSEAGTNGADETADSLICQSSNYQISEGGNMSIENCNPLCSDVMGTSSGQPFSIPSQFSSEQSSLMFGTAANQFHNPLQGNPAQESHTSNSDGFLYPFESGTPCDNIMDDPLLEEQLDQTKDSLQLVSVNDFRTTPSNTIQTCPLVNENSSIPVEQKDGGALYYEPPRFPSLDIPFFSCDLIQSGTDAQQEYSPLGIRQLMMTSVNCLTPFRLWDSPSRDGSTDAVLRSAAKTFTSTPSILKKRHRDLVSPLSEKRCEKKLGSDFRQESFSDLSKDFSRLDVMFDEAANEKATKSSLTTDQTLELEASSEDKENINPTEDGSKEEDKVRNGLSNERQLDGGEVHYKEKGTREGTKGGANSAIGKIKQPSGVLVELNASDLFFSPDRFGAKSGRATYLSSKALGNQYARRLEAASNQGSVSSSFETSCFSVICSPRIRGKKDGSSFIITTSMQSAPAPTALDNSAETSGNGVGAETVSISGETPYKRSIESPSAWKSPWFINSLLSSPRLDNELNFEDLALFMSPGDRSYDAIGLMKQLSEQTAGAFADAQEVLGGETPESILRGRNSKNQKADENHSLLSANVMSERRTLDFSECGSPGKGKETENFCTSNNSFSSPSSYLLKGCR

SEQ ID NO: 1230 - protein, 255 aa, Glycine max
MDSKFRKNNRNSYTSEQDQDTDHDVAQENIAESPPSSTVFNIDGLVPSPTPSSKRRRAIQKRVVQIPMKETEGCRLKGESNTPPSDSWAWRKYGQKPIKGSPYPRGYYRCSSSKGCPARKQVERSCVDPTMLVVTYSSDHNHPWPPSRNHARPTKKPEPVPDPVEPEEKFADESMITTAEELGWLGEMEATSSTVLESPFMATTYHADVALIPMREEDESLFADLGELPECSVVFRQGLLAERRRYTAPWCGTTS

SEQ ID NO: 1231 - protein, 588 aa, Nicotiana tabacum
MIQVKEESQTLDFSGFASCSSFSDSSYEASTPRYSSEPGSSYRRSSGPTKRSSQAGWTEEEDNLLTEVVKRFKGRNWKKIAECMNGRTDVQCLHRWQKVLNPELVKGPWSKEEDDLIVELVEKYGCKKWSFIAKSMPGRIGKQCRERWHNHLDPTIKRDAWTEQEESVLCHYHQIYGNKWAEIARFLPGRTDNAIKNHWNSSVKKRLNLNLPSRLVLDTESEGSPNFSSDKKKIEIKKHPVQAQNAEQTIFLGKQTGLDNAAVALSTDLRIGYAYSAGNAKHKDTSLFGACISAEENVRDLIKPLGGIQFGKADVLPIGETDKPCQSNLSRTKISYPLSASSSDFPLDQLHHTSWSTSQVEAVHPTTFRSMYESPKRSRHDTVNDPNCDFLSLSLASFTEVHSQSTKKNKAYDTQSSLGLKQQGSLYYEPPQLKDMMIPLTDENLSRDDLIRQQNGHPFCSTPPSLKLTVSANGSSPESVLRNSAMSYTRTPSIIRKKNSRFPEAATHSRCTGTTSPTHIFPRASDREDTSNLKDRFSGCKSSASGKSLGRRLEYAFDMEWDASRCCTPVSAASPCALRLGGNTMLTP

SEQ ID NO: 1232 - protein, 299 aa, Arabidopsis thaliana
MGAPKQKWTPEEEAALKAGVLKHGTGKWRTILSDSEFSLILKSRSNVDLKDKWRNISVTALWGSRKKAKLALKRTPPGTKQDDNNTALTIVALTNDDERAKPTSPGGSGGGSPRTCASKRSITSLDKIIFEAITNLRELRGSDRTSIFLYIEENFKTPPNMKRHVAVRLKHLSSNGTLVKIKHKYRFSSNFIPAGARQKAPQLFLEGNNKKDPTKPEENGANSLTKFRVDGELYMIKGMTAQEAAEAAARAVAEAEFAITEAEQAAKEAERAEAEAEAAQIFAKAAMKALKFRIRNHPW

SEQ ID NO: 1233 - protein, 373 aa, Populus tremula x Populus alba
MNSTSTQFVTSGRTGIYDPMHQIGMWGENFKSNRNTSTSTMFIADNPNPSASIIIAPDSKLDDQSEGTSHGTLGASNKYDQEASKPSDKVQRRLAQNREAARKSRLRKKAYVQQLESSRTKLVQLEQELDRARQQGLYIGGGVDTSQLGFGGATNSGIPPFEMEYGHWLEEQNRHICDMKIALDAHISDAELHRLVESDMSHYSELFRIKATAAEADVFYVMSGLWKSSAERFLLWIGGFRPSELLKILLPHIEPLSEQQVMNALNLRQSCQQAEDALSQGMEKLQQTLAETVAAGQLGEASYSHHKETAMAKLKDLVRFVLQADHLRQETLQQMSRILTTRQAARGLLALGEYFQRLRYLSSLWATRPCEPA

SEQ ID NO: 1234 - protein, 202 aa, Glycine max
MSSSLIANPTADRSRDSHRTKKKKKSIKQHQQQHDAKWKTHAQQQLYSSKLHQALARVNISGDAPRRGRAVRDAADRVLAVAAKGRTRWSRAILTNRLKVKFRKPVHKRQKVVVVGPGRPKKKARFSVLRLRGKTLPAVQRKVRVLGRLVPGCRKEPLPVILEEAIDYIPALEMQVRAMQALADLLLGSSSASTSATAAPPS

SEQ ID NO: 1235 - protein, 287 aa, Solanum lycopersicum
MATEEPVIVNEVVEEQAAPETVKDEANPPAKSGKAKKETKAKKPAAPRKRSATPTHPPYFEMIKDAIVTLKERTGSSQHAITKFIEEKQKSLPSNFKKLLLTQLKKFVASEKLVKVKNSYKLPSGSKPAAAAVPAKKKPAAAKSKPAAKPKAAVKPKAKPAAKAKPAAKAKPAAKAKPAAKAKPAAKAKPAAKAKPVAKAKPKAAAAAKPKAAVKPKAAPAKTKAAVKPNLKAKTTTAKVAKTATRTTPSRKAAPKATPAKKEPVKKAPAKNVKSPAKKATPKRGRK

SEQ ID NO: 1236 - protein, 227 aa, Oryza sativa Indica Group
MAKTKQGKRDVDSYTISGTNKVVRVGDCVLMRPVDSDNQPYVARVEKMELDGRGSVRVRVRWYYRPEESKGGRRQFHGAKELFLSDHFDMQSANTIEGKCVVHSFKNYTKLDNVGPEDFFCRFEYKAATGAFTPDRVAVYCKCEMPYNPDDLMVQCDDCKDWFHPSCMSMTIEQAKKLDHFVCSDCVKENGAKRPSHAYAGSTKYEPKWIQGFSLSTGISLLLFPFL

SEQ ID NO: 1237 - protein, 332 aa, Populus tremula x Populus alba
MAEASPRTDTSTDDTDDKNQRFERGQSTAISAPDSSDKSKEKTGDQKTLRRLAQNREAARKSRLRKKAYVQQLESSRLKLTQLEQELQRARQQGIFISSSGDQTHSMSGNGALAFDAEYSRWLEEQNRHISELRAAVNSHAGDTELRTIVDNVVAHFNEVYRLKGTAAKADVFHILSGMWKTPAERCFMWIGGFRSSELLKLLVNQLEPLTEQQLMGIYNLQQSSQQAEDALSQGMEALQQSLAETLANGNPGSSGSSGNVANYMGQMAMAMGKLGTLEGFLRQADNLRQQTLEQMHRILTTRQSARALLAINDYFSRLRALSSLWLARPQE

SEQ ID NO: 1238 - protein, 147 aa, Zea mays
MEQHLFLRGGNAQGDSGLVLSTDAKPRLKWTPELHQRFVDAVNQLGGAEKATPKTVMRLMGIPGLTLYHLKSHLQKYRLSKNLQAQANASTSKNAIGCTSIADRIPGTSAATMSSTNVVPQAEKTIQIGEALQMQIEVQRQLNEQLE

SEQ ID NO: 1239 - protein, 274 aa, Zea mays
  misc_feature (44)..(44): Xaa can be any naturally occurring amino acid
RGGDAVAERQGGRGGGGGGPGRHDERLQRPRGRGGGGGAAAAGXDGQGRAKRKRSRRRRDRDGQQPKEPTTQEEYLALCLVMLATGRRDADADAAAPPQDHACSVCGKAFPSYQALGGHKASHRAKPSPSPSPAAALAPEPGAGDGDRHDEKKPAQPSSSSAGSRPAAAAHECNVCGKAFPTGQALGGHKRRHYDGTIGSAAAPARASSSSVPASAATSSLGAATSVPASAPPPPQAVAFDLNLPALPERCAGVDEDEVLSPLAFKKPRFMIPA

SEQ ID NO: 1240 - protein, 278 aa, Vicia faba
SEEPTTVAVEQPIVEEPAAVDTLPPVVNESEEPAAKPKKAPKEPKAKKAPAKPKTHPTYEEMVKEAIVALREKTGSSQHAIAKFIEEKHKNLPSNFKKILLVQLRKLVASDKLVKVKASYKIPAKSSAPKPAKKSAASKPKAKPKAKPAAKSKSKPAVKAKPAAKAKPAAKTKPAAKAKPAAKTKPAAKPVAKPAAKAKPAAKTKPAAKAKPAAKAKPAAKAKPAAKAARTSSRTTPGKAAAPKPAAKKAAPVKKTPVKAAAKAKTPVKKAAAKRGKK

SEQ ID NO: 1241 - protein, 205 aa, Brassica napus
ILQFHGSNNDELLQSTFSHFQMLGSGFGPNPNMGFGPSHEAMDGCISRTSSFQMDPVDTMGVMLKNSEENRTISSKNKRKSEVKRREEERTEKKIKVEAETESNMKGKSSMSNTEASSDTSKETSKGASEIHKLDYIHVRSRRSQATDRHSLAERARREKISKKMKYLQDIVPGCKKVTGQAGMLDEIINYVQSLQTQIEVSNEP

SEQ ID NO: 1242 - protein, 290 aa, Vicia hirsuta
SEEPTTVAVAVEQPIVEEPAAVDTLPPVVNETVDLTAAKPKKAPKEPKAKKAPAKPRTHPTYEEMVKEAILSLKEKTGSSPYAIAKFIEEKHKQLPSNFKKILLVQIKKLVAAGKLLKVKASYKLPAKSTAAKPAKKPAAAKPKAKKPAAKSKAAAKAKPAAKAKAKPAAKAKPAAKARPAAKAKPAAAVAAVKAKPAAKAKPAAKAKPAAKAKPAAKPKPAAKAKPAAKPAAKAARTSTRTTPGAKVAAPKPAAKNATPVKKAAPAKAAVKAKTVKSPAKKAAAKRGKK

SEQ ID NO: 1243 - protein, 124 aa, Gossypium herbaceum
IEKVVSSIKAMKPKIVTVVEQEANHNGPVFLDRFTEALHYYSTLFDSLEGSGVAPPSQDLAMSELYLGRQICNVVACEGMDRVERHEPLTQWRTRMETAGFSPVHLGSNAYKQASMLLALFASG

SEQ ID NO: 1244 - protein, 322 aa, Oryza sativa Indica Group
MSSTMPAQGGVRHHRTCRMYWCYQCGRAIRIISYPSTDVFCPRCFGRFLHEIDPPPRPAPPPPHFFPQPYHPHYDGHPRRWLIYGGEAPPVAAPGRAFRQPAPAVPGRAFRQPGPAPAPSPAPAPPRRRMPSPPPVARRPSTPPAIDPGNYFNGPNLNNLIEELTQNDRPGPAPAPSSAIDSLPTCPVCKEDFELGEAARQMPCKHVYHSDCIVPWLRLHNSCPVCRYQLPSSAAAGSNANSRARRGSANNGGGGGGGDGRDREQTIVRWGPFSWMWPPRGLEDPDDGWEYGRRGRPEAGDAGGRMCNDHGNFRKLVTMMDG

SEQ ID NO: 1245 - protein, 269 aa, Zea mays
MSNSDWFDQEDISRNPYWTKEENKRFESALAIYGEDVPDRWMKVAAMIPGKTVSDVIKQYRELEEDVFDIESGRIPIPGYLTSSFTFEMVDNHDFEPYRKRSNGAKGPDHERKKGVPWTEEEHRRFLMGLMKYGKGDWRNISRNLVVSKTPTQVASHAQKYFQRQLSGGKDKKRPSIHDITTLSITTPNTGFSDNQSDHVLALHQKLSSTLQKVDQNNDASAMALNSSQEGWFTSSQQYLTASNGLRFQGQNLYGNGFHGAQPPQSSVF

SEQ ID NO: 1246 - protein, 297 aa, Solanum tuberosum
MSSVYSDKSSSTPAVTGGGFGGEIMLFGVRVKVDPMRKSVSLNDLSQYEHPNANNNNNGGDNNESSKVAQDEGYASADDAVQHQSNSGRERKRGVPWTEEEHKLFLLGLQKVGKGDWRGISRNFVKTRTPTQVASHAQKYFLRRSNLNRRRRRSSLFDITTDSVSVMPIEEVENKQEIPVVAPATLPTTKTNAFPVAPTVGPIIFPVQIDKSREYPTLLRHDHGNSSMLVGPVPMFSMPNPSTAIDLNANHNSTIEPSSLSLRLSLSLDQGQASSTRHSAYNVMSSFSNGESIIRVA

SEQ ID NO: 1247 - protein, 514 aa, Petroselinum crispum
MSSSLGDLLAQPNNDDFGSNWGFENQKTKSFANQSLPFSPPPVSPSSYFSFLDSPIQNNNYTIVSSSGNGTMNAQSFKEENQNFSDFSFPAQTRPASSTSSSLIPANTNLVEDSLKRKQGGWNFEEPAKKNDFLMDNASVTSDIATLQRISPEMTMNQANMQSNAALQSNLNNYAQSSQSSQTNRDQSKLDDGYNWRKYGQKQVKGSENPRSYYKCTYLNCPTKKKVETTFDGHITEIVYKGNHNHPKPQSTKRSSSQSYQNSIGTMPESSLLENGRSEPVTTPENSSLSFGEDDLFEQGSMNKPGDDDGNEPDSKRWKGEYESNEPMSSLGSRTVREPRIVVQTTSDIDILDDGYRWRKYGQKVVKGNPNPRSYYKCTQVGCPVRKHVERASHDLRAVITTYEGKHNHDVPAPRGSGSYPAVNRPSDNTTSAPTAIRPTTNYLNPLQNPRAQPANGQAPFTLEMLQRPRSYEFSGFTNTSNTYAINQNQQASGQFSTAKDEPDVDSFFDSFLA

SEQ ID NO: 1248 - protein, 334 aa, Glycine max
MRRTVFMIPFITTTTMISNSTTHHQAFHSLRDNNNNSAPISSQNFQGFDDHNNNSSSDHHHTTFTDCLHGSMDYNTLSRVFDMSCSSSEVISSIDENPKKPSAGGDSVGVRGNQSTPNSSVSSPSNEAEAIIEEDSTKSQKDKQPKACEADGDEKPKKENKPKKKEKKPREPRFAFLTKSEIDHLEDGYRWRKYGQKAVKNSPYPRSYYRCTSQKCGVKKRVERSFQDPTIVITTYEGQHNHHCPATLRGSAASMLSSPSFFGSSYMASSLPQDFLAQLVPSYSQINDHQSPMFHQNLSHNLHPQPQQQHQFQLSHDHGLLQDLLPSFPGKHEP

SEQ ID NO: 1249 - protein, 85 aa, Panicum miliaceum
ECQKVGAPPEVSARLTAMAQELEARQRTALGGLGAATEPELDQFMEAYHEMLVKFREELTRPLQEAMEFMRRVESQLSSLSISGR

SEQ ID NO: 1250 - protein, 559 aa, Brassica napus
MESFCDNDDNNHGNTTNLLGFSLSSNMLKMGGGGGEEALYSSSSSAATSSSVPPQLVVGDNSNNYGVCYGSNSAAGGMYSQMSVMPLRSDGSLCLMEALNRSSHSNQHHHTQVSSPKMEDFFGTHHSNTSNKEAMDLSLDSLFYNTTHEPNNNTNFQEFFSFPQARNHHEEETRSYQNDPGLTHGGGSFNVGVYGEFQQSLSLSMSPGSQSSCITGTHHHQNQNNQAQNNHQISEALGVETSVGFETTTMAAAAKKKRGQEEVVVVGQKHIVHRKSIDTFGQRTSQYRGVTRHRWTGRYEAHLWDNSFKKEGHSRKGRQVYLGGYDMEEKAARAYDLAALKYWGPSTHTNFSVENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMASNTLLSGELARRNINSIVVRNNNNEENAVNAVVDGGLNKEVSSPERELSFPAIFTLPQVGQKMFGANMVGNMSSWTTNPSAELKAVSHTLPQMPVFAAWADS

SEQ ID NO: 1251 - protein, 339 aa, Oryza sativa Indica Group
MAPSKQQQQMLLKKVMAKKPKTKRLSGFGLKPSAAFSRPHVPSAAASLQPSRRVRVVFEDPDATDSDSDDDEDAGAASKKRYFELFIGKPASSTKQASPASTVAAYANIGKVGSTCYRGVRLRKWGKWAAEIRNPFTGHREWLGTFDTADAASAAYQSASRNFAEEKRRRGVASSASPASSATPTPTASSSSSTSAAPFAHPSPSSVLEATKPAPKPESPPLPEQAATPLLVEATNETAELPDDPEFYKDILRGLQLPDIDPMDFRAGLDALDISDVPAYMNGEQDVLFTEDMLLGDFAEEDDLDLDDIGDDFCEDFPEIPSGYDFGRGDMFRQVDFCV

SEQ ID NO: 1252 - protein, 141 aa, Canavalia gladiata
MPKVKADAKAADNRLKRKGAGAGRKQSKKAAKDPNKPKRPPSAFFVFMSEFREQYKKEHPTNKSVAVVGKAGGDKWKSLSDAEKAPFVARAEKKKEEYDKSILAYNRKLEGKNPSEEEKSDKSKSEVNDEDEDEEEDQDDE

SEQ ID NO: 1253 - protein, 140 aa, Picea abies
MAKSKPMKKVLDSYTIKGTDKVVKVGDCVVLRAEDAQKPPYIARVEKIEADGRGNHVKVRVRWYYRPEESIGGRRQFHGAKELFLSDHFDEQSADTIEGKCSVHTFKNYTKLDSVGSEDYFCRFEYNAATGGFTPDRVAV

SEQ ID NO: 1254 - protein, 85 aa, Panicum miliaceum
ECQKVGAPPEVSARLTAMAQELEARQRTALGGLGAATGPELDQFMEAYHEMLVKFREELTRPLQEAMEFMRRVESQLSSLSISGR

SEQ ID NO: 1255 - protein, 323 aa, Zea mays
MDPRFTLPAAIGGGAGRVHHRRAHSESFLCFSDADLLLDPDGDLSFSDLDFPSLSDDSPAASDPTPPPPLPQPAPAPRPAGGAHTRSLSLDAAFFEGLAFQGPSGSAGGGPGHKRSGSMDGATSPFEGESALSSGLPDYAKKAMPAERIAELALIDPKRAKRILANRQSAARSKERKVKYTSELEKKVQTLQTEATTLSAQLTLLQRDTTGLTAENRELKLRLQSMEEQAKLRDALNETLREEVQRLKIAAGQVGNMNGNPFNGGLQQQIPSYFVQQQQMSYFGGHQAQAQAQHHSQNHHHRSPSNGRQSPSDQSLNDSMDFV

SEQ ID NO: 1256 - protein, 542 aa, Zygosaccharomyces rouxii
MEEVHQPYDTRLICSKGREKRGIYSIFEYEYRFRQDIFESIEVNGRFRIADSGLGWKSANAGGSAANQSKQPFLLPATELSTVQWSRGCRGFELKVNTKNQGVVQLDGFAPDDFNLIKNDFHRRFNVQVEPKEHSLRGWNWGKADLARNEMVFALNGRPSFEVPYARINNTNLTSKTEVAIEFNLADENYQPAGDELVEMRLYVPGTVTNEEEDGMVKTEDDVKKEGEEVKAEGEGEVKAEGEGEGEEANGVKKEDGEDGETEDVDMVREEKTAAEAFHEELKEKADIGEVSGDSIVSFQDVFFATPRGRYDIDIYKNSIRLRGKTYEYKLQHRQIPKDRSLPKAMILPSSGLIHRTTITQGQTTTLPCITFQKDERQRCIDLEDEDFEANYKDRLKREYDAKTHIVVSHVLKGLTGRRVMVPGEYKSKYDQCAVSCSYKANEGYLYPLDNAFFFLTKPTLYIPFMDVSSVNISRAGQASTSSRTFDLEVTLRGNRGSTTFANISKEEQQLLEQFLKSRNLRVKNEDKEAQERLQSALGSSR

SEQ ID NO: 1257 - protein, 298 aa, Populus trichocarpa
MGRVPCCDKDEVKKGPWTPEEDQLLVQYIQKHGLGCWRSLPKNAGLLRCGKSCRLRWTNYLRPDIKRGPFSPAEEATIVHLHGMLGNKWAYMASQLPGRTDNEIKNFWNTHLKKRLTSIGPKLQINQSSSSSEPINIKCKSPSARHMVQWESARVEAEARLSKQSLLIKPTSTAKSRPDIFLQLWKSEVGETFRITEEKYGKTCESLVSDTPPSIKNESVFLDDTVSPKPFKTTTFMDTTQEQEDTCKPNEEVMTVSDSIGSNEFADSTDTALKLLLDFPGGNDMEFIGEESEFFQLP

SEQ ID NO: 1258 - protein, 432 aa, Zea mays
MESMAQERDALDSPALSIDKRLRSDAVESPLVDDATQPKEGADGYPVKVRKPYTITKQREKWTEEEHGKFLEALKLYGRSWRQIQEHIGTKTAVQIRSHAQKFFSKVVREPGASNSIEIPPPRPKRKPLHPYPRKCADSTVTNAPMGEPKNAPVSSPSGSDQENGSPVSVLSAMQSDAFGSSISNPSTGGTSPASSDDGNNVPEIVNGEENLLTQQIEDRSHQESKQDNSDGELSEEDSSRVQETSLKLFGKTVIIPDPKKVCSSDGGAGDDTQEVMQTSWVGGGVAAYPAHNGWFLPFHSFPAHMYESGDARISPLHMWWPYYGFPAGHPRGFGTGLLNEGAIESDADNSPSVETNSDRTGNVHVQTTTPTIHNNAVKESVGPVEMPESGPSIELKPSANSAFVRVKPSSSVSGDQSLVRGFVPYKRCKVE

SEQ ID NO: 1259 - protein, 489 aa, Triticum aestivum
  misc_feature (225)..(225): Xaa can be any naturally occurring amino acid
  misc_feature (239)..(239): Xaa can be any naturally occurring amino acid
  misc_feature (250)..(250): Xaa can be any naturally occurring amino acid
  misc_feature (258)..(258): Xaa can be any naturally occurring amino acid
MALSTLLLPSSSSTAADTSDRRRGQQPQNHHSKRKKKPPALPPPLSPAPRTPGRRHLAATGTPSRKSPALAAPTAGAKARLVASKDHRQRRSGSKKATAQKPARPASSWEQLKSLLSCRSATAAARVHDPAALARGPGAGGYWGTSLCSMRDVATVDGASSAASVVVDHRDTAPLNRSSRRAHHSSSSAAGGGGHPSSLRGLSGCYECRAINVEPVSRRYPRPRXELCPCSQCGEGVHXRADSLEQHQAXRHAVSELXGPEDSGRNIVEIIFKSSWQKRDRPICHIDRILKVRNPPRTVARFEAYRDAVRARCRADVSAGGGGATRAAADGNELLRFHPAALACELGADGSTSLCASCDDGDADGKTAAAACGVCAAIRHGFAPWAGAHPLGVRTTASSGRAHDVCGAEAVGAPGWRAMLVCRVIAGQVRRRDGDEDGEEKEVEAGPFDSVAGDDAGGAYGVLEELFVANPRAILPCFVVVYRVDVDAQ

SEQ ID NO: 1260 - protein, 424 aa, Oryza sativa Japonica Group
MAAAGNSFLNQELVKVADGVSDWHLPSSSHGGTCHTNTRGAPITVGVPDLGCPVSSIGMATSSSLMPKEGLTTASYNSVVAFPVGATMVPQQQQTQAAGSNDNPGLVKGGWTREEDEVLRQMVRHHGDRKWAEIAKSLPGRVGKQCRERWTNHLHPDIKKDIWTEEEDRMLIEAHQTYGNSWSAIAKQLPGRSENTIKNHWNATKRSLNSKRRLRKKNSEQTVPGQPSLLENYIRSCQHMLPNETVPPPPAPPAPFDISRYGNSGVIDASPTLPVVQEPGTSTPPGLVMFLDLLNQAIPHPPQPETMDLFNMTPEVSHLNTSGYCLQLDAGGNLYYGRLPVPAPVQPHGISTQELQDTPHLSLYYPLSSFAGSHTDGTVEFDHQLSNPDGGTMVRRQAQVASPLVAAPMAWMTMTSSKWRPTSL

SEQ ID NO: 1261 - protein, 163 aa, Zea mays
MDSSVEKQGSVALDPDERAPASGETKACTECHTTKTPLWRGGPCGPMSLCNACGIRYRKKRREAMGLESSSKAATAGGSEHQQQQRKKKATAAAAAASSKRERERERERNKEADEVTVELRAVGFGKEVVLKQRRRMRRRRRLGEEERAAILLMALSSGVVYA

SEQ ID NO: 1262 - protein, 862 aa, Vitis vinifera
MASSEVSIKGNCGHGRGESFTSGYSEPNDGGVSRSVAEGQKGHSSVSGAGKDFETALYTELWHACAGPLVTVPRERERVFYFPQGHIEQVEASTNQVSDQQMPVYDLPSKILCRVINVQLKAEPDTDEVFAQVTLLPEPNQDETAQEKEPLPPPPPRFHVHSFCKTLTASDTSTHGGFSVLRRHADECLPQLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAKSTGTMFTVYYKPRTSPAEFIVPFDQYMESVKNNYSIGMRFKMRFEGEEAPEQRFTGTIVGIEDADPKRWRDSKWRCLKVRWDETSTIPRPDRVSPWKIEPAVTPPALNPLPVPRPKRPRSNMVPSSPDSSVLTREGSSKVTVDPSPASGFSRVLQGQEFSTLRGTFAESNESDTAEKSVVWPPLLDDEKIDVVSTSRRFGSDNWMHLVRHEPTCTDLLSGFGARTDSSHGFSSFVDQNDVAANTMKKHLEHESKFNLLAGPWSMMPSGLSLNLLESSIKVPVQGSDMPYQTRGDARFGGFSEYPTLHGHRVELQQGNWLMPPPAQSHFENFAHSRELMPKPILVQKQEAVKPKDGNCKLFGIPLIGNPVISEPAMSYRSMTNEPAGHLHLAPSAFDSDQKSEQSKGAKSTDNPLAVSEQEKPCQTSLPLSRDVQGKVQSVSTRSCTKVHKQGIALGRSVDLTKFNNYDELIAELDQLFEFGGELMAPKKNWLIVYTDDEGDMMLVGDDPWQEFCGMVRKIYIYTREEVQRMNPGTLNSKNDDNPSVAEGMDAKEVKRQPVPLTSNLENC

SEQ ID NO: 1263 - protein, 67 aa, Physcomitrella patens
GSATDPQSVYARHRREKINERLKSLQNLVPNGAKVDIVTMLDEAIHYVKFLQNQVELLKSDELWIYA

SEQ ID NO: 1264 - protein, 1013 aa, Oryza sativa Indica Group
MGAPKQKWTAEEESALKAGIAKHGAGKWRTILKDPDFSNVLRYRSNVDLKDKWRNMNVTVNASGARDRVKAPVVKKPRSAPKHEGHSTSTAIAAVTSDGDDDVAEPVPLATSTSSKRSLSRLDNIIVEAVRSLNEPTGSYKTAIANYIEEQYWPPADFDHVLSSKLNDLTASGKLIKVNRKYRIAPSSSLSEGRSSKVVLLEDIKKEPTKLDREDVAVLTKSQIDAELARMRTMTAEEAAAAAARAVAEAEAIMTEAEAAVREAEAAEADAVAAQAFAEAAMATFKNRSSAKLVIALSTSVLVSNDHSSLKLPVGAGAASVSSDLVFVGGELRKKNTFLWGFGRIEMEGTAQQGFPAMFLLRLGRCLSTFTSYSRNFDESYSYSHSYWLILKRGKNAFISDFFPLYLFPLLSKSAILGRLIEENSDSDECVIKLSDIPGGAKSFELVARFCYGLKIELSSENVVYLRCAAEHLEMTEETSGDNLINQTESFFNQVVLRSWKDSLEVLRTCDGLLPHAEDLHIVKRCIESLAGKASIDPDLFGWPVSEHSTMQSPGGSVLWNGISTGAKVRNCSSDWWYDDASSLSFPTYKRLISSMESRGIKQEIIAGSLTYYAKKFLPGLNRRQSTGPMPLPAATLSDEEQRRLLEEIDRMLPLQRGLISTNVLLWLLRTAMILKVDRACISNLEKRVGMQLDEATLEDLLLPNFSYTMDTLYNVECVHRILDHFLAMDQTMGGGGASPCLDDVMASPSLAPITAVAKLIDGYLAEIAPDINLKPLKFQSLAAVLPEYARPLDDGLYRAIDVYLKSHPTLPEAEREQLCRLIDCQKLSLEACTHAAQNERLPLRVVVQVLFFEQLQLRTSVAGCLLVSDNLEASSRTLRGGGAVAASGEAGCWATAAVRENQALRVGMDSMRLRLMELERECSDMRQDIRKLGRGRRRLRGGGGIVAGGKDGGGWAARVQRMLTPRMMKLQMCSAQHDAAEQQRMNNEHKKVEKVAKNKKQLSMDDGDDEEA

SEQ ID NO: 1265 - protein, 371 aa, Solanum tuberosum
MENVHHHHDHDNIGNSIQRPNFPLQLLEKRDQDHTTTICSSQLHPYNSTSLHMMTTSSSDAPCVDHNQKSKNQDKKQQAKKPTTTKDRHTKVDGRGRRIRMPATCAARVFQLTRELGHKSDGETIEWLLQQAEPAVIAATGTGTIPANYSSLNISLRSSRHHSASNYLAHNNINNFGHVYHDRNYFNGVGLFSSENNSFFPSGNLNMLQAKEELCDDDDDDDNNNNTGRIKRRSEDQDLLQNNYHMSNMLQSSTYGSIPASHQIGHIPATTLYMMTNNNNSSHHDPNNCSMWGSSSNNNNIENSNIRGGLLNFMNFHQPILGTRGGGGGGMVAEGQWGMLTAAMNSYRQSGGHASGSSNQHNGGDDHQHHS

SEQ ID NO: 1266 - protein, 340 aa, Zea mays
MCGGAILAELIPPTRRVASKPVTEGHLWSASSKKAGSGRDKRHQHEYADDDFEAAFEDFDDDFDVHEDDEDGHFVFSSKSALSPALHDGRAASQKKQRGRQFRGIRQRPWGKWAAEIRDPHKGTRVWLGTFSTAEDAARAYDVEARRLRGSKAKVNFPAASGRARGRARPRRGDDGNPRTAPETQHPAQPALLPRGERETQRKEGIAAVKPEATESFDVGGGLFFDMAFPTFPASPPPQAVDTSFAGSTATSETGSPAKRPRCDEDSSEGGSGSALELADELAFDPFVLLQMPYSGGYDDDSLDGLFAADEAVQQDVGNGMDGVRLWSFDEFPAVDGSVF

SEQ ID NO: 1267 - protein, 583 aa, Oryza sativa Indica Group
MVKSGQEAAPGSGGNAAAAAARQGGGGGGRGRQYKGVRMRSWGSWVSEIRAPNQKTRIWLGSYSTAEAAARAYDAALLCLKGSAADLNFPRVAAAAAANATSPLQHHSGAASFATATGGYNPAAAPTTPPCSYGDMSSCSAVSSPETANYYGADHDMVAREDDVDYAALADIDAFFQSPKCMDYSMMDPCSTFFSPAPESLAAEWEDEASHPNPRGRDSLAFALLVSFLPSAAAAAAARAMGYTKEQLLARLQELNIEFSCYDHPVVLTVEEQAKHVGHLGGALSKNLLLKDKKHRLYVVSALAGTKVDMKILSQRLGLGKGGLRMAPEENLLEVLQVPLGCVTPFALLNESASFFHGYAIAFLTDSYNCVFASSAVSLLLDQGFKSKQSCYFHPLTNDVTIALSSSNLDKFLMSIGRQPAYVDLEASPVVGKDNPPDLADLVPSGVPNSAEPIEKVTPTNVPRQNDVPKEKTCLPEVKAKPKVQNKGAEKTQSKIPTNGANVEKFVNDVFDIMSPLFLSEVSKKLNVKQEELSSIFDGFKEQATIDLESVTTSLKNAAYTAGFEAGFETMLNSGLKGQASRK

SEQ ID NO: 1268 - protein, 124 aa, Gossypioides kirkii
IEKVVSSIKAMKPKIVTVVEQEANHNGPVFLDRFTEALHYYSTLFDSLEGSGVAPPSQDLAMSELYLGRQICNVVACEGMDRVERHEPLTQWRTRMETAGFSPVHLGSNAYKQASMLLALFAGG

SEQ ID NO: 1269 - protein, 652 aa, Zea mays
  misc_feature (11)..(11): Xaa can be any naturally occurring amino acid
MTDGHHFNNIXLLGGRGGTNPGQFKVHSGGLAWKRQGGGKTIEIDKADVTAVTWMKVPRAYQLGVRIKAGLFYRFIGFREQDVSNLTNFIQKNMGVTPDEKQLSVSGQNWGGIDIDGLTSMFVTLASVGNMLTFMVGSKQAFEVSLPDVAQTQMQGKTDVLLELHVDDTTGANEKDSLMDLSFHVPTSNTQFVGDESRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEAVVERDLALSKELLVEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRNEYHNLFNFINGKNIKIMNLGGDGQGASGVVTDVLRDTDDDAVDPHLERIKNQAGDEESDEEDEDFVADKDDSGSPTDDSGDEESDASDSGGEKEKSSKKEASSSKPVQKRKHKARDDEGQEKKKPKKKKDPNAPKRAMTPFMYFSMAERGNMKSSNPDLPTTEIAKKLGEMWQKMSGEEKQPYIQQAQVDKKRYEKESAVYRGEATVDVDSGNESD

SEQ ID NO: 1270 - protein, 166 aa, Triticum aestivum
MSPAEMESDKVVEAAADPEERGAGDPKACDDCNTTKTPLWRGGPNGPKSLCNACGIRYRKRRRVAMGLDPEAKRKPKRDDAILSKAEASSTKEEEEEDNKASTNKIKTKTTTHTVELHMVGFAKDAVLKQQQRRRRQMRRRKPSCLGEEERAAILLMSLSSGVIYA

SEQ ID NO: 1271 - protein, 444 aa, Ostreococcus tauri
MTTSDRSRSSADAENEAPEERPTPHNAHAHEDGYRWRKYGQKNIKGSRHPRSYYRCTERGCPARKKTELASDDESDEDEGDRMRVTYEGVHTHPKPSRGRGPSMLMSMEPLCIAATPERATSGTSSGTVFGRRRGREEGQTEREKRKFHEFSIKSESLETPKKRRKESPAAKTTPRSRTTPQSKTPPRQTPSRPNRSRASGSRSRQRERRESSCSAQNAGRSSSYRAKKPMKQPVNPTLMSDMMTCFNEYVTNSEQWTANGHIGGHVAPFKSSALEYEHHRRPVVPPPPQERSLSDRLFDWLPLSPLSPTWPSWPFGDADLEAKLLRSTPARENQAVEYNHDHRPPSPSAHRRRRTYGAHPRRAPSRLVPRRVSPLALRVHHLKHSTSRDAHENHALRSLLWARAEISLVRRASSLEDARDPRPYTRTRCTPPHSARHFALFSV

SEQ ID NO: 1272 - protein, 325 aa, Capsicum annuum
GTGTALYTAFTSSRISAAQILKAYKAFITACPFKLLSNIFANKYIRKLIAGEPKIHIIDFGILYGFQWPCLIQGLSMRPGGPPELRITGIDLPQPGFKPAERVEETGRRLEKYCKRFKVPFVFKAIAKKWESITVEELEIQRDEVLIVNSLYRLGNIPDETVVQNSPRDAVLDLIRRIRPDMFIHGVLNGTFNTPYFVTRFREALFHYSSLFDMFEASLPREDEDRKLFEEEVFARDAMNVIACEGTERVERPETYKQWQLRCVRAGFKQLPLDQEIVKTVSNKVRSEYHKDFSVHEDGRWMLQGWKGRVFYALSCWKPTRLSAN

SEQ ID NO: 1273 - protein, 85 aa, Cenchrus ciliaris
ECQKVGAPPEVSARLTAMAQELEARQRTALGGLGAATEPELDQFMEAYHEMLAKFREELTRPLQEAMEFMRRVESQLNSLSISGR

SEQ ID NO: 1274 - protein, 337 aa, Arabidopsis thaliana
MANPVGFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQIMTYTLCKVKFKGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTESPNSIKLVSLAQEVSKTPGTGIDNDAQGTEIGEHKLGQETIKNKRAGFFHRMIQKFVKKIHLRT

SEQ ID NO: 1275 - protein, 411 aa, Oryza sativa Indica Group
MDMMEEEAANAATAQAAAAGDLADVVARANARAFLVSTPHHHPSPLHPLPPPPMPQAPHQYYPAPQITIPYHHHHHGELRRPTTIAYTDAPVPFETAGPPSTVVDSYHHLTPGDAGYGMPRPLALQISQHALCGGGDVVMGGGGAGAADDGEEAIRISPLTPSAHHQMMKRKNEVKKVVCIPAPPATSSRGGGGEVIPSDLWAWRKYGQKPIKGSPYPRLCRSFNIVPSEGYIYTYAQAIPKMGYYRCSSSKGCMARKQVERSRSDPNMLVITYAAEHNHPWPMQRNVLAGYARSHHSTHATASSSRHKQQQQQQTNQLQPALITSSSSSSSSPFNLYADVVLGGQQANMMMTTEGAGAGLGIQPSAADEVFAELEELEPDNPTMINANMQVYSTTSRPGVSSYDHQWHKF

SEQ ID NO: 1276 - protein, 295 aa, Triticum aestivum
  misc_feature (143)..(143): Xaa can be any naturally occurring amino acid
  misc_feature (166)..(166): Xaa can be any naturally occurring amino acid
  misc_feature (219)..(219): Xaa can be any naturally occurring amino acid
  misc_feature (258)..(258): Xaa can be any naturally occurring amino acid
MSRRKGAAAAGGGAGPMAMAAMEEEAAELRRGPWTLEEDNLLMSYIACHGEGRWNLLARCSGLKRTGKSCRLRWLNYLKPDIKRGNLTAEEQLVILELHAKWGNRWSRIAQHLPGRTDNEIKNYGRTRVQKQARQLKVDANSXVFRDAVRCYWMPRLLDKMSMAAXSTAAPPPLMEQHGQGVLSSSQSPPIGRDQLWCYGPAAGGFDPSPSASTSGSTXAAGLQPAPVPWFFELNWEDSTATRGRRPSRGAGGMDLNXAGPLGSPGLKGWDLGRKILPPGAQPRNTSIPEGAAKP

SEQ ID NO: 1277 - protein, 128 aa, Physcomitrella patens subsp. patens
VRVICTDPDATDSSSDEEDNFRPLRNSQQRLVQEIYTGLSSHGTRTAKPTVPEKSQLKSASFASTNDSKPHKYRGVRQRPWGKWAAEIRDPSKGVRLWLGTYDTAEQAAQAYDKAAREIRGPQAHTNF

SEQ ID NO: 1278 - protein, 227 aa, Triticum aestivum
  misc_feature (209)..(209): Xaa can be any naturally occurring amino acid
MQDRGMEQTEEAVSASPARLLTAAGEQQGDAATWLDLTLGVNCSQPAAAEDPSSCSDEEPAAKHKQEQPPPPPPAAAAAPTTPHKVFSCNFCMRKFFSSQALGGHQNAHKRERSAAKRSSSLSYHHAHHQRMVMAGLPLEAHAAIVRALRVNPAGSAVHKPARQEATAPRLHDGVVGPWPPLVYEEVLGSTSWPGSFRMRTQTEPPSSXEQQLLPEQTKKMDLSLRL

SEQ ID NO: 1279 - protein, 128 aa, Vitis vinifera
MIIIVCVVVQESLSEEMNEIKKCCTDCKTTKTPLWRGGPAGPKSLCNACGIRYRKRRSSMVGVNKKKERMNSGSHDLSETLKQSLMALGNEVMMQRQRSSVKKQRRKLGEEEQAAVLLMALSCGSVFA

SEQ ID NO: 1280 - protein, 121 aa, Brassica napus
  misc_feature (95)..(96): Xaa can be any naturally occurring amino acid
  misc_feature (101)..(101): Xaa can be any naturally occurring amino acid
  misc_feature (107)..(107): Xaa can be any naturally occurring amino acid
  misc_feature (115)..(115): Xaa can be any naturally occurring amino acid
  misc_feature (117)..(118): Xaa can be any naturally occurring amino acid
  misc_feature (120)..(120): Xaa can be any naturally occurring amino acid
MTSRMKKRCNENEEGVEQRKGPWTLEEDTILTNYIAHNGEGRWNVLAKSSGLKRKGKSCRLRWLNYLKPDIKRGNLTPQEQLLILELHCHGGNRXXKIAQXLPGRTXNEIKNYWXTXXSXP

SEQ ID NO: 1281 - protein, 229 aa, Misopates orontium
MAREKIQIKKIDNTTARQVTFSKRRRGLFKKAEELAVLCDADVALIIFSSTGKLFEYASSSMKEILERHNLHSKNLGKMEQPSLELQLVEDSNCARLSREVAERSQQLRRMRGEELQGLNIEELQRLERSLEVGLSRVLDKKGEKIMNEINQLQEKGQQLMQENQRLKQQVVDISNCQQITATPDSEIIHLYEEGQSSESVTYTCNSTGLPQDYDCSDTYLKLGLPYSG

SEQ ID NO: 1282 - protein, 766 aa, Ostreococcus tauri
MLREEGRLPTSTSSETRASRRATRASFGTERAGDVKSVLIVDDVALVRRIHAGHVGKLGYRTIDARDGAEALRLYGENHAGLQGILLDVMMPGMDGFQTAGGIRELEQKQALRRMPIIAVTSLTEKEMQWDDKLASFDGHVDKPTSMSTLASIFKSMSMTPDLRISENEATGAAHASLLDPHGVKRTRGANMPSSSESDADGNLDGSNEGSSEQNGRKGSNSDRDAEGQRSSGGSGNEEGQNAYVSPRSERRVRSPGPDNRSRRPANATMAGSGKNTSGGNASDEGSGDASRQGSADEDGEMKSTMDTKAETAPESNAKVKDLATGKVPSADNGDAEIKTATKTTRASAGKAVENEESPNAKAMEENTPIPCARCGSDRTRFCYYNNGLPTQPRYYCRSCQRYWTDGGILRNLPEGSGKRKDRAPLINTNLPQTSVPLAPETAPQKPTVPVTTMVSGEANANAPTEMQRAVLMLMTQVAGFDVNHAAKHAGVVASRAGEQVAQAVLQNLGHTSEAIDMAISMAKITGWRIGLSVSAVATASVSQGLNPAEISNLISTQLPFLADTLVREISEQAKTMKLMRKSPSGGSDSGGSGGTGEENGGKSATSAKSASTTATATAMGTLPSTQEALMQRWMSDLRNFGFGASQGTGMPPANETEIPVARKPFESNVQATANLRTIEKSSSSAFEVPKSASTGAFTVPMPVPRTANAPAPMNFPMNPTAWLAKMNRQASLRSQQNNSGTPPTQQHFVKTEVPRVDDKTRPERK

SEQ ID NO: 1283 - protein, 285 aa, Zea mays
MAASPSPSGSGGGKAGVDRIKGPWSPEEDEALQRLVRRHGARNWSLISRSVPGRSGKSCRLRWCNQLSPRVEHRPFTPDEDDAILRAHARFGNKWATIARLLSGRTDNAIKNHWNSTLKRERERKREYYADARPGPGDQRSLKRTSSDGPPGSPSGSDLSGSSHQSLPTVMPSAASTAVTSQQQLQHVYYRPVPRAGGVVLLPVAPPSPQAPPATSLSLSLSLPGLDQQPEPSPPPPPTPQAQPSSAFSAEFLLMMQEMIRIEVRNYMSGSGFDAHAVMGMAEID

SEQ ID NO: 1284 - protein, 120 aa, Physcomitrella patens subsp. patens
MGRAPSSSRVTTGEGLNKGPWTAEEDSILTAFVRANGEGNWRILPKRAGLKRCRKSCRLRWMNYLRPDLKRGNFSPDEDELIIKLHSLLGNKWSLIAGRIPGRTDNEIKNYWNSRLKRNL

SEQ ID NO: 1285 - protein, 286 aa, Zea mays
MGAPKQRWTSEEEAALRAGVARHGVGNWRMILNDPELSSTLRYRSNVDLKDKWRNMNVIVTSSSTRDRGRTSTRRTRAAPKNNDQLLAMSTITSEVDDEIVDVKPIVSMSVEGWNTSNSKKSHSRLDNIIMEAIKNLNEPTGSHRTTIANYIEEQYWPPSDFDHLLSAKLKYLATSGKLLKVNRKYRIAPSLLEDVQREPLKLGSDASRTLTRSQVDAELVRMATMTVEAAAAAAAHAVAEAEAIMAEAEAAAREAEAAEAEARAAQAFAEAAVLTLKNRNAAKLV

SEQ ID NO: 1286 - protein, 279 aa, Arabidopsis thaliana
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSSCSFGKDIKEMASGRCITTDRKRKRINHTDESVSLSDAIGNKSNQRSGSNRRSRAAEVHNLSERVLHRFVYIIYNI

SEQ ID NO: 1287 - protein, 155 aa, Oryza sativa Japonica Group
MASAGLPEITSPCAEDKELKSHLLNKYSGYLSSLWRELSKKKKKGKLPRDARQKLLHWWQLHYRWPYPSELEKAALAESTGLDAKQINNWFINQRKRHWKPTPPAMEYRSLQPAGAASYGGASAGASTSGGGSAVVRGMEGQHFTGGGAYPRGDP

SEQ ID NO: 1288 - protein, 337 aa, Oryza sativa Japonica Group
MSSTMPAQGGVRHHRTCRMYWCYQCGRAIRIISYPSTDVFCPRCFGRFLHEIDPPPRPAPPPPHFFPQPYHPHYDGHPRRWLIYGGEAPPVAAPGRAFRQPAPAVPGRAFRQPGPAPAPSPAPAPPCRRMPSPPPVARRPFTPPAIDPGNYFNGPNLKNLIEELTQNDRPGPAPAPSSAIDSLPTVQITGAHLSDGSQCPVCKEDFELGEAARQMPCKHVYHSDCIVPWLRLHNSCPVCRYQLLSSAAAGSNANSRARRGSANNGGGGGGGGGDGRDREQTIVRWGPFSWMWPPRGLEDPDDGWEYGRRGRPEAGDAGGRMCNDHGNFRKLVTMMDG

SEQ ID NO: 1289 - protein, 226 aa, Gossypium raimondii
MRKPCCDKQGTNKGAWSKQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVGPLNPTTTNSMDVACKLRVFSTENDDGVSDAASYLEDETPPTGISNLDLDLTIAFPSSPIKNIIEESQKKTASIVTNNKEEQYTVPTLLLFR

SEQ ID NO: 1290 - protein, 298 aa, Arabidopsis thaliana
MADDWDLHAVVRGCSAVSSSATTTVYSPGVSSHTNPIFTVGRQSNAVSFGEIRDLYTPFTQESVVSSFSCINYPEEPRKPQNQKRPLSLSASSGSVTSKPSGSNTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQQTSKSPTTTIATYSSSPVTSADEFVLPVEDHLAVGDLDGEEDLLSLSDTVVSDDFFDGLEEFAAGDSFSGNSAPASFDLSWVVNSAATTTGGI

SEQ ID NO: 1291 - protein, 209 aa, Gossypium herbaceum
KQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVGPLNPTTTNSMDVARKLRVCSTDNDDGVSDAASYLEDATPPTGISNLDLDLTIAFPSSPIKNIIEESQQKIASIVTNDEEEEYTVPTLLLFR

SEQ ID NO: 1292 - protein, 241 aa, Ostreococcus tauri
MTGEEGIREVQQTVDMSTLDFGYGDAGFMYSSLGLLGTDSVSWSFEEDKFFETNLAQYDGWPITGDDYWGQLQQQMPQKAVQELKDRYAKLKEDIREIESGFVSLPEYYDEGVDSEDYVTAEVSFAPMKTVKAQPAAPAVQAPAPAAPPAKKSKNVPKTGDQERRKGVPWTEEEHRLFLLGLNKFGKGDWRSISRNFVVTRTPTQVASHAQKYFIRLNSMSKKDNKRRSSIHDITSATGRD

SEQ ID NO: 1293 - protein, 791 aa, Oryza sativa
GDPLYDELWHACAGPLVTVPRVGDLVFYFPQGHIEQVEASMNQVADSQMRLYDLPSKLLCRVLNVELKAEQDTDEVYAQVMLMPEPEQNEMAVEKTTPTSGPVQARPPVRSFCKTLTASDTSTHGGFSVLRRHADECLPPLDMTQSPPTQELVAKDLHSMDWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSVGMRFRMRFEGEEAPEQRFTGTIIGSENLDPVWPESSWRSLKVRWDEPSTIPRPDRVSPWKIEPASSPPVNPLPLSRVKRPRPNAPPASPESPILTKEAATKVDTDPAQAQRSQNSTVLQGQEQMTLRSNLTESNDSDVTAHKPMMWSPSPNAAKAHPLTFQQRPPMDNWMQLGRRETDFKDVRSGSQSFGDSPGFFMQNFDEAPNRLTSFKNQFQDQGSARHFSDPYYYVSPQPSLTVESSTQMHTDSKELHFWNGQSTVYGNSRDRPQNFRFEQNSSSWLNQSFARPEQPRVIRPHASIAPVELEKTEGSGFKIFGFKVDTTNAPNNHLSSPMAATHEPMLQTPSSLNQLQPVQTDCIPEVSVSTAGTATENEKSGQQAQQSSKDVQSKTQVASTRSCTKVHKQGVALGRSVDLSKFSNYDELKAELDKMFEFDGELVSSNKNWQIVYTDNEGDMMLVGDDPWEEFCSIVRKIYIYTKEEVQKMNSKSNAPRKDDSSENEKGHLPMPNKSDN

SEQ ID NO: 1294 - protein, 853 aa, Oryza sativa Indica Group
MATAEVGGGGGEGDAAAAAVARAGGGGGGGGGGGEDALFTELWSACAGPLVTVPRVGEKVFYFPQGHIEQVEASTNQVGEQRMQLYNLPWKILCEVMNVELKAEPDTDEVYAQLTLLPELKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKRNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGWMQMSKPESYSEMLSGFQPPKDVQTPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 1295 - protein, 218 aa, Gossypioides kirkii
QGTNKGAWSKQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVVPLNPTTTNSMDVACKLRGCSTDNDDGVSDAASYLEDETPPTGISNLDLDLTIAFPSSPIKNIIKESQQKIASIVTNDEEEQYTAPTLLLFR

SEQ ID NO: 1296 - protein, 373 aa, Oryza sativa Japonica Group
MERCSVLGLGGGGGGGGRLDGELPPGFRFHPTDEELITYYLLRKVVDGSFNGRAIAEIDLNKCEPWELPEKAKMGEKEWYFYSLRDRKYPTGLRTNRATGAGYWKATGKDREIRSARTGALVGMKKTLVFYRGRAPKGQKTQWVMHEYRLDGTYAYHFLSSSTRDEWVIARIFTKPGVFPVVRKGRLGISGGGGDTSCFSDSTSASVGGGGGTSASSALRAPLAEASLFAAAAAPAVDGADSSNYGGGGGAGSATATANLVTGLELVPCFSTTAHMDASFGTGQYNPAPLAVEPPPPPPAFFPSLRSLQENLQLPLFLSGGMQAGVSSQPLSGGGAFHWQSGMDVKVEGAVGRAPPQMAVGPGQLDGAFAWGF

SEQ ID NO: 1297 - protein, 483 aa, Oryza sativa
MRSSSSKATPTTSPAFRVLCSPPSAKSPRPNKGEDGGGEAEASHRRGKGDAMWDLNDSPAAEAAPPPLSPSADDSGASSSSAAAVVEIPDDADDDSAAVVVVTRQFFPPAVPGGGGDPAPGNARAGWLRLAGAAPPVAATGPAASAAVSKKSRRGPRSRSSQYRGVTFYRRTGRWESHIWDCGKQVYLGGFDTAHAAARAYDRAAIKFRGVEADINFSLEDYEDDLKQMSNLTKEEFVHVLRRQSTGFPRGSSKYRGVTLHKCGRWEARMGQFLGKKYVYLGLFDTEEEAARAYDRAAIKCNGKDAVTNFDPSIYAGEFEPPAAATGDAAEHNLDLSLGSSAGSKRGNVDGGGDDEITGGGGGGAGSDQRVPMAFDLDWQTAAARSTKAKFLSNGDPGTAGGLSLTIGAGMAGHWPPQQQQGWGNAGGMSWPHPPHPPPPPTNAAAAATATAAAASSRFPPYIATQASTWLQKNGFHSLTRPT

SEQ ID NO: 1298 - protein, 142 aa, Brassica rapa subsp. pekinensis
KNLGVRPGEALAVNFAFVLHHMSDESVSTENHRDRLLRMVKSLSPKVVTLVEQESNTNTAAFFPRFKETMDYYDAMFESIDVTLPRNHKQRINVEQHCLARDVVNIIACEGADRVERHELLGKWRSRFGMAGFTPYPLSPLV

SEQ ID NO: 1299 - protein, 140 aa, Picea abies
MAKSKPMKKVLDSYTIKGTDKVVKVGDCVVLRAEDAQKPPYIARVEKIEADGRGNHVKVRVRWYYRPEESIGGRRQFDGAKELFLSDHFDEQSADTIEGKCSVHTFKNYTKLDSVGSEDYFCRFEYNAATGGFTPDRVAV

SEQ ID NO: 1300 - protein, 85 aa, Cenchrus echinatus
ECQKVGAPPEVSARLTAMAQELEARQRTALGGLGAATEPELDQFMEAYHEMLVKFREELTRPLQEAMEFMRRVESQLNSLSVSGR

SEQ ID NO: 1301 - protein, 233 aa, Dianthus caryophyllus
MGRGRVELKRIENKINRQVTFAKRRNGLLKKAYELSVLCDAEVALIVFSNRGKLYEFCSTSCMNKTLERYQRCSYGSLETSQPSKETESSYQEYLKLKAKVDVLQRSHRNLLGEDLGELSTKELEQLEHQLDKSLRQIRSIKTQHMLDQLADLQKKEEMLFESNRALKTKLEESCASFRPNWDVRQPGDGFFEPLPLPCNNNLQIGYNEATQDQMNATTSAQNVHGFAQGWML

SEQ ID NO: 1302 - protein, 404 aa, Zea mays
SPHASGEMLNRQVVKSDSATIKIPELDFEIPPEAQRGTLSTVEGIIMRAVDELQALQDERKKVDPQKAEAIDQFLLKLRSLGSGEAAFTFILDDPAGNSFIENPHAPLLDPLLSVRFYERTREQQAALGFLAEPPKEQPGEAVLPASAVESNSDGLQSVPHGSVGAVAGRRAIAQGNPDEVAAALCRYSAPEEVDTLPSTCGACGTECVTRFFATKIPYFREVIVMATTCDMCGYRNSELKPGGEIPAKGKKITLRVQNAQDLTRDVIKSDSASVKVPELELELSCGTLGGMVTTVEGLIVKICEALERIHGFQLGDSTLEWKKKKWDDFKERLSKLLSLQEAWTLIIDDGLAASFVAPATDSLEDDSQLTIEEYQRSWEQNEELGLNDMDTSSADAAYNTTNT

SEQ ID NO: 1303 - protein, 265 aa, Physcomitrella patens subsp. patens
MQDGEEMSDEEMDVDELEKRMWRDKMRLKRIKELQKDREMRSGTGHKQSQEQARRKKMSRAQDGILKYMLKMMEVCQAQGFVYGIIPEKGKPVSGASDNIRAWWKEKVRFDRNGPAAIVKYQADHALPGKPKGNVSTGPTPHTLQELQDTTLGSLLSALMQHCDPPQRRYPLEKGVPPPWWPSGDEEWWPQLGLPKGQGAPPYKKPHDLKKAWKVGVLTAVIKHMSPDIAKIRKLVRQSKCLQDKMTAKESATWLSVLNQEEGLA

SEQ ID NO: 1304 - protein, 600 aa, Vitis vinifera
MGIFEEMGFCGNLDFLSAPPGEGEVAPENEPEATVEEDYSDEEMDVDELERRMWRDRMLLRRLKEQNKGKEGVDNAKQRQSQEQARRKKMSRAQDGILKYMLKMMEVCKAQGFVYGIIPEKGKPVSGASDNLRAWWKEKVRFDRNGPAAIAKYQADHSIPGKNEDCNTMASTPHTLQELQDTTLGSLLSALMQHCDPPQRRFPLEKGIAPPWWPTGNEEWWPQLGLPKDQGPPPYKKPHDLKKAWKVSVLTAVIKHMSPDIAKIRKLVRQSKCLQDKMTAKESATWLAIINQEEALSRKLYPDSCPPVPLAGGSGSFVISDTSDYDVEGVEDEANIEVEECKPRDVNLFNLGVGARDRLMVPPLAPSIKGELVETNSDFIQKRKQPPDEPHIMMDQKMYTCEYTQCPYNNYRLAFLDRASRNNHQMNCLYRSNSSQGFGMSNFQINNEKPAAFSLPFAQPKAAAPPVNQSPAFNVSGLGLPEDGQKMISDLMSFYDTNLQRNKSLNPGNLNFQLQLDDNFFNQGVMMGGNITEETNMPLNHSVFSSSEIQFDQCKAFDSPFDTNPNDNIADFRFGSPFNLAAVDYTVDPLPKQDVSMWYL

SEQ ID NO: 1305 - protein, 231 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKLAEKQKDQRQQVQRDQTQQQTSSSSMSFMLREAAPTTNVSIFPVAAGGRVVEGAAAQPQARVGLPPWMLSHLSC

SEQ ID NO: 1306 - protein, 251 aa, Pisum sativum
MEEYTNNPNQNQNQSSRPNFLYNQIPMKQHLSSSIKRIRKLFSFRNKLHHHQHQHHHHQQQSAVENWNLIVTSQLHTPIFHYPNLMRTNIIPQTIMNHHQQGGGGSPSSSNEAESIKAKIIAHPQYSSLLQAYMDCQKIGAPPEAVARMVEARQEFEARQRSSVNSRESSKDPELDQFMEAYYDMLVKYREELTRPIQEAMDFMRRIETQLNMLCNGPLRIFPDDKNEGVGSSEEEQENSGGETDQVQEID

SEQ ID NO: 1307 - protein, 394 aa, Catharanthus roseus
MGSSEIDKSSKEAKEAKEAKETPPSSQEQPAATSAGTPDWTGFQAYSPIPPHGFLASSPQAHPYMWGVQHLMPPYGTPPHPYVAMYPHGGIYAHPSIPPGSYPFSPFAMPSPNGIAEPSVNTPGNMEVDGKASEGKEKLPIKRSRGSLGSLNMITGKNNDAGKTSGASANGACSKSAESASEGSSEGSDANSQNESQMKSGNRQDSGETSQNGSGAHGSQNGGTNTPHSMVAMVPLSASGGVTGPATNLNIGMDYWGTAASPTVPVVRGKVPSTPVGGGMVPARDPVQAQLWIQDERELKRQRRKQSNRESARRSRLRKQAECDELAQRAEALKEENNSLRAEVSLIRSEYEQLLAQNAALKERLGEASGQDDPRSSRNEQQHSVQRETAARSQ

SEQ ID NO: 1308 - protein, 453 aa, Arabidopsis thaliana
MSFTKNTSLQILTLTLILPPLTQPRGREISREIQAYAEVIALSPNSLMTTNRFICEVCNKGFKRDQNLQLHRRGHNLPWKLKQRTNKEQVKKKVYICPEKTCVHHDPARALGDLTGIKKHFSRKHGEKKWKCDKCSKKYAVMSDWKAHSKICGTKEYRCDCGTLFSRKDSFITHRAFCDALAEESARFVSVPPAPAYLNNALDVEVNHGNINQNHQQRQLNTTSSQLDQPGFNTNRNNIAFLGQTLPTNVFASSSSPSPRSASDSLQNLWHLQGQSSHQWLLNENNNNNNNILQRGISKNQEEHEMKNVISNGSLFSSEARNNTNNYNQNGGQIASMSATALLQKAAQMGSKRSSSSSSNSKTFGLMTSIFNNKQAENIKTKEVDERGFTRDFLGVGSQHRSWPLLMVNHNLPDSSPPASTDGTPTADMNQDVKYEIQVTRGWFKHGEENGEI

SEQ ID NO: 1309 - protein, 321 aa, Arabidopsis thaliana
MSYRLLSVDKDELVTSPCLKERNYLGLSDCSSVDSSTIPNVVGKSNLNFKATELRLGLPESQSPERETDFGLLSPRTPDEKLLFPLLPSKDNGSATTGHKNVVSGNKRGFADTWDEFSGVKGSVRPGGGINMMLSPKVKDVSKSIQEERSHAKGGLNNAPAAKAQVVGWPPIRSYRKNTMASSTSKNTDEVDGKPGLGVLFVKVSMDGAPYLRKVDLRTYTSYQQLSSALEKMFSCFTLGQCGLHGAQGRERMSEIKLKDLLHGSEFVLTYEDKDGDWMLVGDVPWEIFTETCQKLKIMKGSDSIGLAPGAVEKSKNKERV

SEQ ID NO: 1310 - protein, 270 aa, Zea mays
MAATPAPPSHGGGRNGTLPPPLPSNESFSKFFESWISEQSRDLEELRAAASADPPAPEAELRRLVGQVLGHYAQYYRAKAAAAADDVLCMFTPSWTSTTENLYLWCGGWRPTAAIQLLYTKSGMQLQHQLPAFLDGGGLKDDLGDLGAAQLQAADQLQRRTIRREREIEDAAASAQEALTTATMVELAGGGGRDAGAMDREMQAKAAGMRRVLEMADALRLEDDARGVNLSHATISRYGANTYIWRDKGRHVSGMEVLSYRASDHADSLA

SEQ ID NO: 1311 - protein, 251 aa, Boechera stricta
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLEANRALSMKLEDMTIGVRHHHIVGAWEGGDQQNVAYGHHQAQSQGLYQSLECDPTLQIGYGHPVCSEQMTVTTQVQTQPGNGYIPGWML

SEQ ID NO: 1312 - protein, 171 aa, Triticum aestivum
MGSSDMDKTPKEESKTPPATSQEQSSTTGMPTTNPDWYNFQTYSPIPPHGFLASSPQAHPYMWGVQHIMPPYGTPPHPYVAMYPHGGIYAHPSIPPGSYPFSPFAMASPNGIADASGNAPGSIEVGGKPPEMKEKLPIKRSKGSVSGGNLSMWITGKNNEPGKTPGESANG

SEQ ID NO: 1313 - protein, 319 aa, Oryza sativa Indica Group
MAPKRPTPPPPPPPVASSEETASGSDSDESEEEEEEEEESPLAQPAPVVSNKGAESDSSGEEESEEEEEEDLVRSSATKSRDPPQENREEDDSSDEEEDESSESEKAEAPPPPPLNPAPKQGAEGNGPKVSSPKRQAFHRIWSTEDEVRILEALAAHRREHGSLPQTDALIATLAGSLDNTGYGRKELQGKVSTLKRRYESTAKKKGDLPSKGHDRRLYDLSKSVWGSEAAAAAANGTTTAPREFGEMCELYPHLAEEVKLLEAAHPGLFKRDFGKLDDDKAHALDMKIKKQRIAEISVVLRRGDLTKEVTKVLTELVE

SEQ ID NO: 1314 - protein, 298 aa, Zea mays
MGAEAKCDRIKGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRKLATATGGGAAWEEASDSGDSPRPCKRASPGPESPTGSDRSELSHGSGQVFRPVPRPGGFDAISADVRPPPPRQDEDPITSLSLSLPGLEHGFHHDSARSHFQELSPSPRSPSPPPAPAPQPSSSYPFSGDLVAAMQEMIRAEVCKYMSGVGLPAGCGAGAVGEACIPQLVEGVMRAAAERVGVMTRQ

SEQ ID NO: 1315 - protein, 397 aa, Triticum aestivum
FAVPPGLSPTALLGPPSLFSPTANFEMSHQQALAQVTAQAVHSQYTVGSQADYSLPFSSATTSALTSQFINSSANVTSMKETATLPLHTVNDNLKSNEVSQGFQTSALTVDKPADDGYNWRKYGQKAVQGGEYPRSYYKCTQASCPVKKKVEHSAYGQITQIIYRGQHNHQRPPKRRSKDGGNLLNEDDFPENRDALTRSEPGSQDHSGKVEVSNDGITGLSMSKRRDGGDQSSGSSDREEDNDEAGDDNGDAGIVNANKRHVPVPAQRIIVQTTSEIDLLDDGYRWRKYGQKVVKGNPHPRSYYKCTYQGCGVKKHIERCSQDPTAVITTYEGKHSHDVPAARSSVAAAASANASSSISLLHRGQKAASSSQRVLPRAAVHTSDSSLQLKEENEIT

SEQ ID NO: 1316 - protein, 349 aa, Zea mays
MNNMSNRATHWCYACRRPIRLRGQDIICPNCNDGFIQEISEMGGVLNTYGLIEPDFEERQARRFGMMDAISSLMRQRLSEIGRDSLFDIHGRQGTGTEYGRRSTAIPTLVFGGIPSPAVGSSDINVVIREGRRAGAARPNFSSLVVGPSLEALFEQLLLQNNRQGPPPAPQSAIDSMPVVKINRRHLDEDPQCAVCKDKFEVGAEAREMPCKHLYHTDCIIPWLVQHNSCPVCRHPLPSQRSGSSTSSARVPSAYYNETACPPAVARADFDPVPSAYYNETATDPPAVTRADFDPAPGNYGSESQESHVPFSFLWPFGPSSSYQYEENVDEPAVYDPNQIAYSAWHYDH

SEQ ID NO: 1317 - protein, 247 aa, Momordica charantia
MGRGRVELKRIENKINRQVTFSKRRNGLLKKAYELSVLCDAEVALIIFSSRGKLYEFGSAGTTKTLERYQRCCFSPQDNHIERQTQSWFQEISKLKVKYESLCRTQRHLLGEDLGPLSVKELQNLEKQLEAALAQARQRKTQMMIDQMEALRRKERQLGDLNKELRLKLEAEGQNLKAIQSFWSSSSAAAGHGNDFPLHHSQASPIECQHEQPVLQIGYQNYFSAEGPSVRKSMTTCETNFIQGWVI

SEQ ID NO: 1318 - protein, 327 aa, Nicotiana tabacum
MMDELSKLHSAIACSSNNNHVVGVLEHITGQQQEGPINNSSVDNNLEKASLEMSDLIKAQIANHPLYPNLLSAYLQCRKVGAPQEMASILEEISKENHLISSGHNTEIGTDPELDDFMESYCAVLLKYKEELSKPFDEATTFLNNIESQLSSLCKENLTTTTTTTTSFNSNNNYLSDEAGGTSDEDLCCGEMEAADSTQESPANREGDNELKETLMRKYSGYLSSLRKEFLKKRKKGKLPKDARTALLEWWNTHYRWPYPTEEEKNRLSEITGLDPKQINNWFINQRKRHWRPSEDMKYALMEGVSSGSIAGSMYFDGAGGTGSIGT

SEQ ID NO: 1319 - protein, 85 aa, Cenchrus pilosus
ECRKVGAPPEVSARLTAMAQELEARQRTALGGLGAATEPELDQFMEAYHEMLVKFREELTRPLQEAMEFMRRVESQLNSLSISGR

SEQ ID NO: 1320 - protein, 91 aa, Brassica napus
TGFGSPYGQITWSRLPFDQLPAIGKLSSMKNFHLQQPLNVRSNYIGIPSTNIGKILVGSPITLEQWKDDGGLLSTNQEEQHKHKLDLSLKL

SEQ ID NO: 1321 - protein, 344 aa, Arabidopsis thaliana
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 1322 - protein, 209 aa, Physcomitrella patens subsp. patens
MAAPWHQEPQGKDQSQRVESFLPPGFRFHPTDEELVSYYLTKKVLDSRFAVRAIAEVDLNKCEPWDLPEKAKMGEKEWYFFSLRDRKYPTGMRTNRATDAGYWKATGKDRDVLAHGRPRLIGMKKTLVFYMGRAPKGEKTNWIMHEYRLENDGGHPLSPRANKDEWVVCRIFEKSSGGKRGFSMSESHMRQGMAYQLEDARSSLPPLMD

SEQ ID NO: 1323 - protein, 428 aa, Arabidopsis thaliana
MYEESSCFDPNSMVDNNGGFCAAETTFTVSHQFQPPLGSTTNSFDDDLKLPTMDEFSVFPSVISLPNSETQNQNISNNNHLINQMIQESNWGVSEDNSNFFMNTSHPNTTTTPIPDLLSLLHLPRCSMSLPSSDIMAGSCFTYDPLFHLNLPPQPPLIPSNDYSGYLLGIDTNTTTQRDESNVGDENNNAQFDSGIIEFSKEIRRKGRGKRKNKPFTTERERRCHLNERYEALKLLIPSPSKGDRASILQDGIDYINELRRRVSELKYLVERKRCGGRHKNNEVDDNNNNKNLDDHGNEDDDDDDENMEKKPESDVIDQCSSNNSLRCSWLQRKSKVTEVDVRIVDDEVTIKVVQKKKINCLLLVSKVLDQLQLDLHHVAGGQIGEHYSFLFNTKIYEGSTIYASAIANRVIEVVDKHYTASLPNSNY

SEQ ID NO: 1324 - protein, 85 aa, Cenchrus pilosus
  misc_feature (20)..(20): Xaa can be any naturally occurring amino acid
ECQKVGAPPEVSARLTAMAXELEARQRTALGGLGAATEPELDQFMEAYHEMLVKFREELTRPLQEAMEFMRRVESQLNSLSISGR

SEQ ID NO: 1325 - protein, 236 aa, Brassica napus
  misc_feature (183)..(184): Xaa can be any naturally occurring amino acid
  misc_feature (187)..(187): Xaa can be any naturally occurring amino acid
  misc_feature (194)..(194): Xaa can be any naturally occurring amino acid
  misc_feature (196)..(196): Xaa can be any naturally occurring amino acid
  misc_feature (203)..(203): Xaa can be any naturally occurring amino acid
  misc_feature (213)..(213): Xaa can be any naturally occurring amino acid
  misc_feature (218)..(218): Xaa can be any naturally occurring amino acid
  misc_feature (231)..(231): Xaa can be any naturally occurring amino acid
MEELNFRSKTSTSRLRLFGFSVDGEEDFFEQTVKPNQSSDSPEHNEFPAGSSGRSGGGVRSRGGGGGERKYECQYCCREFGNSQALGGHQNAHKKERQQLKRAQLQATRNAAAKYSNVGSASPLLRNPMVSAFAPRPHHLSSTVSPPGGGGSWMYLPRVSPSQLHVSHGCVVQDGAGAGTNGXXYEXGFGFNGXQXRHVQAHXPRPLVNGFSXEVGSXFDDGLGLDLHLSXAPAGH

SEQ ID NO: 1326 - protein, 300 aa, Arabidopsis thaliana; identical to SEQ ID NO: 201

SEQ ID NO: 1327 - protein, 236 aa, Gossypium hirsutum
MGRGRVELKRIENKINRQVTFAKRRNGLLKKAYELSVLCDAEVALIIFSNRGKLYEFCSSSSMIKILERYQKCNYGAPEPNVSSREAALELSSRQEYLKLKARYDALQRSQRNLLGEDLGPLSSKELESLEKQLDSSLKLIRSTRTQYMLDQLNDLQRKEHLLNEANRTLKQRLVEGYQVNSLQLNPNATEDVGYGRQQVHHQPHGDAFFHPLDCEPTLQIGYQHDPMSVVTAGPV

SEQ ID NO: 1328 - protein, 519 aa, Solanum lycopersicum
MPADPDNSSAMNDSTGSGEASVSSSGNQVVPLKESAKKKRNLPGMPDPDAEVIALSPTTLLATNRFVCEICSKGFQRDQNLQLHRRGHNLPWKLRQRSSNEVKKRVYVCPESSCVHHDPSRALGDLTGIKKHFCRKHGEKKWKCDKCSKKYAVQSDLKAHSKICGTREYKCDCGTLFSRAFCDALAQESAKTLPEKPPSTNEEPKTQAVASSSPPPSPPAPPPATESQPPPPPPAAPKSLMTPTVPPSTAVMSFASSVQNRELRENPVTNSAGAATKQVVEEAAVVASLTGNCSSSCSNGSSSSNVFGSLFASSTASGSLPSQAPVFSDIFRAMAPEHTLEMAPPSSTEPISLGLAMSHSSSIFRPAGQERRQYAPAPQPAMSATALLQKAAQMGAAATSSSFLRGIGVMSSTSSSNGHQEWSGRPSDANGASLAAGLGLGLPCDAGSGLKELMLGTPSVFGPKHPTLDLLGLGMAASVGPSPGLSALLTSMGSNLDMVTSAGSFGSADFSGKDLGRNS

SEQ ID NO: 1329 - protein, 131 aa, Brassica napus
  misc_feature (98)..(98): Xaa can be any naturally occurring amino acid
MDSISPLSNQTTTTSSGSDLSRRKCKKKSPSSPPPSLEKWRSEKQQQIYSTNLGHALRELRISQPSPNPNGRAVREVADRALAVAARGKTLWSRAILXSKAVKLKFRKHKRQRIANPALTQPVIATGSLRS

SEQ ID NO: 1330 - protein, 278 aa, Hordeum vulgare subsp. vulgare
METGGSKREGDCPGQERTKKVRRRTTGPDSVAETIKKWKEQNQKLQQENGSRKAPAKGSKKGCMAGKGGPENSNCAYRGVRQRTWGKWVAEIREPNRGNRLWLGSFPTAVEAARAYDDAARAMYGATARVNFPEHSPDANSGCTMAPSLLTSNGATAVSHPSDGKDESESPPSLVSNAPTAALHRSDAKDEFESAGTVAHKVKTEVSNDLGSTHEEHKALEVFQPKGKALHKEANVSYDYFNVEEVVDMIIVELSADVKMEAHEEYQEGDDGFSLFSY

SEQ ID NO: 1331 - protein, 810 aa, Pinus radiata
MANEKNGTFDGSKSNGHSNKIGLQRSWLRRETAIPAAQFQGSLSSQKTNGLSNNIGLQWSWLQHEAAMPAAQLQDSLSSEKMNGLSDNIGSQRSWSQQEEAVPAAQLLPAAQYQGSLSSEQTITTTDGDSDDKETYSDIVLKYISDMLMDENMEDKKCMYQECSALQATVKPFYDILGENYPPQGMCSKSKIGQNQNQLLNYTKDDVPYKIEDSSWIGEFFNSQMPTGFESPLSANLSAGYSSQYSFSSSGSSTVIDGLPDSPIYEINLSEYFSENKQDSGLGEFEEASQVVPKLNMGISAENGRVMRAPKKETDLELKVGKREDAIGVPFQMNATHSDDENGPKRQKDPHREDLDLEDRQSNKHSAVYSDNVIRTESFDEVLLCGGRNGKNFADMQVQVLQNGVQKSVQNGSVKGSQGPKTVGKKQGKKEVVDLRSLLLICAQSVAADDTRGANETLKQIRQHASAYGDGSQRLANYFADGIAARLSGSGGRLFTMISSGALSSAAEILKAYQLLLVATPFKKISHFMTYQTVLNVAEGETRLHIVDFGILYGFQWPSLIQCLANRPGGPPMLRITGIEFPQPGFRPAERIEETGRRLEDYAKSFGVPFEYQAIATKWENLDVEELGLRSDEVLVVNCLGRLRNLLDETVVQDSPRNIVLNKIRSMNPRVFIQGVVNGAYNASFFITRFREALFHYSALFDALETTVPRDNQQRFLIEKEIFGREILNVVACEGSERLERPETYKQWQGRTQRAGFVQLPLDRSILSKSRDKVKTFYHKDFGVDEDGNWMLLGWKGRTIHALSTWRPST

SEQ ID NO: 1332 - protein, 390 aa, Oryza sativa
MGSSGADAPTKTSKASAPQEQQPPASSSTATPAVYPDWANFQGYPPIPPHGFFPSPVASSPQGHPYMWGAQPMIPPYGTPPPPYVMYPPGVYAHPSMPPGAHPFTPYAMASPNGNADPTGTTTTAAAAAAGETDGKSSEGKEKSPIKRSKGSLGSLNMITGKNSTEHGKTSGASANGAISQSGESGSESSSEGSEANSQNDSHHKESGQEQDGEVRSSQNGVSRSPSQAKLNQTMAIMPMTSSGPVPAPTTNLNIGMDYWANTASSTPAIHGKATPTAAPGSMVPGEQWVQDERELRRQRRKQSNRESARRSRLRKQAECEELAQRAEVLKQENTSLRDEVNRIRKEYDELLSKNSSLKEKLEDKQHKTDEAGVDNKLQHSGDDSQKKGN

SEQ ID NO: 1333 - protein, 395 aa, Oryza sativa Indica Group
MANLLFFVQIYARIGHILLALCGLGLVKPMEEMLMGANPNPNGSSNQPPPPPSSAASAQRPIAPPAAGAAAGAGAAGAGAGTERRARPQKEKALNCPRCNSTNTKFCYYNNYSLQQPRYFCKTCRRYWTEGGSLRNVPVGGGSRKNKRSSSSVVPSAAASASTSAAVSGSVPVGLAAKNPKLMHEGAQDLNLAFPHHHGRALQPSEFTAFPSLESSSVCNPGGNLAAANGAGGRGSVGAFSAMELLRSTGCYVPLPQMAPLGMPAEYAAAGFHLGEFRMPPPPQQQQQQQAQTVLGFSLDTHGAGAGGGSGVFGACSAGLQESAAGRLLFPFEDLKPVVSAAAGDANSGGDHQYDHGKNQGGGGGVIGGHEAPGFWNSSMIGNGSSNGGGGGGSW

SEQ ID NO: 1334 - protein, 323 aa, Arabidopsis thaliana
MDLPPGFRFHPTDEELITHYLHKKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKFSAHNLPKTAKNEWVICRVFQKSAGGKKIPISSLIRIGSLGTDFNPSLLPSLTDSSPYNDKTKTEPVYVPCFSNQTDQNQGTTLNCFSSPVLNSIQADIFHRIPLYQTQSLQVSMNLQSPVLTQEHSVLHAMIENNRRQSLKTMSVSQETGVSTDMNTDISSDFEFGKRRFDSQEDPSSSTGPVDLEPFWNY

SEQ ID NO: 1335 - protein, 195 aa, Vitis vinifera
MKKVCHIPAEGLSSDMWAWRKYGQKPIKGSPYPRGYYRCSSSKGCLARKQVERNRSDPDMFIVTYTAEHNHPMPTHRNSLAGSTRQKPVTPPAAATTTASADAVKPSAKPACSSPATSADDELVQQSTSVQSKDLVEDEEDDELGFSDTAVDDDFFMGLEELAEQVTGDCFPDHFPPSFPIPWLANNAATAAGGI

SEQ ID NO: 1336 - protein, 365 aa, Arabidopsis thaliana
MESTGEAVRSTTGNDGGITVVRSDAPSDFHVAQRSESSNQSPTSVTPPPPQPSSHHTAPPPLQISTVTTTTTTAAMEGISGGLMKKKRGRPRKYGPDGTVVALSPKPISSAPAPSHLPPPSSHVIDFSASEKRSKVKPTNSFNRTKYHHQVENLGEWAPCSVGGNFTPHIITVNTGEVISSEFFFRSRHQDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSFLAGTDHQDQKPKKNKHDFMLSSPTAAIPISSAADHRTIHSVSSLPVNNNTWQTSLASDPRNKHTDINVNVT

SEQ ID NO: 1337 - protein, 325 aa, Nicotiana tabacum
MADISPSTSTDADTEDKNRFLNSQQLGAVASDGSDRTRDQKTLRRLAQNREAARKSRLRKKAYVQQLESSRMKLTQLEQELQRARQQGIFISGSGDQSQSMSGNGALAFDVEYARWLEEQNRRINELRGAVNSHAGDGELRIIVDGILAHYDDIFRIKGDAAKSDVFHILSGMWKTPAERCFLWLGGFRSSELLKLLINQLEPLTEQQLLAINNLQQSSQQAEDALSQGMEALQQSLAETLAGSLGPSSSSGNVANYMGQMAMAMGKLGTLEGFIRQADNLRQQTLQQMHRILTTRQSARALLAISDYFSRLRALSSLWLARPRE

SEQ ID NO: 1338 - protein, 246 aa, Chrysanthemum x morifolium
MGRGKVQLRRIENKINRQVTFSKRRGGLLKKAHEISVLCDAEVALIVFSNKGKLFEFSTDSCMESILERYERYSYTERQLVATDATPRSWTLEYNKLKSRADLLQRNHRHYMGEDIESLSLKEIQNLEQQLDTGLKNIRTRKNQLLHESISELQKKGKAIQEQNTTLTKKIKEKEKDKTITENVQWEQHNYVDHDTSFLMPQPPPGLNMGGNYNQSGGGAGERADGMTNELDLSLQYSCHMRCFPS

SEQ ID NO: 1339 - protein, 524 aa, Zea mays
  misc_feature (487)..(487): Xaa can be any naturally occurring amino acid
MSARPPPQPRPRLALPPRSTAESLFTGAGDTSPGPLTLASALFPSDADGGGGPGGASSSAAGAATFTQLLTGSLAPPPPQQQRHDAERGRGGGVARAGPALSVAPPASASAGASVFTVPPGLSPSGLFDSPGLLFSPAMGGFGMSHQQALAQVTAQATHSPLRMFDHLEQPSFSTAATMSGALQHMNSAASMAGISDMTMATANNENTSFQSAEASQRYQVNAPVDKPADDGYNWRKYGQKVVKGSDCPRSYYKCTHPNCPVKKKVEHAEDGQISEIIYKGKHNHQRPPNKRAKDGNSSAFDQNEQSNDTTSGLSGAKRDQDNIYGMSEQAYGLSDGDDMDDGESRPHEVDDADNESKRRNIHISSQRTLSEPKIIVQTTSEVDLLDDGYRWRKYGQKVVKGNPHPRSYYKCTFAGCNVRKHIERCSSDPKAVITTYEGKHNHEPPVGRGGNQNAGMSSQQKGQNNVSSNQASFSRPDLSNANQMPXWNLTVQERAIVTCIWMTFFWQIQDACNSYSHMASKVS

SEQ ID NO: 1340 - protein, 243 aa, Chrysanthemum x morifolium
MGRGRVQMKRIENKISRQVTFSKRRTGLLKKAHEISVLCDADVALIVFSTKGKLFEYSTHSSMESILERYERYSYAEKLLTAPENETQASWTLESSRLKAKIEVLERNIRHYGGEDLEPLSLRDLQSVEQQLDTALKRIRTKKNQLMHESISELHKKEKTLQERNNSLSKKLKENEKNSEQQNERVELPQPPPPPPQPQPYSVPSFATSRPFIGAAMREEELARAHHVSTTMMPLWMIRHLNQ

SEQ ID NO: 1341 - protein, 197 aa, Arabidopsis thaliana
MEKEGLGLEITELRLGLPGRDVAEKMMKKRAFTEMNMTSSGSNSDQCESGVVSSGGDAEKVNDSPAAKSQVVGWPPVCSYRKKNSCKEASTTKVGLGYVKVSMDGVPYLRKMDLGSSQGYDDLAFALDKLFGFRGIGVALKDGDNCEYVTIYEDKDGDWMLAGDVPWGMFLESCKRLRIMKRSDATGFGLQPRGVDE

SEQ ID NO: 1342 - protein, 212 aa, Populus trichocarpa
MFERLLRHRDLSLFLPFIFGFTSTNSTEERDPDQEPQTTDPNERIILINPLTQGMVVIEGAASLESLLRDIGNKNGQPPASKASIEAMPSVEIGEDNKDGECAICLEEWEPGAVVKEMPCKHRFHGNCVEKWLKIHGNCPVCRYKMPVDEEELGKKRDGGDGGREWRRAEREIWVSFAFNGNRRNRDSNENPSSDSTDFSTSSPSADHETES

SEQ ID NO: 1343 - protein, 411 aa, Medicago truncatula
MAQQCQLTSPFHLFLFCPLHFSTTIHSSFLNVFTLTKQQQPPPLPRPPHTTILTLHLSLTNEHNLATTTKPYTPMDSGGNSSSEESSLNGLKFGQRIYFEDTALTAASAAAASTTIAAGSPSSSGSKKGRGGSVQHSQPPRCQVEGCKLDLTDAKAYYSRHKVCSMHSKSPTVTVSGLQQRFCQQCSRFHQLAEFDQGKRSCRRRLAGHNERRRKPPPSSLLTSRFARLSSSVFGNSDRGGSFLMEFASNPKHSLRNSPGNQTTAIGWPWPGNTESPSSNLFLQGSVGGTSFPGARHPPEETYTGVTDSNCALSLLSNQTWGSQNTEPSPGLNNMLNFNGTPMTQLGTSSHGVAMHQIPNNYEVVPDLGRGHILHPLGSQHSGELDLLQQGRRHYMDVEHSRAYESSQWSL

SEQ ID NO: 1344 - protein, 300 aa, Physcomitrella patens subsp. patens
MALRSDDRAGSTTKAHQAELGVHFRGVRKRPWGRFAAEIRDPWKKTRVWLGTFDTAEEAARAYDSAARALRGTKAKTNFSPPPPSGDDHSMTSQSSTVESLSNGPMKQSSHHPSKSIHINLYRSSGGASESSSWRNRLDLNVSVAQDPLPVTDDGQLQYKSVSAGRSCVEEGVTCALSSKRAGPSPIHALFEEAGHVVESKRQRVMKKPTPITPTERLSVGRDWLGSEENTVLGMEQHASEITPETRACHSDCDSSSSVILNSEAACATPPTPHDAKPVMRRTPYPFLLDLNQPPCKDRQ

SEQ ID NO: 1345 - protein, 140 aa, Picea glauca
VEDGSGGETDFQEVDHHAVEDRELKDHLLRRYSGYLSSLKQEFMKKKKKGKLPKDARQKLLGWWSLHDKWPYPSETEKIALAECTGLDQKQINNWFINQRKRHWKPSEDMHFMVMNSHSPHSAALYVERHLMTEGYHLDC

SEQ ID NO: 1346 - protein, 802 aa, Prunus avium
MVHGLESSDVAFCGGDLHHHHMKDVNIPISDGFGGGGAMEELEDQEDNLGVDPSEMWLDDNDQETAFLADVNDPSIFYNDHFPPLPDFPCMSSSSSSSSTPAPVKPVTSSSTSSSISSSSSAASWAILRSDAEEDGERRQQQHHNSYNHRYQYSQVDDQAVDAHALSSTASMEISQPSDLGREGGAIDCMGAMETFGYTDLFESNEFFDLSSIFQSDSLLMEQFQQDDDHQQLLTPHQLQDPNEATAIIPQQQQQQEVAVRDEENNKKDDQNENKEPDDMAMVFLEWLRSNRETVSAEDLRSVKIKKSTIECAARRLGGGKEAMKQLLKLVLEWVQTNHLQKRRSNSLTTKDANIVAQQQQYHDPFQNPNPNTSPRVLEPNPSCSFTQTPWMAPPPHAAYDHAGESLSPLRPRRPPPAAYPSMMGYIAPDQYVNGPGPYQPSPEYHHMIDSGQPTWPSSPFGMGTAHYGSFPDNNIHLAPPPQHRPQAFAGYGSQYQPYQYFPGNGEHQLMRLGSSATKEARKKRMARQRRLVSHHRHGHHHQQQHLNAQMPDHLLHQQHTRLVGNAANLNCANSVPLQANPGNWFYWATATAAPSPSPAMMPSITPEAAPPPPVQQMDRPASTQAQNYNQGRSAAQERQERRQGWKSEKNLKFLLQKVLKQSDVGSLGRIVLPKKEAETHLPELEARDGISIPMEDIGTSRVWNMRYRYWPNNKSRMYLLENTGDFVRANGLQEGDFIVIYSDVKCNKYMIRGVKVRQAGPKSEGNKRPGKSQRNQHASTPAGTNGSSPSSASASATHKKQ

SEQ ID NO: 1347 - protein, 125 aa, Zea mays
MPLDPWFVSWWAGVAGKGVATGMGHGRIIKYFFRLSAQLLLSPVWLVGRYQNWTINGRGTALKSPENEEANSTAQHLVDFTEAEEDLVSRMHRLVGNRWEIIAGRIPGRTAEEVEMFWSKKYQER

SEQ ID NO: 1348 - protein, 200 aa, Triticum aestivum
MCGGAIISDFIPERDHRGGSKRSLCTADFWPNAAGAGAAFDDPTGHHDFYPADLTGARSFPPQHRAAEEEPSRKRERKTMYRGIRRRPWGKWAAEIRDPAKGARVWLGTFATPEGAARAYDRAARRIRGTKAKVNFPNEDPPLDLDDYDVANVAGFFHQPSYMADAAAPATEVAYAHQLPQQDEPGMELWNFDNINTQVI

SEQ ID NO: 1349 - protein, 169 aa, Triticum aestivum
NDRASIVGDAIEYINELNRTLKELTSLVEGDTKHRMKMLKLDDAARDNGESSSLQQVKDDQDSQLNGAIRSSWIQRRSKECHVDVRIVGNEINIKFTEKKKTNSLLCAAKVTDEFRLELIHVVGGIIGDQHIFMFNTKISEGSSVYASALASKLLRAMEMEHLAVDIFS

SEQ ID NO: 1350 - protein, 222 aa, Glycine max
  misc_feature (93)..(93): Xaa can be any naturally occurring amino acid
MRKGRGGGASAAAAAAVNGSVLKEPRYRGVRKRPWGRFAAEIRDPLKKARVWLGTFDSAEDAARAYDTAARNLRGSKAKTNFPLSPFCYQHPXTDPFFYAGFHDHQNNSNNNNDNLNNPQRPTSSGMSSTVESFSGPRPPTTTTTTTTPFLTTTRRYPRTPPLVPEDCHSDCDSSSSVVDDSDDNIVSSSFRPPLPFDLNALPFDDDAAVVDDDLRCTALCL

SEQ ID NO: 1351 - protein, 510 aa, Glycine max
  misc_feature (302)..(302): Xaa can be any naturally occurring amino acid
  misc_feature (332)..(332): Xaa can be any naturally occurring amino acid
  misc_feature (421)..(421): Xaa can be any naturally occurring amino acid
MWDLNDSPDQRKDYESEGCSSSLYDDKGKRVASVSNSSSSAVVVEDGSEEEDSERGGSRTLDNKKTNKIFGFSVAHDDSDHPPVTHQFFPVEDSELPVSAAAAGSGGGGGGSSFPRAHWVGVKFCQSETPGAGKAVKVSEPMKKSRRGPRSRSSQYRGVTFYRRTGRWESHIWDCGKQVYLGGFDTAHAAARAYDRAAIKFRGVEADINFNIEDYEEDLKQMTNLTKEEFVHVLRRQSTGFPRGSSKYRGVTLHKCGRWEARMGQFLGKKYVYLGLFDTEIEAARAYDKAAIKCNGKEACHXNFDPSIYDSELNSESSGGGSCRSPIWDLSXLGNLISKHNNSQTSGNHFANSATDQHMPPESNWRNGGSKPKVHLVNILPKPCGRSNIEAYGHGESETLRLLSQTHLQSPTNKEMHRYGXIGRQQSPQKPHNFAHHLHQPSFHVPSSSSNGGRIGSDLSLSMSDQQQWQQAGPPHLLATAAASSGFPQQIRPSQGWLQKNGFHSLMRPS

SEQ ID NO: 1352 - protein, 2135 aa, Oryza sativa Indica Group
MAPPRELDLSDEVEGEEDGTTDFVFRLAGDPIPLLPTTSSPLPLFDLQSPPSRPLAVSNRRAAVFLAHPNGFMAATTKALIEASKEAREKGKSTTRCARDCCVADIPLPGVSLLELSRDESVLAACAGSVIHFFSASSLLTDKDVEPLSSCTLEGSSTVKDFKWLNHASKAFIVLSKDGLLSQGSLGEGLKDIMENVDAVDCCKEGTHIVLSKKNTLNILSSDFKEICCMPLLFQLWSDDSDSDDASIKVDSIGWVRDDSIVVGSVRLNEEGNEEGYLVQVIRSCGNTFFENSSKSVVFTYVDFFRGIMDDVLPSGVGPNLLLGYLHRWDLMVTSNKKSIDEHISLLKWSSATDDKKTVVYLEMLEDKYSPRIDLQENGDDNVILGFGVENVSLFQKITVTVGPEQKEVAPQHILLYLTGEGKLNIYYLARISDPSELPQTKLSAIEDSNVMKEISPVTVSGKEFTPSATSSLDKSIRPDGAELSSVQPDRDLHGSTDMKNSSPVSKAKEIVASSPAPASFLAPASNLKPGISFSFSTANSVSLSPAGSNTSSELGSSWQQSSSSNFVNNQLGKGSIPSTQPVGAFGGSQNSKKDGNLSFNKSSVFTSDGSTLVKPGERNEPGFGSHPLQSSYTTDKKVPSSVGLSSKSSPSISPIKPSSAGPSSTGFRTGNLEAFPTSRGSPLPQESIDKPHDRTHAVVDHSKNFKLGAMFDTEQDLSKKFYSINDMTKELDTLLSYIEKDGGFRDACITFQERPLSMFEGDLQNFLELLQIFKNKIAEQCSRVEDLRNKMFQGTSTTRVSARQAYMKGIVDQSSDTQYWDIWNRQKLSPEFEAKRQNILKANQNLTNQLVELERHFNNLEMNKFGETGRVASSRRAIYSSKARSSQTQISSVYNALNSQLAAAEQLSDCLSKQISALNISSPSTKRGSVAKELFESIGLDHTMDAAKFSGGTPSKSVKRYPSTREHITSISGPSKTAEPETARRRRESLDRSLASLEPQKTTVKRIAQQQRLKISSDLPFRSNKKIFDSQMAAMSQEKSSSSPTSSIVESYANKLHYPSEVLHEKTKPSGPQHNTLFKWVKESAGPSQGPQHKYPELPGQLKSSDQPPKLGSSSPLSFSYSHKDVWDNISSSNVPSSGTTHTMPKSSTLTFKTTVIPKTNTSTLPDLSPLMTGSKFSLSPLTVKTLSGDSGGASSIITKNKQGGQAMPYLGTTKGLDVSPQNMGGAFRDLNKPSLSPEPPKSALLQGKTVQLGKITETVQSPVKAKPEVAFQPPAFPPTPVAQSSPCSIKPTVPSSATSSSSTMQESAAKTSDVLSPTGPSILPSKESMTKPSSPLPDGTISSSLLSIPMPVKESSTGLNKIVSKPEVVTSEVTGTTVSASTSSSVPITEGKPSSIPATSGSLPSIPVSAPKVVPVSAESAVVTSTGKDVGPSNPSSDEDDMEEEVPSASSDLNLGALGGFGLGSVPSSSPPKSNPFGNSFTTSDNKSSGSSFTLTTSPGQLFRPASLSIPSSQPAQSSQSTSSSTFSSAFSSGLSGFGQSAQIGSAQQSGFGQPSQIGAGQQAGFGQPAQIQSGFGQPAQVGVAQQSGFGQPAQIGTAQQSGFGQPAQFGAQQALGSVLGSFGQSRQLGSFGAGGFGGFASASASGGFSSNSGFAGGATGGGFSAAAAPAGGGFAAAATGGGFAALASKGGGFAAAASSGGGFGGAAQGSGFSSVALMHAPKIVLRALAVAIVELPTPGIDTISQEHFAYLSTSDIRTWVSHQDSLTNLDEIVSNHPTTSRQTFQCMTGTEQMMYHQQQVQSDSQHLSSRPGLSPEKQFLLQGGADSSSGLVLSTDAKPRLKWTSELHERFVEAVNQLGGPDKATPKTIMRLMGIPGLTLYHLKSHLQKYRLSKNLQSQANASRAQGVLGCSTTEIDKPCEGNGSPASHLDLETQTNSSSMHINEALQMQIEVQRRLHEQLEVQRHLQLRIEAQGKYLQSVLEKAQEALGTIAVAETAATANASSSKRLQNEHTQLHYHQQQQQVGDGSVDSCLTTCDCEGSHHSRSHGHRGEQDILSIGLPPFEPAAARSGKEHHYLLFPNEPSRRRSCSDERRREMSTLQASELDLSINGRSSSHSHRRENIDLNGAGWS

SEQ ID NO: 1353 - protein, 767 aa, Castanea sativa
MSPNSEDQFSNLIDEYTFNQLSPLPTTDLNFLEGPNLLSDVDLGPTSFEPSITPTDGPEGQPYDPPHVVMPPTLQADSTTSPDDNDFSETVFKYMNQILMEENIENKPCMFYDPLGLKDTEKSFYDALGQKNPPLPNQNSLESPGLSSSSGDNGTNSTSSSSTVIDALLLSDLGEHNYQPSLSPPPILGEYNAVQSNFNPTDQSQFFGNLSDDSVNHFGDGLAVMAQNIFTNSESILQFRRGLEEASKFLPKSNNLVIDLESNTVSSSEWKKGDDLMVESLVVKGEKESDSSDGSRGRKNHEREEIELEEGRSNKQTAVYVEESEETELSEMLHKVLLCTDAPPSLYGDNCEPLQNDASKASPQTKGQVQGANGGKGSRNKKQGKKKETVDLRSLLILCAQAVSTGDGRTANELLKQIRQHSTPFGDGSQRLAHFFANGLEARLAGTSVGTQMFYTSNRALSTLEKLKAYQVHLSACPFKRIAYSFSNKMIFHAAERETTLHIVDFGIQYGFQWPLLIQFLSKRPEGAPKLRITGIDLPQPGFRPAECIEETGRRLEKYCNRFNVPFEYNAIASQKWETIRIEELKIERNEVLAVNCAFRMKNLLDETVEGTSPRDAVLNLIRRMKPDIFINSIVNGSYNAPFFLTRFREALFHFSALYDVFDVTIPRDNPQRVMFEREFYGREAMNVIANEGLERVERPETYKQSQFRISRAGFKQLPLNQEIMSLFRAKMKAWYHKDFILDEDNHWMLQGWKGRIVYASSCWVPV

SEQ ID NO: 1354 - protein, 585 aa, Oryza sativa Indica Group
MVDRRMAFAAEADVDSKAAFGFFGGECFVGEGDLVNPAPPPPQQQQVHEGGFAAEDESDGDDDDDDDDVDDIEELERRMWRDRVRHKRLKELQQSRAGRESRAGDAGGGGRQQRQSQEQARRKKMSRAQDGILKYMLKMMEVCNAQGFVYGIIPEKGKPVSGASDNLRSWWKEKVRFDRNGPAAIAKYQADNAVPGCDGDAGGAAPAGPHSLHELQDTTLGSLLSALMQHCDPPQRRFPLEKGVPPPWWPEGSEAWWPEAGVPKELGPPPYKKPHDLKKAWKVAVLTAVIKHMSPDVDKVRRLVRQSKCLQDKMTAKEIVTWLAVLKQEEDLYLKLHPGALPPPLSAASFNASVSGEYDVEGVDGDEAGNNNLQKAQNDATAFMDLTTTMDAALSNNKFLIMPLMKEEAIDVDFIQKRSEPELMLSSDSHARVYTCGNVQCPHSNYALGFLDRNERNAHQYACKHNAAAAAAESKPPPPHIFEPLGSFDFDLPVDGQRCLAGLMTMYDNDVAAATQMHHHHHQQQQANFFIRDDAPFGGDVAATAAAASEFRFSSNFNVSGGGAVDYGGAMQQPPAKYAGSNWFY

SEQ ID NO: 1355 - protein, 644 aa, Vitis vinifera
  misc_feature (95)..(95): Xaa can be any naturally occurring amino acid
  misc_feature (306)..(306): Xaa can be any naturally occurring amino acid
MSEGHLFNNISLGGRGGTNPGQLRVHPGGILWKKQGGGKAVEVDKSDIVGVTWMKVPRTNQLGVRVKDGLYYKFTGFREQDVTNLTNFFQHSCGXNPEEKQLSVSGRNWGEVDLNGNMLTFLVGSKQAFEVSLADVSQTQMQGKNDVILEFHVDDTTGANEKDSLMEISFHIPNSNTQFVGDENRPPAQVFRDKIMSMADVGAGGEEAVVTFEGIAILTPRGRYSVELHLSFLRLQGQANDFKIQYSSVVRLFLLPKSNQPHTFVVVTLDPPIRKGQTLYPHIVMQFETDYVVQSELSLSEELLNXKYKDKLEPSYKGLIHEVFTLILRGLSGAKVTKPGKFRSCQDGYAVKSSLKAEDGVLYPLEKSFFFLPKPPTLILHEEIDYVEFERHAAGGSNMHYFDLLIRLKTEQEHLFRNIQRNEYHNLFDFISGKGLKIMNLGDVQTADGVAAVLQNDDDDAVDPHLERIKNEAGGDESDEEDEDFVLDKDDGGSPTDDSGEEESDASESGGEKEKPSKKESKKEPSVSKASSSKKKPKDGDEDGSKKRKQKKKKDPNAPKRAMSGFMFFSQTERENIKKSTPGIAFTEVGRVLGDKWKKMTAEEKEPYEAKAQADKKRYRDEISGYKSNPQPMNVDSGNESDSE

SEQ ID NO: 1356 - protein, 226 aa, Arabidopsis thaliana
MDRTGRHTSGLNRTGKSCRLRWVNYLHPGLKRGKMTPQEERLVLELHAKWGNRWSKIARKLPGRTDNEIKNYWRTHMRKKAQEKKRPVSPTSSFSNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSG

SEQ ID NO: 1357 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLESHRKTSGGGRSCCPQPSLVVRAPQQQQQQQHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 1358 - protein, 76 aa, Triticum aestivum
MSRESLGKNSKIMGGRERKEVNSTAKHFVDFTEAEEDLVFRMHRLVGNRWELIAGRIPGRTAEEVEMFWAKRHQDQ

SEQ ID NO: 1359 - protein, 521 aa, Solanum melongena
MPADPDSSSAMNDSTGSGEASVSSSGNQAVPQKESGKKKRNLPGMPDPDAEVIVLSPRTLLATNRFVCEICSKGFQRDQNLQLHRRGHNLPWKLRQRSGNEVKKRVYVCPEPTCVHHDPSRALGDLTGIKKHFCRKHGEKKWKCDKCSKKYAVQSDLKAHSKICGTKEYKCDCGTLFSRRDSFITHRAFCDALAQESAKTLPEKPPNANEEPKTQAVASSSPPAPPPATESQPPPPPAPKPLITPAVPPSTAIMSFASSGQNPELRENPNTNSAGTATEQVVEEAAAVTSLSGNCSSSCSNGSSSSSVFGSLFASSTASGNLPSQAPAFADMFRAVAADRTLEMPPPSSAEPISLGLAMSHSSSIFRPAGQERRQYAPAPQPAMSATALLQKAAQMGTAATSSSLLRGFGVMSSTSSSNGQQEWNGRPIDTNGASLAAGLGLGLPRDTGSGLKELMLGTPSVFGPKHPTLDLLGLGMAASVSPAPGLSALITSMGSNLDMVTSAGSFGSGDFSGKDLGRNS

SEQ ID NO: 1360 - protein, 258 aa, Oryza sativa Indica Group
MVKNTSNKCIAAAGATAAAGLGGGAASCSGGGGDGKVTTAAAAALAVRPYKGVRMRSWGSWVSEIRAPHQKRRIWLGSYATPEAAARAYDAALLCLKGSDAILNFPSSASSRRRLDIHRGSTDSAAGDMSPRSIQRVAAAAAAAFDAAAAGVVVDESCSCSSEAMSSTPTSGATSLSTLGSSGGGDVLDHATTPSSSSSAAANVCSPPLEGDHELWTELDAFASPKFMDLMAAGGTAFSSPWEEPEEDGELMRLWSFC

SEQ ID NO: 1361 - protein, 259 aa, Zea mays
  misc_feature (185)..(185): Xaa can be any naturally occurring amino acid
MGRGKVQLKRIENKINRQVTFSKRRSGLLKKAHEISVLCDAEVALIIFSTKGKLYEYSTDSCMDKILDRYERYSYAEKVLISSLWKCRDKGNWCHEYRKLKAKVETIQKCQKHLMGEDLETLNLKELQQLEQQLESSLKHIRTRKNQLMLESISELQRKVNSNEKSLQEENKVLQKEKALLLPAXLAEKQKAQRKQVQWGQTQQQTSSSSSCFVIREAAPTTNISIFPVAAGGRLVEGAAAQPQARVGLPPWMLSHLSS

SEQ ID NO: 1362 - protein, 547 aa, Solanum melongena
MKVPFSTNDNVSSKPLISSNNNNNNNNLRNVTFPVAVTNGPNLCYEPKSVLDLRRSPSPIVEKQIVTTNPDLSALCGGEDPLQLGDHVLSNFEDWDSLMRELGLHDDSASLSKTNPPLSLAQTESLTQFHNLSDFSGDSTQFANPDFSFSDSTFPQQFPAVNQGSFINALDLSGDIHQNWNVGFDYVDELIRFAECFETNAFQVAHVILARLNQRLRSAAGKPLQRAAFYFKEALQAQLAGSTRQTRPSSSSDVIQTIKSYKIFSNISPIPMFSSFTANQAVLEAVDGSMLVHVIDFDIGLGGHWASFMKELADKAECRKANAPVLRITALVPEEYAVESRLIRENLTQFARELNIGFEIDFVLIRTFELLSFKAIKFMEGEKTAVLLSPAIFRRVGSGFVNDLRRISPNVVVHVDSEGLMGYGAMSFRQTVIDGLEFYSTLLESLEAANIGGGNCGDWMRKIENFVLFPKIVDMVGAVGRRGGGSWKDAMVAAGFRPVGLSQFADFQADCLLGRVQVRGFHVAKRQAEMLLCWHDRALVATSAWRC

SEQ ID NO: 1363 - protein, 222 aa, Picea mariana
MGRGKIEIKRIENTTNRQVTFCKRRNGLLKKAYELSVLCDAEVALIVFSSRGRLYEFANHSVKRTIERYKKTCVDNNHGGAISESNSQYWQQEAGKLRQQIEILQNANRHLMGDGLTALNIKELKQLEVRLEKGIGRVRSKKNEMLLEEIDIMQRREHILIQENEILRSKIAECQNSHNTSMLSAPEYDALPAFDSRNFLHANLIDAAHHYAHQEQTTLQLG

SEQ ID NO: 1364 - protein, 202 aa, Oryza sativa Indica Group
MDKYYEEDWTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTKVSHYKTEGVFAFTGGRQGTASPRNRATAKADQQLVHQPKEKKLAQ

SEQ ID NO: 1365 - protein, 440 aa, Populus trichocarpa
MGPETSSQEQQLRLALTTPAPPASAPAKTTPVSTKTTALAPGFRFHPTDEELVIYYLKRKVSNKPFRFNAISEVDIYKNEPWDLADKSRLKSRDQEWYFFSPLDKKYGNGARMNRATGKGYWKATGKDREIRRECQLLAMKKTLVFHSGRAPGGLRTNWVMHEYRLIDEELERTGAMQIDSYVLCRVFHKNNIGPPTGNRYAPFIEEEWDDRGAALIPGEDAADEVVVTYDTGGEMHRTEQDSHSINKSPLGITEVPGDSQNALPVCKTESVEDCPPLCVLNTEAPFPLLQYKRRKHNNETGSNRSNGSENSTRTSQDPCSSTTTTAATTSAEMMMATTSATTTAISALLEFSLMEPLEPKENPRVPPPALDAASLDSSMSPSCRKFINDLQSEIRKISVERETLKLEMMSAHAMINILQSRVDFLNKENEDLKRSVHAK

SEQ ID NO: 1366 - protein, 646 aa, Zea mays
  misc_feature (116)..(116): Xaa can be any naturally occurring amino acid
  misc_feature (185)..(185): Xaa can be any naturally occurring amino acid
  misc_feature (260)..(260): Xaa can be any naturally occurring amino acid
MMGGGLLVDQSVVFPGVHNFVDLLQQNGDKNLGFGSLMPQTSSGDQCVMGEGDLVDPPPDSFPDAGEDDSDDDVEDIEELERRMWRDRMKLKRLRELQQTRGKDSLASGAGLADGXSKPRQSQEQARRKKMSRAQDGILKYMLKMMEVCRAQGFVYGIIPEKGKPVSGASDNLRAWWKEKVRFDXRNGPAAIAKYQADNAVPGAENELASGAASPHSLQELQDTTLGSLLSALMQHCEPPQRRYPLEKGVPPPWWPTGDXEEWWPELGIPKDQGPPPYKKPHDLKKAWKVSVLTAVIKHMSPDIEKIRRLVRQSKCLQDKMTAKEISTWLAVVKQEEELYQKLNPGARPPASTGGIASAISFNTSSSEYDVDIIDECKGDEAGNQRTAVTDPTAFNLGASILSDKFLVPTPMKEETADVEFVQKRNAPAAAEPELMLNNRLYTCNNVQCPRSDYSYGFLDRNARNSHQYTCKHKDPTPQSTENKPPSAPPQPQAFQPAFSQPNQALNSLDFSLPMDGQRSIAELMNMYDNNFVPNKNPSSDSVAVMERPNAMPQQRIQMDEGFFVQGNGAFDDVNNSMMQQQQQQQQAPVQQQQQFFIRDDTPFVSQMGDIAASAPEFRFGPGFNMSSGVDYPGAAQRNDGTNWFY

SEQ ID NO: 1367 - protein, 368 aa, Zea mays
MALEAVVFSQPQAAAGHFGYGRGDSTTYAVPWCDLLQGGVGGGGGGFGDLCAAGEWDLDIDTWAAAAAAAAPTVELGGDDWDWEALSRDYQSSDASTEYYHGGSRKAAAAPEPGAGRRKRRRAKAVKNKEEIESQRMTHIAVERNRRRQMNEYLAVLRSLMPPSYAHRGDQASIVGGAINYVRELEQLLQSLEVQKSIRSRPGAGAGAADSSPFAGFFSFPQYSATTTSAHGGCSGNNNNNTGSGGNRSDAAGAAAGAGAGAGAGAGAAGSAVADVEVTMVEGHASLKVLARRRPKQLLKLVAGLHQLRIPPLHLNVTTVDAMVLYTFSLKVEDDSNMGSVEDIAAAVHEIIGSIEQQQQEEGETAVM

SEQ ID NO: 1368 - protein, 274 aa, Triticum aestivum
MGRGKVQLKRIENKINRQVTFSKRRNGLLKKAHEISVLCDAEVAVIVFSPKGKLYEHATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALRKELVERQKAAASRQQQQQQQQQMQWEHQAQTTHTHTQNQPQAQTSSSSSSFMRRDQQAHAPQQNVCSYPPVTMGGEAAAAAAAPGQQAQLRIGGLPPWMLSHLNA

SEQ ID NO: 1369 - protein, 1090 aa, Ustilago maydis 521
MSSSTSAAIPPQANSDESNPLRTPPPPSSSTSSSSSSLSASTVSTPTPLAAGATSSSAVQSASASSPDPAVAFIPTPSSSSAPVTAQVSPPKITPATPSSSFSPPPPSSSSPSATVSVSSSPPTSSTIHHATVSDPTTEDIDMAVSTVSHPAPDLVLTDLGASSKRITPLASATIPHNSPQLEGTPLNPSQQQLALDALVPASALSTSSQPFSPISNSPQPMQPTKSSPATPTSLVKHSELTPSPRDRSAASGSASSSTPASSTTPALPPKVAPVMAGMGTLPPNVPPPSASASASTSAFSASDTLRAIPTNKNNPAFLNKLRSMVDDPNTDELIRWSPDGASFFVPNHVRFGDQVLPRFFKHNRFSSFVRQLNMYGFHKVPHLQQGALKHDSPQESELWEFSNPHFHRDHPDWLSKVQRKKGPRDDKDNHADREASATTGQELMHAGALMRTDFGMNNLGADANADGALQLASVLNAINAIKNAQTSISADLRHLQNSNQNLWQEAVESRQRAKRQQETINKILRFLAGVFGNQEDTETPVPGKKVSGKARAGKRVGVRPQQQQQQQQQHQQHQQQRSKSRLMIEDGNASSSSSHRGIQGLDLPLDQEEIEEMPYHLRFQEASNSDSPKVQSPSANLGASRFTQIGSPPSSSSAADFGRQLSEAVSTPGGSRRLSSQASNQVLNALASGEGNAWLASLFGASLANQGSKSTGPASGGGLKLDPHMVAALQQALASAGGVNSASDNTGDYFGSTTGAPADDGSSRFSAFPSSSSNASAVSSSNSAQANALGLDADALARFGASISHALVQSPARPNPNAGASNTQPTNYSVTSPSKGGSANLFDMGNDEVTSSGNNNQQLALSLSRATRDLQNTSSDVDQVQSSINSLIQGLQGIAGQAPASASASASDRAAVVPWQTTSGAAFDAAPATFGDASGSASVGNQFEAPSGTTPPSSTVDVGATSGTNAGMDDFDVDSFLSQFVDSSQAPGGGVTSPTPNNAYGESPSFAFSPATTAAFLHGAATSASDLPYAQQLTSKAESGTSSNSSSSRLNGKADSNAPKKRKPSTSGVELAVDVDMPDRPLKKSGRKA

SEQ ID NO: 1370 - protein, 204 aa, Arabidopsis thaliana
MATEQDAEVGTETPSVSGRFLRNRDLYLFLPFLLGFSDQESSNGDDDDVASSRERIILVNPFTQGMIVLEGSSGMNPLLRSLLESREEGRPPASKASIDAMPIVEIDGCEGECVICLEEWKSEETVKEMPCKHRFHGGCIEKWLGFHGSCPVCRYEMPVDGDEIGKKRNDGNEIWVRFSFNDGRRIRDFSAQDGGNSDGVESEN

SEQ ID NO: 1371 - protein, 255 aa, Gossypium barbadense
MEMYPSTIDSDLMMLDSIRRLLLGESSDLRFTSSNDCTNVGAAPPMFCRSSSFSRLYPCLTDIWGDLPLKENDSEDMLVFGYLRDALTVGWAPSDHSSPTFPPIKPEPQEIPTETAVKEVPTVANAAVPTVVPAKGKHYRGVRQRPWGKFAAEIRDPAKNGARVWLGTFETAEDAALAYDKAAYRMRGSRALLNFPLRVNSGEPDPVRITSKRATPEPSTSSSSGSENGSPKRRRKVGSAAPVVAQAGLNMGFGA

SEQ ID NO: 1372 - protein, 727 aa, Bradyrhizobium sp. BTAi1
MVVAQGPGGGEVGPDGRPKQQPQGQPQRPGPGAPPPHQAAPPPPPAPPPAAAPRPAPPPPAPPPAAAPRPAPAPPPPPPPPRAEPPRPAPPPPPPPPRAEPPRPAAPPPPPPPPRAEPPHAAPPPSRAEPPAPPPSRPAPPVAAPPVHTPPPPAPPPASPHEPARPATPPAPPPAAAPVRPTPPTPPAATPAPPPPSSSAPNQRPGTPPSPVTPPPSPPAAGNAPPPAHTPPRSAAPSPQPTPAPTPPGGPGQRPPIQPGAGAPPPGAPQGAPPPRGAPTPPAGTVAPGPGTPPSPATPPAAQTPPPNAQPGTPSPGPRPGTPPTPPPAAGPGPAAGPGAAGPGPGTAAPGPGGPAATPAPGPGSGPGAGAQGAVPPAGPPAMTNRPPPQVAAPIPAPPPPSPQQLTPIAPGAPLVGPQRLEDFRGQRREVQEGGRTLIYEPGRVIVRDPGGQEFVRHDELERFRYGARDIRVMREDRGETRTVVIRPDGSQIVTITAPDGRLLRRIRRDIGGREIIIIDNTYRDPQAVGGFYVDLPPPEIRIPYNRYIVDAEEAPPDVIYDTLVAPPVERVQRRYSLDEVRYSPSVRQLMPSIDLNTITFETGSWEIGPDQVAKLQVIADGLNQAIQRNPREVFLIEGHTDAVGNETDNLSLSDRRAESVATLLTQQFGVPAENLTSQGYGEQYLKEQTQGPSRINRRVTVRRITPLLNGGQAALPPPPPGIAPPR

SEQ ID NO: 1373 - protein, 229 aa, Antirrhinum majus
MAREKIQIKKIDNTTARQVTFSKRRRGLFKKAEELAVLCDADVALIIFSSTGKLFEYASSSMKEILERHNLHSKNLGKMEQPSLELQLVEDSNCTRLSNEVAERSQQLRRMRGEELQGLNMEELQRLERSLEVGLSRVLDKKGEKIMNEINQLQEKGMQLMQENQRLKQQVVDISNYQQITATPDSEIIHVYEEGQSSESVTYTCNSTGLPQDYDCSDTYLKLGLPYSG

SEQ ID NO: 1374 - protein, 246 aa, Cucumis sativus
MAPREKAVAVKPSVGNVKEVHFRGVRKRPWGRYAAEIRDPSKKSRVWLGTFDTAEEAARAYDSAARDFRGVKAKTNFPLPSDDQLLNLNNKINNINNNQSPSQSSTVESSSREQALMVDSSPLNLNLGHGIGGLTNAGPISFPFQRYQIPMIGEVFTRGIPPSNHVLYFDAALRAGMINSHPNQRLHFDRIREAVSDFRREFAGSGVQSDSDSSSVVDMNGQDLKPRGGSGGRLDLDLNFPPPESA

SEQ ID NO: 1375 - protein, 259 aa, Arabidopsis thaliana
MKRGLDMARSYNDHESSQETGPESPNSSTFNGMKALISSHSPKRSRRSVEKRVVNVPMKEMEGSRHKGDTTPPSDSWAWRKYGQKPIKGSPYPRGYYRCSSTKGCPARKQVERSRDDPTMILITYTSEHNHPWPLTSSTRNGPKPKPEPKPEPEPEVEPEAEEEDNKFMVLGRGIETTPSCVDEFAWFTEMETTSSTILESPIFSSEKKTAVSGADDVAVFFPMGEEDESLFADLGELPECSVVFRHRSSVVGSQVEIF

SEQ ID NO: 1376 - protein, 367 aa, Arabidopsis thaliana
MNGEISRPPELISSRNPCKSFENAIHKAVEAELAELAKSDANGGGKSKVKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKPAEQWKIPLLMSNTEIVYQLYPSMVRRISNASPKEHLPQEEETGVLSDDKMDDEAKEPPREQNSKTGVYRPVARMGAFSVCKPGYMAPCEGPLVQASRPDSLAGKFLQSLCYDPIIPSKCGHGCCNHQDSTTLSSSSVLGSEFVDYEEHSSAELDKELISISNDLNNTAWIRSGKEAEQSLKADDQFRREYAHSKFSGMVNNGVSSQMVRQDLRALS

SEQ ID NO: 1377 - protein, 184 aa, Brassica napus
  misc_feature (71)..(71): Xaa can be any naturally occurring amino acid
MQDQLVCHGCRNTLLYPRGATNVRCALCNTVNMIPHHPSPHARAGMDMAHIVCGGCRTMLMYTRGGTSVRXSCCQTLNLVPAPTPSNQFAHINCGNCRTTLMYPYGASSVKCAVCQFVTNVNLMGNGRVPNMQNGAASPRTISTSTQSTPPSKTRTVVVENPMSVNESGKLVSNVVVGVTTCKK

SEQ ID NO: 1378 - protein, 412 aa, Zea mays
  misc_feature (256)..(256): Xaa can be any naturally occurring amino acid
MAEGPCVLHTTGCMEASAAAGGGRESNKKEEESLPPGFRFHPTDEELITYYLRRKIADGRFTARAIAEVDLNKSEPWDLPEKAKLGEKEWYFFSLRDRKYPTGVRTNRATNAGYWKTTGKDKEIYTAGHQLPAAATTPELVGMKKTLVFYKGRAPRGEKTNWVMHEYRLHSKSLPKSNKVHARTCLRTLRMSGWCCRVFAKSAAAKKYPSNNAHALARSSHHHPYALDVFPPLLPTLLQQDPFVARRHHHHHPYMXPADLAELARFARGTPGLHPHIQPHPGTSSSAPYMNPAVAAPPFTLSGGGRLNLNLGATPAMPSSPPALHAMSMAMMSGQTEPSCASTGRQYHQVMAGEHHQQKQMATAAAAGLGGCVIVPGADGGFGADSAAGARYQGLDVEQLVERYWPAGGYQV

SEQ ID NO: 1379 - protein, 227 aa, Physcomitrella patens subsp. patens
KLPSSQFRGVVPQSNGRWGAQIYEKHQRIWLGTFNTEEEAARAYDTAAIKFRGRDAMTNFRPVTDSEYESEFLRSFSKEQIVEMLRRHTYDEELDQCKKVFNMDAAANPVTPPNLPRDEPRESSPTREHLFDKAVTPSDVGKLNRLVIPKQHAERCFPLDLSANSPGQTLSFEDVSGKHWRFRYSYWNSSQSYVLTKGWSRFVKEKKLDAGDIVSFERGRNHELYID

SEQ ID NO: 1380 - protein, 291 aa, Physcomitrella patens subsp. patens
RFKVLQPSRIPIPRQGAYLTIPPGLSPTTLFDSSPVLVSTSQSEPSPTTGTYPMPPFFNGSLTRPVAKVGEVSKEPIDSQPSQPTASHSSQGSEQQAPPAAVSTIVDRPSEDGYNWRKYGQKHVKGSEYPRSYYKCTHINCLMKKKVERSRDGQVTEIIYKGDHNHPKPQPTRRLALSGAHLISDSSGEEHHMIRLKTDKKSKDPVPPPRMIREPRVVVQTTSDVDILDDGYRWRKYGQKVVKGNPHPRSYYKCTNVGCPVRKHVERASNDPKAVITTYEGKHNHDVPAAR

SEQ ID NO: 1381 - protein, 344 aa, Oryza sativa Japonica Group
MDFSGDIDDLISLQLLHDQLLGVEADACLPVAVHHDGVAAFAEHQQGFHPAAFLPQQPMTMTPAGYVDMANDQYLGAHAAAGEAEAVYRAAAAEPVMIRFGGEVSPVSDPRRPPLTISLPPTSHAWAAAEAVHPAALLQAQTAAAAADPNDFRKYRGVRQRPWGKFAAEIRDPKKRGSRVWLGTYDTAIEAARAYDRAAFRMRGAKAILNFPNEVGSRGADFLAPPPPPPPPTTSTHGKRKRHETAAADPDVEVIGESSKSVKTETYTSPASSSLASTTTSTVTSSSTSPSPSSEAAACGGGGGELFVPPMPSSWSWDQLEGFFGILSPLSPHPQMGFPEVAVN

SEQ ID NO: 1382 - protein, 640 aa, Oryza sativa Japonica Group
MGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGIGGSNGGVFEDVNGMMQQPQQTTPAQQQFFIRDDTPFGNQMGDINGASEFRFGSGFNMSGAVEYPGAMQGQQKNDGSNWYY

SEQ ID NO: 1383 - protein, 425 aa, Oryza sativa Japonica Group
MQLLNHAMEAYRQQLEAYQMGSQHSAAAAAAARAPLVLEEFIPVKNIGIDVVAADKAAAAGGNSVSSEKASWMVSAQLWNAPASASAADTAAKGPQTPKEHSEHHPLDTSPKLITAAALPELALAPAEKAADAITIAAGEVDKKPYAHDNGVVARSREAQNGGKPPSTPSDGQAVPPPPQPHRKARRCWSPELHRRFVNALQILGGAQVATPKQIRELMKVDGLTNDEVKSHLQKYRLHTRRPMPSPAPPTAATPQLVVLGGIWVPPEYATQAAGPAIYGAHPATQPHYTAAVAAQEYYHHHHHHLQHHPAAAALVHHRAVAPPPPLPPQQQLAPPYSAKSSASARLGSPDSDGRGSGGGGGAAASGAGRDMSESIEEEGEGEEREDDDDDDEMAATNNAHAVDGDDDNDEINTTTTTSAGAINY

SEQ ID NO: 1384 - protein, 244 aa, Triticum aestivum
  misc_feature (203)..(203): Xaa can be any naturally occurring amino acid
MAYQYHHQDHAPAGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWAQQPXTRSSSDKSKRKRNNAGDGNAEQILVGRARLESEERMPHICT

SEQ ID NO: 1385 - protein, 476 aa, Medicago truncatula
MASSVEKPNQTTTQLEPLPPPQHRHHQQHKPQHHHHPIHDHNQISFGMMQSSSSPSVLGNYIRNKDSGAYDLGELDQALFLYLNGQTDPSSVQDQKQNSTSGMRPPTLNIFPSQPMHVEPSSSNSKASMDLVSPQTSGSKKGSEPPKAVKARTKIIILNQYPREKNHGKGPTSSSEHEGPKTPDPKILRRLAQNREAARKSRLRKKAYIQQLESSRIKLNQMEQELHHARNQGMFFGGGAMLGGEQGLPSMNTISSEAAMFDVEYARWLEEHHRLVCELRAAVHEHIPENELRMFVDKFLAQYDQVAQLKSLVAKADIFHLVSGMWVTPIERCFMWIGGFKPSELIKIIVSQIEPLTEQQIMGIYGLQQSTQQGEDALSQGLEALNQTLSETITSDSLSYPPNMTNYMDQMARAMNKLSTLESFVREADNLRHQTIHRLNQILTTRQAARCFLAMAEYFHRMRALSSLWLARPRQE

SEQ ID NO: 1386 - protein, 222 aa, Picea mariana
MGRGKIEIKRIENTTNRQVTFCKRRNGLLKKAYELSVLCDAEVALIVFSSRGRLYEFANHSVKRTIERYKKTCVDNNHGGAISESNSQYWQQEAGKLRQQIEILQNANRHLMGDGLTALNIKELKQLEVRLEKGIGRVRSKKNEMLLEEIDIMQRREHILIQENEILRSKIAECQNSHNTNMLSAPEYDALPAFDSRNFLHANLIDAAHHYAHQEQTTLQLG

SEQ ID NO: 1387 - protein, 535 aa, Physcomitrella patens subsp. patens
MRAAKVCHPLLGFAESREEGEEDEDGVDEASQTLGADRCRITGDHRLLLWSLKRLQEEIATLLSPVYATKLLFTVTAISVSALADPHTFIQPHVQVPKRLDDCRVIRASRIVAKTGSTESEQPPDAVFAFSGGHSEGNVYSDSILFLFEELVGPLRSHKHLTPTRMDFLGKQSFDGTEEDRDLDGGARTGASLRGSSDDLSSESNTTSTTNAQDPSSNVAKKLGSRGKVRQYVRSRLPRLRWTADLHRCFVVAVERLGGQEKATPKMVLQLMDVKGLTIAHVKSHLQMYRSLKNDESVQSGNPTVASPSPTVDSRPPTQLMKHLDGAGDAGIDSPSLRGDWHYLLETDFKKQQETDDDHFGQPFPGSVSRSLDSASNYNKIYNRFIGNAVNERSHDLFWPKAQRPSKHITVDRYRYEHDDESNWRQDANSTEPDSLLSLSHLHSRPSLSTTSQKSIILNHRSTSVATEQVSFVDFLSSSQSRNTEQVATPADGLGLDLTMSTGSAIEDPEEVSLSFQRNKVEELDLMLDLTMSTR

SEQ ID NO: 1388 - protein, 276 aa, Oryza sativa Japonica Group
MVVAGKKQGRHSFSASSSSSSSSSCSVVQLGHHQRPQGEDPLIGIKAAAAGGGGIMRKGPWTEQEDVQLVWFVRLLGERRWDFLAKVSGLQRSGKSCRLRWVNYLHPGLKRGRMSPEEERMVVQLHAKLGNRWSRIAKSIPGRTDNEIKNYWRTHLRKLKLKQQKQQQSDDHHNDNDDDDDRNSSSSSSSSNSNSNLQQQPQPEDESSASGSLQAQHHEDQHQLFLHPLWNDDIIVDVDCWSSSTNVVAPPPMPASPLWDIDDAFFCSDYSLPLWG

SEQ ID NO: 1389 - protein, 284 aa, Arabidopsis thaliana
MTAVTAAQRSVPAPFLSKTYQLVDDHSTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 1390 - protein, 244 aa, Triticum aestivum
MVRAPCCEKMGLKRGPWTAEEDMTLVAHIEQHGHSNWRALPKQAGLLRCGKSCRLRWINYLRPDIKRGNFTSDEEEAIIQVHAMLGNRWSTIAARLPGRTDNEIKNVWHTHLKKRLESSSKPSGQAAPKRKAKKPAVAASALEGPTSEPASSSPGQSLSTSSPTGYSMASSLENTGSSSSEEFQIDDSFWSETLAMSADSSGSGMESSDTFGVDSGAPSSSNDEMDFWVTRVMQASDIQSLSQI

SEQ ID NO: 1391 - protein, 218 aa, Picea mariana
KIEIKRIENTTNRQVTFCKRRNGLLKKAYELSVLCDAEVALIVFSSRGRLYEFANHSVKRTIERYKKTCVDNNHGGAISESNSQYWQQEAGKLRQQIEILQNANRHLMGDGLTALNIKELKQLEVRLEKGIGRVRSKKNEMLLEEIDIMQRREHILIQENEILRSKIAECQNSHNTNMLSAPEYDALPAFDSRNFLHANLIDAAHHYAHQEQTTLQLG

SEQ ID NO: 1392 - protein, 92 aa, Brassica napus
MLLPPPRVSPPPPLLCTLHARFFRSQRYPRIKHAQKCYVRGSFAVPVLQRGSGTCLGVVEIPPPPQKMNSRLELENICTALEVSLSLLPTHV

SEQ ID NO: 1393 - protein, 237 aa, Brassica rapa
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVAINGNGVSQSGKIHTCSICFKSFSSGQALGGHKRCHYDAGINGNGNGSSSNSVEVVGGSDGNYVDDERSSEQSATGDNRGFDLNLPADQVAVVISKR

SEQ ID NO: 1394 - protein, 251 aa, Malus baccata
MDTISRQLSDSAEKPESSSESVTTRSQLTSFSDEEVILASSTPKKRAGRRVFNETRHPVYRGVRRRNNDKWVCEMREPNKKKSRIWLGAYPTAEMAARAHDVAALAFRGRLACLNFADSAWRLPVPASTDSVDIRRAAAEAAETFRPAEFGGVSESGDDEKESKKMEGEKDCGCAEQSDCGRAEQSDCGGAEQSGSSFYLDEEEMFAMPRLLDSMAEGLLLSPPRRSAGSNMNWDDMGSNDDDVNLWSFSK

SEQ ID NO: 1395 - protein, 245 aa, Oryza sativa Japonica Group
MARERREIRRIESAAARQVTFSKRRRGLFKKAEELAVLCDADVALVVFSSTGKLSQFASSNMNEIIDKYTTHSKNLGKTDKQPSIDLNFFLIILLRTYTNSYAYIHLLLQLEHSKCSSLNEQLAEASLQLRQMRGEELEGLSVEELQQMEKNLEAGLQRVLCTKDQQFMQEISELQRKGIQLAEENMRLRDQMPQVPTAGLAVPDTENVLTEDGQSSESVMTALNSGSSQDNDDGSDISLKLGLP

SEQ ID NO: 1396 - protein, 316 aa, Oryza sativa
PPPLGLHNPSDSAGRGSSSPLFLLFFSPRLSRTLPSPFSRVGGGHHASLRGLSGCYECRAINVEPMSRRYPRPRELCACSQCGEVFNKADSLEHHQAIRHAVSELGPEDSGRNIVEIIFKSSWQKRDRPICQIDRILKVHNAARTVARFEAYRDAVRTRCRATAARAAADGNELLRFHPAALACPLGLNGATSLCDDDDACGVCAAIRHGFAPWAGAHPLGVRTTASSGRAHDCGAAAAAAQQAGGCRAMLVCRVIAGRVRRNDDDGGAEEEEGAFDSVAGDEAASSVYGNLEELFVANPRAILPCFVVIYRVVPE

SEQ ID NO: 1397 - protein, 361 aa, Vitis vinifera
MGSSSSSSSSPGFAPHPLEGLHEVGPPPFLTKTFDMVEDPATDSVVSWSRARNSFIVWDSHKFSTTLLPRYFKHSNFSSFIRQLNTYGFRKVDPDRWEFANEGFLGGQKHLLKNIKRRRHVSQNTQQGGLGACVELGQYGLEDELERLKRDRNVLMAEIGKLRQQQQNSRNELVAMEGRMQNTEKKQMQMMTFLAKALNNPSFVQQFIQQRRELRGAEIGRKRRLTTSQSAENLQEVITVASIDQAFSYTNQDDGDMSGIESEIETFFSGGWDNESSEDIKDPKADSIDNNLGSVNDVIWEELLSDDLIAGNEEEVPPLRLGDHHEPETDVEVEDLVATPSDWGEDFQDLVDQMAFLRSKS

SEQ ID NO: 1398 - protein, 176 aa, Oryza sativa Indica Group
MGFPSVCYCVILPQPLVLVLQLLDLLRHAFLLCLSALGLAAPPPPDEHPAYAPPPPPPASMAALPADLVWAFQPAPEPVAIKARLPAVRYADFVRCRRAAAAAAASCAVCLGALEARHRVRELGNCAHAFHKACIDKWVDKGQATCPLCRAALLPSADDDDAAAIAATTRHHLPSF

SEQ ID NO: 1399 - protein, 266 aa, Triticum aestivum
LAWSRPRWGAQHMVPPYGTPPPPYMMYPPGTVYAHPTTPGVHPFHYPMQTNGNLEPAGAQGAAPGAAETNGKNEPGKTSGPSANGVTSNSESGSDSESEGSDANSQNDSHSKENDVNENVQSGAVIGGVAGPATNLNIGMDYWGATGSSPVPAMRGKAPSGSARGEQWDERELKKQKRKLSNRESARRSRLRKQAECEELGQRAEALKSENSSLRIELDRIKKEYEELLSKDTSLKAKLGETGGGDSVPDMNERGDTNGGSHHKEP

SEQ ID NO: 1400 - protein, 525 aa, Petunia integrifolia subsp. inflata
MPADNSSAMNDNSTGSGEASVSSSGNQAKETSKKKRNLPGMPDPDAEVIALSPTTLLATNRFVCEICSKGFQRDQNLQLHRRGHNLPWKLRQRSSKEVKKRVYVCPEPTCVHHDPSRALGDLTGIKKHFCRKHGEKKWKCDKCSKKYAVQSDLKAHSKICGTREYKCDCGTLFSRRDSFITHRAFCDALAQESAKALPEEPPNAIEEPNNQAIASPSPPPTPPVPPAAAESQPPPPLPLPPAAPMPITPASVPPSTAVISFVSPVQNPELRESSNTDSAGTGTNHVMEETAALVSLTGSCSSSSNSCSNGSTSSSVFGSVFASSTASGSMPSQAPGFTGLFQAMAPDRVAEMAPPSSTEPISLCLAMSQGSSIFRPAGQERRQYAPAPQPAMSATALLQKAAQMGAAATSSSLLRGFGVMSSTSSSHGQQEWNGRPLDPDGASLAAGLGLGLPCDAGSGLKELMLGTPSVFGPKHPTLDLLGLGMAANGGPSPGLSALITSMGSNLDMASFGSADFSGKDLGRNS

SEQ ID NO: 1401 - protein, 192 aa, Chrysanthemum x morifolium
MDIESHYQHQEKLSLVQPSLEPELMLASQNPKKRAGRKKFKETRHPVYRGVRSRKFGKWVCEVRHPITQSRVWLGTHDTADMAARAHDVAVLAMRGRSACLNFADSVWRLPIPQSSDVIDIQKAAAEAAKSFRPIVEIVKIVYEVDEDEIFGMPGVIDSMADGLMLPSPHTVGHGNLFDDVESFDDMSLWCS

SEQ ID NO: 1402 - protein, 203 aa, Oryza sativa Japonica Group
MAGVGVGEGEVRYRGVRRRPSGRYAAEIRDPAKKTPIWLGTFDSAEAAARAYDAAARSLRGAAARTNFPPSTSSSAPPPPPPQHQPPQHLPPAAAAATSSHSSTVESWGVTVAAAAASAGALGLPPPRNGGSNPAADEDCRSYCGSSSSVLCEDGASGAGDEAAAPRCSPLPFDLNLPASSPSAAAAAEADEMDWRCDTLLHL

SEQ ID NO: 1403 - protein, 515 aa, Physcomitrella patens subsp. patens
MGSPANLALGPQVSTITSTIETALNCTVSADGLEADEIQKIAAHLRALQEERGKIEAFKRELPLCMQLLDEAIETAINKVMVDQCSPTASLQTSVLDAQDSDYERPKRTLVLENFMPLKRRWEKQLKEKIFQNDAGNNSQQHEDKVVIGRPAWMKETQLWTKQSESIDYEKASPSRGSRRQVEFKCSEQDRPLTSSRLLLNSKDRQGGAFVPFNREKQLPSPPFSSQSTGPASDAAGFSTSSAVRTPSRMGHTIESFDIGRVNGNVHVRDHSSDARNSIDHSVQTRTGANQPQRKARRCWSPELHRRFVSALQQLGGSQVATPKQIRELMKVDGLTNDEVKSHLQKYRLHTRRPSPSPPSPSHAPQLVVVGWVRPEFTAVEGAASQASTGDNPLPGISNECVPSQSTGQPQKQSPPNFQKHLPAVSTSQTSLRGPSPVGVDSPHSSSDSYIDESDDEQDGNCTSSGENGRQYECNEKPLQSARESKGSTTCLADIDATINPQMKLRILRKTKAAA

SEQ ID NO: 1404 - protein, 548 aa, Petunia integrifolia subsp. inflata
MKVPFSSNDNVSSKPLNNSNNNNLRNSSFPAATNSPNLCYEPKSVLELRRSPSPILDNKQVITNPDYSTLCGGGEDPLQLGDHVLSNFEDWDSLMRELGLQEDSASLAKSNPQLTLTQTESLTQFHTLSEYSADSAQFGSSEFSFSENYPHQFPAVNQGNYINALDLATGDNNNWNLGFDYVDELIRFAECFETNAFQLAHVILARLNQRLRSASGKPLQRAAFYFKEALQAQLAGSTRQTRPSSSSDVIQTIKSYKIFSNISPIPMFSSFTANQAVLEAVDGSMLVHVIDFDIGLGGHWASFMKELADKAESRKAVTPVFRITALVPEEYAVESRLIRENLTQFARELNIGFEIDFVLIRTFELLSFKSIKFMDGEKTAVLLSPAIFRRVGSGFVSDLRRVNPNVVVHVDSEGLMGYGTVSFRQTVIDGLEFYSTLLESLEAANIGGGNNCGDWMRKIESFVLFPKIVELVAAIGRRNGGGGGGSWKEAVVAAGFRPVGLSQFADFQADCLLGRVQVRGFHVAKRQAEMLLCWHDRALVATSAWRCS

SEQ ID NO: 1405 - protein, 168 aa, Brassica napus
MVKQELNIKKEMSLSPPSSPKIKSKKNKIKKYKGVRMRSWGSWVSEIRAPNKKIRIWLGSYSTAEAAARAYDVALLCLKGPQANLNFPSSASSRLLLDEKTHLSPKSIQKIAAQAANNSFDLFAPSSSADSSPFDHDQHPDDMQSLIGSFEDNPCGLLMDPSSSWYDN

SEQ ID NO: 1406 - protein, 229 aa, Zea mays
CARSSATSCPRPRSAARRRPTPPGPVSLDLSLSVTDNSNGNNSNSGGAQADAAREPSRVFTCNYCQRKFFSSQALGGHQNAHRRERTLARRALRLDAAGPYYGYGYGYYADVASLPLYGSCLYPIGIQAHASAAALPEHEDARAGADELRRPARGLLSPMPFLVADDEEMLFGWPGSFRPDAAAPADSGRPRRRARPGGARSDAQAVNCELIRRLDWLIRQAVSFLFLN

SEQ ID NO: 1407 - protein, 373 aa, Vitis vinifera
MALEAVVFQQDLFGYNGKDLYSLFGGNWSCEFGLEKEDEKSCCFDTLESQTETSHHYENWNSPSQPPPPSIVPHLNEWHHHNSSPEGLIPKQVPEFDSTLPTATSSSSRPKRRRSKSKKNQEEIENQRMTHIAVERNRRKQMNEYLSVLRSLMPESYVQRVSVSFLSVPVYICISFQGDQASIIGGAINFVKELEQRLQWLGGQKEKENGEAGSSAPFSEFFTFPQYSTSSTVSDNSVSMADTVGGNQAVIADIEVTMVESHANLKIRSRRRPKQLLRMVSGLQSLHLTILHLNVTTIDQTVLYSLSVKLSEKFKGELSSQTLKDEVQEKAAMNSFGRAKLSLQHLYTCNSTLKTMYPYHDPKDQRESQTKIS

SEQ ID NO: 1408 - protein, 349 aa, Solanum lycopersicum
MGVQEKDPLLQLSLPPGFRFYPTDEELLVQYLCKKVAGHDFPLQIIGEIDLYKFDPWVLPSKATFGEKEWYFFSPRDRKYPNGSRPNRVAGSGYWKATGTDKVITSQGRKVGIKKALVFYVGKAPKGSKTNWIMHEYRLFESSRKNNGSSKLDEWVLCRIYKKNSSGPKPLMSGLHSSNEYSHGSSTSSSSQFDDMLESLPEMDDRFSNLPRLNSLKAEKFNLDRLDSANFDWAILAGLKPMPELGPANQAPGVQGQAQGHVNNHIHSDNNNMNFLNDVYAHPPNFRGNTKVESINLDEEVESGKRNQRIDQSSYFQQSLNGFSQAYTNNVDQFGIQCPNQTLNLGFKQ

SEQ ID NO: 1409 - protein, 521 aa, Vitis vinifera
MDMSDKDKFELEKRSGDSLNYHSASMSSDWRFGGVCKGDLVGSSSCSSASMVDSFGPNLWDHPANSQTLGFCDMNVQNNASTSSTLGIRKGGPGSLRMDIDKTLDIGWNPPSSMLKGGIFLPNAPGMLPQGLSQFPADSGFIERAARFSCFNGGNFSDMMNPFSIPESLNPYSRGGGMLQQDVFASNGLKSVPGGQSQKDEPSMAEISKDVSSARKSESLVKSLEEAKQGIGVSGNESDEAEFSGGGGEPSSGKGLGSKKRKRSGQDPEIDQVKGSPQQPGEASKDNPEIQHKGDQNPSSVPSKNTGKHGKQGAQASDPPKEEYIHVRARRGQATNSHSLAERVRREKISERMKFLQDLVPGCSKVTGKAVMLDEIINYVQSLQRQVEFLSMKLATVNPRLDFNIEGMLGKDILQSRVGPSSTMGFSPETTMPYPQLHPSQPGLIQVGLPGLGNSSDAIRRTINSQLAAMSGGYKESAPQLPNVWEDELHNVVQMGFSTGAPLNSQDLNGSLPPGHMKAEL

SEQ ID NO: 1410 - protein, 92 aa, Debaryomyces hansenii CBS767
MAPTEKKRTTRKKKDPDAPKRSLSAYMFFANENRDIVRAENPGISFGQVGKLLGEKWKALTPEDKIPYENKADTDKKRYEKEKAEYAKKNAA

SEQ ID NO: 1411 - protein, 611 aa, Hordeum vulgare subsp. vulgare
MSSPAGGYGGAEAHHHGHMLLHSHAHHMAAAAAASGGQLYHVPQHSRREKLRFPPDAAAEDSPPTPLAPHHQHHQAGAWPPPAFYSYASSSSSYSPHSPTVPQGQQLVLNGLTAQQVTAQQFPHIPTHNFSLSLSSASSNPATAPPTPRKQQEPGGAGPCGPFTGYASVLGRSKFLVPAQRLLEEICDVGGAAAHADRSLPDEGLLDADTMDVADDELDAAGPMYGAEQQWKKTRLISMMEEVCKRYRQYYQQVQSAIASFETVAGFSNAAPFTALALRVMAKHFKTIKEMILSQLRNTSKMPVKGSSMSKDITIFGLGGGGGAPVGGFQRGSSVNGFGQPHNIWRPQRGLPERSVTVLRAWLFEHFLHPYPTDGDKQMLAKQTGLTRNQVSNWFINARVRLWKPMVEEIHNLEMRQVHKQSPHDNGSQHGVHGHAHQPSSQQQQQQRSGKRSEPCDSHLGQCSGVTRNHHHHSNPAASSHGGGFPDDLSQMSHSMQQGQVTFAGYGALPSQSQQHQHQHQHSSMASPQHPHHQHHVGAAGAGNGGGVSLTLGLHQNNRVCFGEPLPANLAHRFGLEDVVSDPYVMGSFGGGQDRHFAKEIGGHLLHDFVG

SEQ ID NO: 1412 - protein, 208 aa, Vitis vinifera
MAKTKPGKKDLDSYTIKGTNKVVRAGDCVLMRPSDSDKPPYVARVEKIEADHRNNVKVRVRWYYRPEESIGGRRQFHGAKELFLSDHYDVQSAHTIEGKCIVHSFKNYTKLENVGAEDYFCRFEYKAATGGFTPDRVAVYCKCEMPYNPDDLMVQCEGCKDWFHPSCMGMTIEEAKKLDHFLCSDCSSDDDAKRSSNVKEISSSKECP

SEQ ID NO: 1413 - protein, 399 aa, Capsicum annuum
MEGTSSIDQESTTSDSLSIAPAASSSMVVKQQPSMTTTKPPESLCRMGSGTSSVIIDGENGVEAESRKLPSSKYKGVVPQPNGRWGAQIYEKHQRVWLGTFNEENEAARAYDVAAQRFRGRDAVTNFKPLLENQESDDDVEIAFLNSHSKAEIVDMLRKHTYIDELEQSKKLFGYTKDGTMAKNKDGLIDISSFFGGGGTIDKVNNKVREQLFEKAVTPSDVGKLNRLVIPKQHAEKHFPLQNGNNSKGVLLNFEDLNGKVWRFRYSYWNSSQSYVLTKGWSRFVKEKNLKAGDIVSFQRSTSGDKQLYIDFKARNMAPTNPVVTNQVQAQVQVPRVQMMRLFGVNICKIPATINNVVDNNNNNNNNMANCSGGKRMMEMELLTFESCRKKQRVIIDAL

SEQ ID NO: 1414 - protein, 233 aa, Populus trichocarpa
MGLQETDPLAQLSLPPGFRFHPTDEELLVQYLCKKVAGHHFSLQIIGEIDLYKFDPWFLPGKAIFGEKEWYFFSPRDRKYPNGSRPNRVAGSGYWKATGTDKVITTEGRKVGIKKALVFYVGKAPKGTKTNWIMHEYRLLESSRKSGSTKLDEWVLCRIYKKNSSAAQKSMSSVSSKEYSTNGSCSSSSSHLEDVLDSLTEIDDRLFALPRTNSLKQMQRRENQLSKSGFREL

SEQ ID NO: 1415 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECRRSSFSIVPPTPSYYFPTPNGSPGPNQSGVATHLPRRSSCAVPCTQVHSPIPMKGRPLFNDRDLEGKETQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 1416 - protein, 1031 aa, Arabidopsis thaliana
MEGGRGGGDGNFLPNSNFGVFSDSAMDMDFMDELLFDGCWLETTDGKSLKQTMGQQVSDSTTMNDNNNNSYLYGYQYAENLSQDHISNEETGRKFPPIPPGFLKIEDLSNQVPFDQSAVMSSAQAEKFLLEESEGGRRYWIAPRTSQGPSSSVKERLVQAIEGLNEEVQDKDFLIQIWLPIQQEGKNFLTTSEQPHFFNPKYSSLKRYRDVSVAYNFLADEDSKESVGLPGRVFLKKLPEWTPDVRFFRSEEYPRIKEAEQCDVRGSLALPVFERGSGTCLGVVEIVTTTQKMNYRPELDNICKALESVNLRSSRSLNPPSREVCKNGLLNQTLTSSIHRNNEFWLLNVICPFCFSFCRVYDLPLALTWAPCARQGKVGSRHSDENFSECVSTVDDACIVPDHQSRHFLEACSEHHLLQGEGIVGKAFNATKLFFVPEVTTFSKTNYPLAHHAKISGLHAALAVPLKNKFNSSVEFVLEFFFPKACLDTEAQQDMLKSLSATLQQDFRSLNLFIDKELELEVVFPVREEVVFAENPLINAGTGEDMKPLPLEEISQEDSSWISHMIKANEKGKGVSLSWEYQKEEPKEEFMLTSGWDNNQIGSGHNNFLSEAEQFQKVTNSGLRIDMDPSFESASFGVGQTLLGSRRPGEKRRTKTEKTIGLEVLRQYFAGSLKDAAKSIGESDDSFTQFHFHVAVCPTTLKRICRQHGITRWPSRKIKKVGHSLKKLQLVIDSVQGVQGSIQLDSFYTSFPELSSPHMSGTGTSFKNPNAQTENGVSAQGTAAAPKSPPSSSCSHSSGSSTCCSTGANQSTNTGTTSNTVTTLMAENASAILKRARSEVRLHTMNQDETKSLSRTLSHKTFSEHPLFENPPRLPENSSRKLKAGGASKVKATFGEAKHEIARRFNIDNIAPFDLKYLDDDKEWVLLTCEADLEECIDIYRSSQSRTIKISVHEASQVKLGGICVQEREPPSGVIFQVPNQSISVKSSNQYLLKKQVSLQTKGSRFGLFLFLSDSVSDTKEDIDPEPIIAT

SEQ ID NO: 1417 - protein, 441 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLALEKLNRSGSPDLCLSEPENQSPTSVLSTLGSDAFGTVDSTKPSEQSSPVSSAVAENSGDLVLSEPFDLVVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDLEGKETQKEGSSTGSNAESVDAEYLEIEAQSSRNVVEESVRASVPSLFERRANSTKRVKGFVPYKRCLAERGVSSSTLTGEEREEQRTRLCL

SEQ ID NO: 1418 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFVVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSAGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 1419 - protein, 83 aa, Physcomitrella patens subsp. patens
KLRRKGLKRVREPRYAIQTPSDVEIMEDGYKWRKYGQKAVKNSPHPRSYYRCTHMMCPVRKRVERSAEDTGLVITTYEGTHTH

SEQ ID NO: 1420 - protein, 263 aa, Brassica oleracea
MANFENLSSEFQTIAVDIYSSMNQAADLNNNNNISSNLQFQTFPPFSTSLDSLFLHHRHPQQLHDLPGKYPGSDNNLSATSTLYHSSHNNVDETKKRKALLQPLSSSENSSVSDQLNINTTKTGCSRRGKRLKKKNQEEEKEREVVHVRARRGQATDSHSLAERVRRGKINERLRCLQDIVPGCYKSMGMATMLDEIINYVQSLQNQVELLSMKLTAASSFYDFNSETDAVDSMQRAKAREAVEMGRQTRDGNPVLHLSAWSL

SEQ ID NO: 1421 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKNGTMASEKLNRSGSPDLCLSEPENQSPTSVLSTLGSDAFGTVDSTKPSEQSSPVSSAVAENSGDLVLSEPFDFAVEESRSSPARAYASSNQANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDMEGKETQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 1422 - protein, 197 aa, Brassica napus
  misc_feature (185)..(185): Xaa can be any naturally occurring amino acid
  misc_feature (191)..(191): Xaa can be any naturally occurring amino acid
  misc_feature (193)..(193): Xaa can be any naturally occurring amino acid
MEKDGLELEITELRLGLPGRDVTEKMMKKRGFTEMIMTSSGSHSEQCESSVVSSGVDVEKVNETPAVKTQVVGWPPVCSYRRKNSCKEVSTTKVGLGYVKVSMDGVPYLRKMDLGSSQGYDDLAFALDKLFGFHGIGVALKDGDNCEYVTIYEDKDGDWMLAGDVPWGMFIESCRRVRIMKRSEXTGFGLXPXGLDE

SEQ ID NO: 1423 - protein, 524 aa, Solanum bulbocastanum
MPADPDNSSAMNDSTGSGEASVSSSGNQAVPLKESAKKKRNLPGMPDPDAEVIALSPTTLMATNRFVCEICSKGFQRDQNLQLHRRGHNLPWKLRQRSSNEVKKRVYVCPESSCVHHDPSRALGDLTGIKKHFCRKHGEKKWKCDKCSKKYAVQSDLKAHSKICGTREYKCDCGTLFSRRDSFITHRAFCDALAQESAKALPEKLPSTNEEPKTQAVASSSPPSTPPAPPPATESQPPPPAAPKPLMTPTVPPSTVMSFASSVQNRELRENSITNSAGTSTKQVLEEAAAVASLTGNCSSSCSNGSSSSSVFGSLFASSTASGNLPSQAPVYSDMFRAMSPERTLEMASPSSTEPISLGLAMSHSSSIFRPAGQERRQYAPAPQPAMSATALLQKAAQMGAAATSSSFLRGFGVMSSTSSSNRHQEWSGRPIDANGASYAAGLGLGLPCDAGSGLKELMLGTPSMFGPKHPTLDLLGLGMAASVGPSPGLSALITSMGSNLDMVTSAGSFGTADFSGKDLGRNS

SEQ ID NO: 1424 - protein, 271 aa, Oryza sativa Japonica Group
MERGDEASVNRGWLELRLGVNGGGGVETVPVTAADSSASSEAGEADTVTPSQQQQQQQQGSPSSPAASSAPNKVFSCNFCMRKFFSSQALGGHQNAHKRERSAAKRTPSSSPYHLHHHRMMMAGAGLPLEAHAAFMRAALRVNPAGSAIHKQQQQHQPPPPITQDATAPRFHDGAAVAAAAAVTPWAPVAPLAYDEVLSSSASSWPGSFRFRTQPEPPPSSEQEPPSEQNVKFSKYISADVLSLKSRIIMLKLCHNRGYDNKGCNSAICTA

SEQ ID NO: 1425 - protein, 889 aa, Physcomitrella patens subsp. patens
MLCSGALVNPEAETSSQVYWSEGSPGRGGYQSINAGSEAGREGSMAVRARERGRERAFPSQLSLRWSGLLWSGHPPVPVVLQIFPKRFCASSFIVLISELLLQNLPSGIQLFRQPPPPAFLISAFRVSVPTFPALFPQRSRATELGTLRFSNSRSALIAVHVDRPSWWHRLCNFSVRESEPESEADDLGMLAAAHCCRRDGHAVTAMSFSEFVIASRSGSLGNREGYESRYDPPFCLRRVLHASSYCRIELCRPELIKSVHLYMDDGFVTAVQQEFLLSPDVYTQISEPIPSYFSRFAHNGAKQFIDTLKQLNEADLWQCVLEYHVHTPQDTSIIPLLSVSKNPALYYIPSLAEDLVLVEKAVQIPAHEHQQCIPLRGPDCLDAQQHFPACGGQSYIDGSQLTWNFPKWGLAGFSGFTVESAGMNDGVQSESNSQAETLHDWGSDLELASPRMFETCVLGSSWSTSISSMPFTGLMSSSCLISNVASNNKSDPVSWSPSSLVLESQMAGSYAFHEVLPFSDDSNCGQMKLTTSSDASQSPALCHGDLFLSPLCTSSTMSDRVSPRSPLLKKVVESAMSYCSDESLSEPAGSDRPKGGFSSAALPFDSQKCRIINHRGEVLTHQPCSYELSEPGHDVGHVGECHSMLEMGAEPCNQRGATERMTEITLHELSQYFHMPITQASKELKVGLTVLKKRCREFGIPRWPHRKMKSLDSLIQNIQVTFRLGLCMLHLTLSDFVKWPLRTDKHIMDRWWESRLAYFEDDNREPSLSARNSELRSMQTFSIKFYLVHPKRLVVNIWFQTVELARGPEGGTSGPVMSAVKELEHQKKRMEERPGTELAERTKRLRQACFKASYKKRRQALTSLLQQDVGVEMCKDAVVGELPSVQIR

SEQ ID NO: 1426 - protein, 212 aa, Sinningia speciosa
MVRGKVQMKRIENATSRQVTFSKRRNGLLKKAHELSVLCDAEVALIVFSQKGRLYEFSSSDMQKTIRRYFEHTKEDRSANVRVEQHMQQLKHEAVFMSKKIELLEIARRKFLGHNLGTSSMEELQELDNQLERSLKNIRHRKAQLYNEEIEKLQAKEKFLLEENARLREKSEMRLRNGAEKHREIGSCSQSSLSSEVMTELFIGPPITRNGP

SEQ ID NO: 1427 - protein, 210 aa, Sinningia speciosa
MVRGKTQMKRIENATSRQVTFSKRRSGLLKKAFELSVLCDAEVALIIFSPTGKLYEFSSSSVINKTIERYQSNSKALVIGRKTKENVQHLKDETVELSKKIELLQELQRKLLGEGLDTCSLDELGQIEQQLEQSLSNIRVKKNLLYKQQIDLLRDQEKALMKENTELRKKCEMLPAQLSILPKGKVQPVDVETALFIGLGPVYTPSYNGL

SEQ ID NO: 1428 - protein, 284 aa, Picea abies
MEHMNTTAQSSSSLYGVHMVEYGGDVGVGSMMALMTEHQPESESIMTSIPIPSSYSSYSHGHGHGHGHGHGHGQSECLLSAAAMFQSSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 1429 - protein, 264 aa, Brassica napus
MDGGGDGGGAAYNPRTVEEVFRDFKGRRNGMIKALTTDVQEFYRLCDPEKENLCLYGHPNEHWEVNLPAEEVPPELPEPVLGINFARDGMMEKDWLSLVAVHSDAWLLAVAFFFGARFGFDKADRKRLFNMMNDLPSIFEVVAGTAKKASKEKSSVSNNSSNRSKSNSKRGSEPKPKYSKPEPKDEEEEEEEGVEEEDEDEDDDEQGETQCGACGESYAADEFWICCDLCENWFHGKCVKITPARAEHIKQYKCPSCSNKRARS

SEQ ID NO: 1430 - protein, 229 aa, Vitis vinifera
MEKSGEQMVDVRSVVEAISTDNEDAPLYQVESLCMRCTQNGTTRFLFTEIPHFRKILLSAFECPHCGERNNEVQFAGELQPRGCSYSLHFSAGDQKMLNRQVVKSESATIKIPELDFEIPPEAQCGSLSTVEGILTKAVDDLQALQEERKKVDSQTAEAIDQFLLKLKPCATGDSSFTFNLDDPAGNSFIENPFAPSPDPSLTIKFYKRSPEQQASLGYLVDSSQLGDQ

SEQ ID NO: 1431 - protein, 280 aa, Vitis vinifera
MKREPHGSIGAAAGHRAIAQVNSAEIAENLFRYSTPEEVMTFPSTCGACAARCETRMFVTNIPYFQEVIVMASSCDGCGYRNSELKPGGRIPVKGKKITVCVKNVNDLSRDVIKSDTAGVSVPELDLELASGTLGGVVTTVEGLITKICENLERVHGFTFGDSLDDSKRSKWQDFRMRLSKLLSLEEPWTLIIDDALANSFVAPTTDDIKDDHQLTCKFSSCQSEASLILKCTSFLMKRLIIFKPLRYLGVGKAVLRIRNYFILFVYFRFLHHCPNKGHS

SEQ ID NO: 1432 - protein, 165 aa, Oryza sativa Indica Group
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGEHWDPGDLYNLSDCHPKLMSAWQQLAVMACDAF

SEQ ID NO: 1433 - protein, 443 aa, Solanum chilense
RMSVDVGAPSPRSIQMDEQLNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGVSSSTLTGEEREEQRTRLCL

SEQ ID NO: 1434 - protein, 443 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTQSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGVSSSTLTGEEREEQRTRLCL

SEQ ID NO: 1435 - protein, 318 aa, Oryza sativa Japonica Group
MMVPSSRKVRVFCSDPDATDSSDEDDQNKKERRFSREILIPMENSKASKPVKTLVQCGTKTVKDSEKEPTSKYRGVRRRAWGKWAAEIRDPVRKSRKWIGTFNSEEEAAAAYLAQSNQFHEELMALKIQSSVSEQEDLSSSVTISCVSSSQSCDQKIQAKPQEHKRVSVVVNRETVEQKFKAQPQAQKIKAQPEVQKRVSVKISHETEDEHLLNLPSTPKGKEISMGAVLGRIDEIPVSNCVGHIDEFPPDDFTRLADAFPVSDFIGMADVPLGDDYIGLADISHLPLPITDLKFDLNAELNWDGFDFASLEQELNCL

SEQ ID NO: 1436 - protein, 223 aa, Zea mays
  misc_feature (184)..(184): Xaa can be any naturally occurring amino acid
IPLCWGVPHGSVGAVAGRRAIAQGNPDEVAAALCRYSAPEEVDTLPSTCGACGTECVTRFFATKIPYFREVIVMATTCDMCGYRNSELKPGGEIPAKGKKITLRVQNAQDLTRDVIKSDSASVKVPELELELSCGTLGGMVTTVEGLIVKICEALERIHGFQLGDSTLEWKKKKWDDFKERLSXDDSQLTIEEYQRSWEQNGELGLNDMDTSSADAAYNTTNT

SEQ ID NO: 1437 - protein, 407 aa, Arabidopsis thaliana
MPLPWKKSKSSRISRFVSDFQQSPKHGGSLVVETGFPTSLIDLFVKNRDRLKKQSSKRNNKNNKAQTETRVLSPPPPHMSLQRRMSLPSKLDPALVTEDSPLVRKIEETSVPEIIHEDDGGHRGGGGGGCVLIVVVFKVFMVAVLALSTKKLAVGITLSAFALLFLELAVARVFTYLNLCPDAQIRIDSLIDKLIGKRHKEKLEEEEEEESTSTHDRRNNVYFEIIEEPREEIRVTPQSDSSSLEKAKLVVDEKKEMQTIRDVMFKTEKSKSAKLKSKIVKKIVPKKLRSYKKKKKMKNKEKEEEEVELETEEEGSMTEVSSLYSDERIGSEISERDDLSSNPPFLESCTEVEEEEETGPKEDLTKVIGLIVIVLVGLLCGKVFAIGLTLSWCLILRVFCCKSQTSF

SEQ ID NO: 1438 - protein, 232 aa, Salvia miltiorrhiza
MCGGSIISDEPIIKKRGKLSPQELWAQLDTISEFWGFDSSNDVPNQPKHSSIKKEKYKKSEKGNEKPRKSKYRGIRQRPWGKWAAEIRDPNKGVRVWLGTFNTPEEAARAYDGAARRIRGDKAKLNFPNHHQPRTPPEQPPPKRLCVIPEPPVEPSPDMAYSFESLEECYPTHSQAIKDGLSSLESFLGLEPTREPQTPELARFGLDEPVGSVDLWLMDEFVSLGQNNSVFF

SEQ ID NO: 1439 - protein, 774 aa, Glycine max
MDTPDRSKINTPLSQFEDSPVFKYISNLSPIEPVKSVHVTQTFNSYSFSSPPSVFTSPHGNCHKESRFLRRHNLLETSKPKVSSEDVNNVYSCEETPADSAQACHESSEQQENTAQKISVADASIEPCNENKNPNISIELPQVLKYNLGSPGYEPLLYGDEANSLLELPGNGKPASDVASVPEGSEKDSIEGEMHLPGLCQIEEAKVEGQDCGVDSLITEASDLLMFSPPEAFKGLNKQLNPSIELSNIMTVIPQFATNDGQQMHIGNAVASGSEHEIEDHPSESAAATGTSQRQDNLGNLALVTSNPSEKMDNKLVYVTHRGIRRRCLDFEMASVQRRNPADNSNTNSSTAKSEERNVSNEKQLLPTKHSGDSRRCVLPGIGLHLNALASLKDCKNIKIDTLSSGRQPNLLSSPSSVQLSPSQEHQLSLVPASVERDLEPLENEVQPGEDCTQSLVLVQMAGEDFQQNSPKKKRRKLEPAGEGESCKRCNCKKSKCLKLYCECFAAGVYCIEPCACRDCFNKPIHVETVLQTRQQIESRNPLAFAPKVIRSSDSVSEIGDDLNKTPASARHKRGCNCKKSSCLKKYCECYQGGVGCSVSCRCEGCKNTYGRKDGSVPSGLEAEPEEETEACEKGVVENASWKTETQNTEDHPDQSLATTPLPLSRSLLPLSFSSKGKPPRSFVTTISSSGLFVSQKLGKSNAPRSQHQPKCVKPLQTVPDDDSPVTCIKTSSPNGKRISSPNCDVGSSPTTRRGGRKLILQSISSFPSLTPHH

SEQ ID NO: 1440 - protein, 940 aa, Ostreococcus tauri
  misc_feature (581)..(587): Xaa can be any naturally occurring amino acid
MDCARAFLACVTVLALARALARTPSTTIANVPAAIGMTVIGAVIARVLEHATARERELGRRSGWRGSKKERSTGGSTWTHGPDVEIVVRCFPEVWSAWVELREKIIADYVTSLWYESLTDDADVPNALRAILDEAFARLSNRAREMDLVSLVLREIPDVFSQSLEAYRSARAEIGEEEFRKLCPEDAEDILACVLKKQGELHPAVSGEIETASAFRVLTAVMADILVKKEFASPLTVPLVRELLVVSLLRPLFGFAKPHWANRGILFVTGTVVDYKEDALEKGGDNDMCVSESGENERRVETNALAQHSRSASDNSSDTMPSGLYSDFKLSARVTGAEIVGSGSSSYAVYLVTVTTNENEMWVVPRRFRNFETLHRRLREVDKVAVNALEFPSKSWIKLSLSGAFIESRWKALDAYLRAVLVNEKLAASAEVFSFMDARPGIYDPDKPSVIAPELVKTMSDAMEGMASMVTSYTVGESTDGVNEIATDEDKSNLLAKKPPLHRRISSMYEETVSTATKKSVQQMTKTSSESESGSDTNEGSEDIDEFCRSLSLVRQSVAFIFSIERSISKRFQEFRNARSXXXXXXXYDASALHVRQSVAFIFSIERSISKRFQEFRSARSMARTIAWIRRVVWPEIPYPADTPERLACEADTARQTLLGVFSNQNVKTIMGARASARAANDVFSLLQSPVCCRHVGFVALETVVCALFPEILAKCETRAPETADAAAVDARAEVGRGRAPCRTSAHKKHTTHAMPDVMCGACAEQPAAVVRVQPTTGAHACVCARCDTRYDERPSATRRGTRGGCSKTARRVHSRDERREGQNRQRGERSMQRVGLRPAGGRDELSCDVCQMNPVYVICHEDRAFLCRVCDVSIHEANSSSKRHQRFLFANTRVDLEAMGAGEDAGTRMSPSDSAAEHTVPQFEQEEVGRKVSALDDIG

SEQ ID NO: 1441 - protein, 226 aa, Zea mays
  misc_feature (142)..(142): Xaa can be any naturally occurring amino acid
MSILSISFSTTEAYTEYNNGTKLPTKRQAKKDSLMDLSFHVPTSNTQFIGDEHRTSAQAISVEIDGGGSSEMAVVTFDGIAILTPRGRYSVELHQSFLRLQGQANDFKIQYSSILRLFVLPKFETEAVVERELTLSGEILAXKYKDRLESSYRGLIHEVFSKVLRGLSSAKVTRPSTFRSCLDGYAVKSSLKAEDGLLYPLEKGFFFLPKPPTLIPHEEVCFIKET

SEQ ID NO: 1442 - protein, 435 aa, Populus balsamifera
MFSSSSSFNPFDQYANHTMIAGTENPSSIESCSQTFLQHFPDPFLDVDDLLVGELLSQQQQQHQEEEEVLGSNTALAVEAHDPQTIPTASNEETKINNKKKRSNVDTSKQPIRQRRTGKDRHSKIHTAQGPRDRRMRLSLQISRKFFDLQDMLGFDKASKTIEWLFTKSKAGIKELTDSVPGGRRRCSICADGKSVCSTPESEVVSGIKLTPETNGDKRGTKAKNDSLVSNPKEKRSKKVHKPVFNLVDRDSREKARARARERTRERMKNQGIDTSSDRSSQANPNKLEKFESSGPLEYGENLAPVNQEMSSPLKVGDVKESSNHDLLPHQMDYVSITGNFFWITNSPRSSSIFDFSESVALPGGTNCKDEFPGFPFNSNMTNDRIQYKYNALTNMKLPSLNAHEESPNSIFMNMPNPNDQNSISILMTTTTNGN

SEQ ID NO: 1443 - protein, 510 aa, Arabidopsis thaliana
MSSTFNPAASSPDEMMDLQEETGEVKIEDQCVENKQSTPASCSSVSEGSAGSSHKSPTIASPATVSPTHRYLGRTSGPIRRAKGGWTPEEDETLRQAVDTFKGKSWKNIAKSFPDRTEVQCLHRWQKVLNPDLIKGPWTHEEDEKIVELVEKYGPAKWSIIAQSLPGRIGKQCRERWHNHLNPDINKDAWTTEEEVALMNAHRSHGNKWAEIAKVLPGRTDNAIKNHWNSSLKKKSEFYLLTGRLPPPTTTRNGVPDSVTKRSSSAQKRVFGSVAQTSSVTTDVNNLAEDGNGQINSSVPVEEVVAASRMTSLNEYARSPQLPNPEPLPENGGAANNGYHLYYTPQIDYYRASEVDTQRMYGNECGCSPSASPVSFFTPPPCRNVHSNGSTPRSPESYLREAGRTYPNTPSIFRKRRPRVVVQDNNNAKKTDEAKEVDQKVNDGKDSSEIQNNGSNAYNLSPPYRIRSKRTAVFKSRQLEFISREEEKADDETKSSEKDMLIDGDSQLLG

SEQ ID NO: 1444 - protein, 436 aa, Populus deltoides
  misc_feature (407)..(407): Xaa can be any naturally occurring amino acid
MFSSSSSFNPFDQYANHTMIAGTENPSSIESCSQTFLQHFPDPFLDVDDLLVGELLSQQQQQHQEEEEVLGSNTALAVEAHDPQTIPTASNEETKINNKKKRSNVDTSKQPIRQRRTGKDRHSKIHTAQGPRDRRMRLSLQISKKFFDLQDMLGFDKASKTIEWLFTKSKAGIKELTDSVPGGRRRCSICADGKSVCSTPESEVVSGIKLTPETNGDKRGTKAKNDSLVSNPKEKRSKKVHKPVFNLVDRDSREKARARARERTRERMKNQGIDTSSDRSSQANPNKLEKFESSSPLEYGENLAPVNQEMSSPLKVGDVKESSNHDLLPHQMDYVSITGNFFWITNSPRSSSIFDFSESVALPGGTNCKDEFPGFPLNSDMTNDRIQYKYNALTNMKLPTLNAHEEXPNSIFMNMPNPNDQNSISILMTTTTNGNA

SEQ ID NO: 1445 - protein, 368 aa, Triticum aestivum
MAMPPKPGEPPKPSPGRSPSLNPNPCPLPPIPGGPQPGQAPAAAAPPRSHHRRARSEVPFRFPDADGGGFDEIGSEDDLFSTFMDMDKIAGAGRDRAAETSSSPPRPTKHRHSASFDGFAMGCGGPGRQDGGGGGGGVFADVLEAKKAMSSEQLSELASVDPKRAKRILANRQSAARSKERKARYITELERKVHTLQTEATTLSAQLTLFQRDTTGLSAENTELKIRLQAMEQQAQLRDALNNTLKQELERLKIATGEMTKPDEAYNTGMHHVPYNPSFFQLSEQHTPQHHSSVHQLPSQFQPPHPNVPSHQMLSHPNTFPDMMQQDSLGRFQGLDIGKGSVAVKLEAEAAAKSEGSSISAGESNSTF

SEQ ID NO: 1446 - protein, 285 aa, Picea abies
MEHMNTTAQSSSSLYGVHMVEYGGDVGVGSMMALMTEHQPESESIMTSIPIPSSYSSYSHGHGHGHGHGHGHGQSECLLSAAAMFQSSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 1447 - protein, 436 aa, Populus maximowiczii
  misc_feature (395)..(395): Xaa can be any naturally occurring amino acid
MFSSSSSFNPFDQYANHTMIAGTENPSSIESCSQTFLQHFPDPFLDVDDLLVGELLSQQQQQHQEEEEVLGSNTALAVEAHDPQTIPTASNEETKINNKKKRSNVDASKQPIRQRRTGKDRHSKIHTAQGPRDRRMRLSLQISRKFFDLQDMLGFDKASKTIEWLFTKSKAGIKELTDSVPGGRRRCSICADGKSVCSTPESEVVSGIKLTPETNGDKRGTKAKNDSLVSNPKEKRSKKVHKPVFNLVDRDSREKARARARERTRERMKNQGIDTSSDRSSQANPNKLEKFESSGPLEYGENLAPVNQEMSSPLKVGDVKESSNHDLLPHQMDYVSITGNFFWITNSPRSSSIFDFSESVALPGGTNCKDEFPGFPFNSNMTNDRIQYKYNALTXMKLPPLNAHEESPNSIFMNMPNPNDQNSISILMTTTTNGNA

SEQ ID NO: 1448 - protein, 436 aa, Populus nigra
MFSSSSGFNPFDQYANHTMIAGTENPSSIESCSQTFLQHFPDPFLDVDDLLVGELLSQQQQQHQEEEEVLGSNTALAVEAHDPQTIPTASNEETKINNKKKRSNVDTSKQPIRQRRTGKDRHSKIHTAQGPRDRRMRLSLQISRKFFDLQDMLGFDKASKTIEWLFTKSKAGIKELTDSVPGGRRRCSICADGKSVCSTPESEVVSGIKLTPETNGDKRGTKAKNDSLVSNPKEKRSKKVHKPVFNLVDRDSREKARARARERTRERMKNQGIDTSSDRSSQANPNKLEKFESSSPLEYGENLAPVNQEMSSPLKVGDVKESSNHDLLPHQMDYVSITGNFFWITNSPRSSSIFDFSESVALPGGTNCKDEFPGFPLNSDMTNDRIQYKYNALTNMKLPTLNAHEESPNSIFMNMPNPNDQNSISILMTTTTNGNA

SEQ ID NO: 1449 - protein, 361 aa, Zea mays
MHNRIEEMYHHQQQLQSHSHFLSSRQTFPPERHMLLQGGSIPAEPGLVLSTDAKPRLKWTPELHERFVEAVNQLGGPDKATPKTIMRLMGVPGLTLYHLKSHLQKYRLSKNIHAQANGVNAKNVIGCTMAMDKPLEGNGSPASHLNLGTQTNKSVHIGEALQMQIEVQRRLHEQLEVQRHLQLRIEAQGKYLQSVLEKAQETLSKQNAGSVGVETAKMQLSELVSKVSTECLQHAFTGFEEIDGSQILQGHTIQLGDGSVDSCLTACDGSQKDQDILSISLSAHRGKEIGGMTFDIQEKERGREDLFLDKLSMTPPGQLDRRERGSFSMTRKAAKLDLNINDTTDGPQNCKKIDLNGFNWT

SEQ ID NO: 1450 - protein, 334 aa, Oryza sativa Japonica Group
MCGGAILAEFIPAPSRAAAATKRVTASHLWPAGSKNAARGKSKSKRQQRSFADVDDFEAAFEQFDDDSDFDDAEEEDEGHFVFASKSRVVAGHDGRAAARAASKKKRGRHFRGIRQRPWGKWAAEIRDPHKGTRVWLGTFNTPEEAARAYDVEARRLRGSKAKVNFPATPAAARPRRGNTRATAVPPPATAPAAAPPRGLKREFSPPAETALPFFTNGFVDLTTAAAPPPAMMMTSSFTDSVATSESGGSPAKKARSDDVDSSEGSVGGGSDTLGFTDELEFDPFMLFQLPYSDGYESIDSLFAAGDANSANTDMNAGVNLWSFDDFPIDGALF

SEQ ID NO: 1451 - protein, 291 aa, Musa balbisiana
MTDHVKWTSVESKTSTNAAPISSSSSSRSPSMASSSGAGTAVEHKRARDIRKHPVYRGVRMRAWGKWVSEIREPRKKSRIWLGTFATPEMAARAHDAAVLSVKGAPAAAAVLNFPELAGSLPRPASLSPRDVREAAARAAAMDMPRANAAALVVEDDELEEIVELPRLGQDLFGSAHLAGEFVFHDSISTASGALSFGASSKCPSCLLLHVLLLPSTAQLTRKERRNSVLLLARNRCKSISCLSPKRLSSRRNSWCSSRGTNSREQTAAIIPRLAFCSSLEDPTIIADAFH

SEQ ID NO: 1452 - protein, 558 aa, Zea mays
MADPPTSRMVQHPFGDIPSQTPKQFLYSGSSQHLCHPYQSASDAHVAPQRHYTVRSQSQSQSPDAGSEDFETHSRQYTLDSSSASGCSGHGSPSCQSVHAGSRSPVSHSHDDSHSGSTNGNGSPASASCVTEDPTDLKQKLKDLEAVMLGTDTDPETVDSLEIAIADRLSVEPEEWKNHMVSVPRGDLKELLIACARAVEQNNGYSIDLMVPELRKMVSVSGEPLERLGAYMVEGLVARLAASGSSIYKALRCKEPRSSDLLSYMHFLYEACPYFKFGYMSANGAIAEAVKGEDRIHIIDFHIAQGAQWVSLLQALAARPGGPPFVRVTGIDDPVSAYARGGGLELVGKRLSHIAGLYKVPFQFDAVAISGSEVEEGHLGVVPGEAVAVNFTLELHHIPDETVSTANHRDRVLRLVKGLSPRVLTLVEQESNTNTAPFAQRFAETLDYYAAIFESIDLALPRGDRERINIEQHCLAREIVNLVACEGEERVERHEVFGKWKARLMMAGFKPSPLSALVNATIKTLLQSYSPDYKLAEREGVLYLGWKNRPLIVSSAWH

SEQ ID NO: 1453 - protein, 337 aa, Triticum aestivum
MAAAIDMYKYNTSTHQIGSAASASDQELMKALEPFITIASSSSSHYPYHYYSSPSMTQNSYMATPSSSSYASSFAVSPLPTTAPASPSFSQLPPLYSSQFAASGMNGSMGLAQLGPAQIQQIQAQFFVQQQQQQRGLAGGSFLGPRAQPMKQSGSPPRASAAALALAGVAPAQSKLYRGVRQRHWGKWVAEIRLPKNRTRLWLGTFDTAEDAALAYDKAAFRLRGDLARLNFPSLRRGGAHLAGPLHASVDAKLTAICESLAAPSSKNSAEAEPESPKCSASTEGEDSASAGSPPPPTPPVPEMEKLDFTEAPWDESETFHLRKYPSVEIDWDSILS

SEQ ID NO: 1454 - protein, 414 aa, Oryza sativa Japonica Group
MAIKLNFDFSATFLFTYAKYLLLHLPIKICECIGLQMLPCFFAQGNFEMSHQQALAQVTAEAVHSPYSMINQSDFSLPFSSTTTSVLASQHVNSSANVSSPREIPTLPSHTDNSNIESTEVSHGFQTTALTEDKPADDGYNWRKYGQKAVKGGEYPRSYYKCTHLSCPVKKKVERSSDGQITQILYRGQHNHQRPPKRRSKDGGALLNEADVSPEKEDASTRSEQGSQDYSGKFKASNDGGPSSSRRGDRGEQISGSSDSNDQGEEEVKVEGRATSDGNANKRHVPAPAQRIIVQTTSEVDLLDDGYRWRKYGQKVVKGNPHPRSYYKCTYQGCDVKKHIERSSQDPKAVITTYEGKHSHDVPAARNSSHSSANANVSSSSNLPHKDRGQRSSCRDGLRNASSVSSLQLKEESG

SEQ ID NO: 1455 - protein, 301 aa, Oryza sativa Indica Group
MTTTTTAEGGGGVAPFVAKTYRMVDDPATDGVIAWGRDSNSFVVADPFAFSQTLLPAHFKHSNFSSFVRQLNTYGFRKVDPDRWEFAHVSFLRGQTHLLRRIVRRSSGGGGAKRKEEAGGCGGGGEAAAGDVDEESAVVAMEVARLRREQREIEGRVAAMWRRVQETERRPKQMLAFLVKVVGDPQVLRRLVDRDNTNAAPAASNADDAAVHHQVKRPRLLLDSSSTTTTHGDRHLVTAAADGFYAGGCGPEAAAAAAFVPDDALDFTGLYTGGDGFGNAVVDAGVDDPPAYAFPVVDSGY

SEQ ID NO: 1456 - protein, 211 aa, Oryza sativa Indica Group
MAKTKQGKKDVESYTIKGTTKIVRVGDCVLMRASDTEKAPYVGRVERLETDGRGSVRVRVRWYYRPEESKGGRRQFHGAKELFLSDHFDTQSAHTIEGKCVVHSFKNYTKLDNVGPEDFFCRFEYKAATGAFTPDRVAVYCKCEMPYNPDDLMVQCEGCKDWFHPSCMGMTIEQAKKLDHFLCADCVKENGTKRPSNSYPASSNSDSKVII

SEQ ID NO: 1457 - protein, 331 aa, Arabidopsis thaliana
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 1458 - protein, 444 aa, Solanum lycopersicum
MAQSNSKPPMSSQNFGVGAVSHVRSLSQSSIFSNSCLPPLSPFPPSEPGMVSGRSSLKDISMEEADVNSQGVGVVSSFTRDGLPPRKGHRRSNSDVPLGFSAMIQSSPQLMPISGQKVLGRAVSLGDSNGKIDERKPKGEVTDELLFSYMNLENIETLNGSGTKDRDKDSIVSGTKVTGSESSNNEAESVMKGNNVSIQPTNLREGTKRSADANIAPAARHFRSLSMDSAIGNFHYGDESPNLPTSLMMRSGQLSPSNSGNESSSKHNLDFGNSEFSEAEMKKIMADERLAEIAVLDPKRAKRILANRLSAARSKERKTRYISELEHKVQKLQTETTTLSTQVTILQKNFVEISSLNSELKFRIQAMEQQAQLRDALHEALTAEVQRLKLAAGEHREEGRLPNNMTQQTPVKHNIFQMQRQQPSQMQQLSVGKASAASATPASA

SEQ ID NO: 1459 - protein, 853 aa, Oryza sativa Indica Group
MAPPPPPQGSSTGDPLYDELWHACAGPLVTVPRVGDLVFYFPQGHIEQVEASMNQVADSQMRLYDLPSKLLCRVLNVELKAEQDTDEVYAQVMLMPEPEQNEMAVEKTTPTSGPVQARPPVRSFCKTLTASDTSTHGGFSVLRRHADECLPPLDMTQSPPTQELVAKDLHSMDWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSVGMRFRMRFEGEEAPEQRFTGTIIGSENLDPVWPESSWRSLKVRWDEPSTIPRPDRVSPWKIEPASSPPVNPLPLSRVKRPRPNAPPASPESPILTKEAATKVDTDPAQAQRSQNSTVLQGQEQMTLRSNLTESNDSDVTAHKPMMWSPSPNAAKAHPLTFQQRPPMDNWMQLGRRETDFKDVRSGSQSFGDSPGFFMQNFDEAPNRLTSFKNQFQDQGSARHFSDPYYYVSPQPSLTVESSTQMHTDSKELHFWNGQSTVYGNSRDRPQNFRFEQNSSSWLNQSFARPEQPRVIRPHASIAPVELEKTEGSGFKIFGFKVDTTNAPNNHLSSPMAATHEPMLQTPSSLNQLQPVQTDCIPEVSVSTAGTATENEKSGQQAQQSSKDVQSKTQVASTRSCTKHMKFFLLVVDMLKFSFCKFLAKSQFYPLCGMVHKQGVALGRSVDLSKFSNYDELKAELDKMFEFDGELVSSNKNWQIVYTDNEGDMMLVGDDPWEEFCSIVRKIYIYTKEEVQKMNSKSNAPRKDDSSENEKGSVKRDDTRDGGVLQKAASASVLSILRYSS

SEQ ID NO: 1460 - protein, 616 aa, Glycine max
MMMFEDMGFCGDLDMLCGSLGDGDIAVRQTEPDPVVEDDYSDEEIDVDELEKRMWRDKMRLKRLKEQTKSKEGTDAAKQRQSQEQARRKKMSRAQDGILKYMLKMMEVCKAQGFVYGIIPEKGKPVTGASDNLREWWKDKVRFDRNGPAAIAKYQADNAIPGKNDGCNSIGPTPHTLQELQDTTLGSLLSALMQHCDPPQRRFPLEKGVPPPWWPTGNEEWWPQIGLPKDQGPPPYKKPHDLKKAWKVGVLTAVIKHMSPDIAKIRKLVRQSKCLQDKMTAKESATWLAIINQEEALARELYPDYCPPFSSAVANGSMVINDCSEYDVDGAEEEPNFDVEDRKPDHLHPSNLGMERMMGRMPIQQPSHPMKGDVVTNLDFIRKRKISSDFNMMMDQKIYTCEHPQCPYSEVRLGFHDRSARDNHQLNCAYRNSSADYGGGPNFHATEVKPVIFPQSFVQPNTTAQSASLVAPSFDLTGLGVPEDGQKMISDLMTIYDTNVVGNKNLSSTNCVTAENHNLSQASLQRQDSFFPGQGMVLEGNLFAREEGQFDRFKATMNMNMNMNMNTPFDTNHNNNNIHLMFNSPCDLSSFDFKEDIQGVGMDSLQKQQEVSIWYQ

SEQ ID NO: 1461 - protein, 174 aa, Brassica napus
MEGLMRFGGLEEQFSHISENAINEKTPFLQMLQCIEPEPNQILQSLLQSQTLEPESCLTLETIKRDPGQEEDPVKDPKTEDGAEAKVKEKRKRKRTTAPKNNDEVESQRMTHIAVERNRRRQMKEHLNSLRSLMPPTFLQRGDQASIVGGAIDYIKELEQLLQSLEAEKQSEGA

SEQ ID NO: 1462 - protein, 428 aa, Triticum aestivum
SLHLHHHTTTTSTSPICLLPSRSLPPSLPFHKPTASHSAKNNRATTPSIYLPQAARQYSVAPMSGEFQFHDELASLFTQRPGPGMQQQEQQASWLADYLQTPMDYDLLCRALELPAAEDVVKRELVVDTTPSGGGALTPSAGGGTPNATSSMSSSSSEAGGGLCAGEGDSAGRCKKEDGDGEDGKGGDEGDKSKKGSAAKGGKAGKGEKRPRQPRFAFMTKSEVDHLEDGYRWRKYGQKAVKNSPYPRSYYRCTTQKCVVKKRVERSFQDPAVVITTYEGKHTHPIPSALRGSTHLLAAQAAHLHHQHHGHLGMLPQMGMGGRAGSPFGRSSGGGIDVLGGLLQPRAHHGMTPPMIGAGAGHQASTQGLPGSISSVASATASSPPSLQMQHFMAPDFGLLQDMLPSFIHGAGGNNNNNQPSSPYGKLH

SEQ ID NO: 1463 - protein, 436 aa, Populus trichocarpa
MFSSSSSFNPFDQYANHTMIAGTENPSSIESCSQTFLQHFPDPFLDVDDLLVGELLSQQQQEHQEEEEVLGSNTALAVEAHDPQTIPTASNEETKINNKKKRSNVDTSKQPIRQRRTGKDRHSKIHTAQGPRDRRMRLSLQISRKFFDLQDMLGFDKASKTIEWLFTKSKAGIKELTDSVPGGRRRCSICADGKSVCSTPESEVVSGIKLTPETNGDKRGTKAKNDSLVSNPKEKRSKKVHKPVFNLVDRDSREKARARARERTRERMKNQGIDTSSDRSSQANPNKLEKFESSGPLEYGENLAPVNQEMSSPLKVGDVKESSNHDLLPHQMDYVSITGNFFWITNSPRSSSIFDFSESVALPGGTNCKDEFPGFPFNSNMTNDRIQYKYNALTNMKLPPLNAHEESPNSIFVNMPNPNDQNSISILMTTTTNGNA

SEQ ID NO: 1464 - protein, 465 aa, Oryza sativa Japonica Group
MDRDQMTNTMRDQAANLTSMNPLFYPFMADDALLGMAPPPPQQLLPSVSIQHMDWSPDTMLDNLTFIEEKIRQVKDVIRSMAGRRASSSSAATPEQQLVNADLTCLIVQLISTAGSLLPSLKNSSFLSRTTPPPAAAAGAAQAVSLAAGESSSSARNNETNREDEEEQMGSPDYDELFKVWTNGGAMDECVGAAGDEQDARENPAAAAEEEKYEVLQLEEDEILAPHTHFCGICGKGFKRDANLRMHMRGHGDEYKSAAALAKPPPPPEGEEQPPQPERRYSCPHAGCKRNRMHASFQPLKTILCVKNHYKRSHCEKRHVCGRCGAKRFSVMADLKTHEKHCGRDRWLCSCGTSFSRKDKLFAHVALFQGHAPALPPPPPPPTSGRRRHKQEEPEFTWGGGGGNEFLDVKGIAGVGSGSGGGDEFFSAGSFGAMDFGFGQLDASLAMLLPSEQFAGDHQEENGDK

SEQ ID NO: 1465 - protein, 98 aa, Populus balsamifera
MKEKKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 1466 - protein, 362 aa, Zea mays
MEGAMTTRSKHRRHEEDQEMTMVELRRGPWTLEEDNLLMNYIACHGEGRWNLLARCSGLKRTGKSCRLRWLNYLKPDIKRGNLAPEEQLLILELHSKWGNRWSRIAQHLPGRTDNEIKNYWRTRVQKQARQLRVDANSAVFRDAVRCYWMPRLLEKTMAAAAASTSGEVLLPPLPPPPQLHPSRVAGLLASSSSSPVQRDTSDSDYLPQRYHHHPVDPSPSASSTVSSSAALAPVPCFSELSWVDQYGYGPYYSYGANLDDGAGVFDDSAALEEGLGLDALDLGPADDSDVAHSDATLLDYLNSACAGGGTMMMAVTGGGGGVQSSGCGATGGADADYRPSPCTWRTDELGDPRQHQWGGGI

SEQ ID NO: 1467 - protein, 123 aa, Brassica napus
MCRGVNEEENRSVHGGCRSLCTRPSVPVRCELCGGDASVFCEADTAFLCRKCDRWVHGANFLAWRHVRRVLCTACQKLTRKCLVGDNYHVVLPSATAGEAAVEDITIRSEQDSNDDEVPYVFL

SEQ ID NO: 1468 - protein, 94 aa, Populus deltoides
KKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 1469 - protein, 150 aa, Zea mays
RSLQPQYPRPYIPRRRREIRTRSTRKWWYRRVVAREAWRVAAAAVSGSRRRVKGSWTPEEDELLRRAITRHGPRNWTVISSEIPGRSGKSCRLRWCNQLSPSVERRAFTPEEDAIIVAAHAQHGNRWATIARMLHGRTDNSVKNHWNSTL

SEQ ID NO: 1470 - protein, 369 aa, Oryza sativa Indica Group
MDPRFPPPAPSGGAPPRGHHRRAHSETFIRLPDADLLLDPDGEFGFSDLDFPSLSDDSPAASDPTPPPPPPALPQAAPRPPGGAHLRSLSLDAAFFDGLAFQGGGGGGGAGSGSSGGGAGHKRSGSMDGESSLFEGESAPPDYAKKAMPADRLAELALLDPKRAKRILANRQSAARSKERKIKYTGELERKVQTLQTEATTLSTQLTLLQAYWDAMIIKSVSLFLVVFILNCEYRYSSVLANCTFQDKQGHYKAIEIKESKYIYPDKQSNLLRKPSLFNAALNDALREEVQRLKIAAGQVPNMNGNSFNGGLQQQQQQQQMPTYFSQQQQMHYLSGHQGRHHHPNNPHNSLNGGQSMSGQTLNDSMDFM

SEQ ID NO: 1471 - protein, 933 aa, Arabidopsis thaliana
MNNIEATLFLCFFCIFSSSNVHFAGAKQTAGNITPSENPFTPKASLIRYWNNHINGDSPKPSFFLSKASPLTAVDSTRFASLASNHALNTHHSDFCSAAKLFCFPELAAHSLEKHGDDVNFAAYSGKNFTNYGSDRLSGADSFKNYSGGDNIAVDSFRRYSRNSAGHDDGFTNYAGEVNVADQSFTTYATGTTGGSGEFTNYNTDANEPNGRFTSYSDKANGRSQTFTTYSENGNTGYQSFTSYSKNGNGAPNEFSGYGTGSNVVNTGFTKYGESANGANDSFTSYGENGNVPVNEFKGYGDGGNGAVYGFKNYRDQSNIGVDSFSSYAKNSNNEKVNFVNYGKSFNLGSDNFTGYGQDNVGGNVSFKTYGQGQSFKVYTKDGVVFARYSNNVSSNGKTVNKWVEEGKFFREAMLKEGTLMQMPDIKDKMPKRTFLPRNIVKNLPFSSSTIGEIWRVFGAGENSSMAGIISSAVSECERPASHGETKRCVGSAEDMIDFATSVLGRGVVVRTTENVVGSKKKVVIGKVNGINGGDVTRAVSCHQSLYPYLLYYCHSVPRVRVYETDLLDPKSLEKINHGVAICHIDTSAWSPSHGAFLALGSGPVPLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRLLFEAEISFLLAKHFYTTSDSLPRNVLLPAYGFCSPDKQEEDEFYPVTIMISEGKDWPSYVTNNVYCLHPSELVNVHDGKFHDNGICIFANRTCGVTDKCNEGYWKIKHREKLIMSRYGQTIGWKKVFQFYETEKERHFGNGEEVKVTWTLKEYRLTRKMNKNKVVCVIKYKVKCLPRITS

SEQ ID NO: 1472 - protein, 98 aa, Populus nigra
  misc_feature (86)..(86): Xaa can be any naturally occurring amino acid
MKEKKKGKLPKEARQQLLDWWSRHYKWPYPSESQKLALAESTGLDQKQINNWFINQRKRHWKPSEDMQFVVMDAGHPHYYMDNVLXNPFPMDISPTML

SEQ ID NO: 1473 - protein, 351 aa, Glycine max
MDGGCVTDETTTSSDSLSVPPPSRVGSVASAVVDPDGCCVSGEAESRKLPSSKYKGVVPQPNGRWGAQIYEKHQRVWLGTFNEEDEAARAYDIAALRFRGPDAVTNFKPPAASDDAESEFLNSHSKFEIVDMLRKHTYDDELQQSTRGGRRRLDADTASSGVFDAKAREQLFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAVQFFKSTGPDRQLYIDCKARSGEVNNNAGGLFVPIGPVVEPVQMVRLFGVNLLKLPVPGSDGVGKRKEMELFAFECCKKLKVIGAL

SEQ ID NO: 1474 - protein, 284 aa, Picea abies
MEHMNTTAQSSSSLYGVHMVEYGGDVGVGSMMALMTEHQPESESIMTSIPIPSSYSSYSHGHGHGHGHGHGHGQSECLLSAAAMFQSSRPCQGANKFEPANAHIGGGGAGHFVMEQFIPEQAVISDSSISSVKTEVCSGSGGNGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 1475 - protein, 106 aa, Aspergillus nidulans FGSC A4
MPKANPTRKTKATRETGGRKKKDPNAPKRGLSAYMFFANDNRDKVREENPGISFGQVGKMLGEKWKSLSDKERKPYEDKAAADKKRYEDEKAAYKAGEAEEDEESS

SEQ ID NO: 1476 - protein, 140 aa, Populus trichocarpa x Populus deltoides
MGAPKQKWTAEEEAALKAGVLKHGTGKWRTILMDPEFSAVLRLRSNVDLKDKWRNINVTAIWGSRKKAKIALKRRPLTPKREENAKALSTVVQTNEEVVDAKPLAFASGTPGNGGPKDLLARLYTSDICTSCFAELGCIF

SEQ ID NO: 1477 - protein, 134 aa, Arabidopsis thaliana
FFYLLSFLGLIRKLISTMFKIIGLPDFLEPEPVSTSWPDPPPTLTKPDSAAILAGEMLPVVRFSDINRPESECCAVCLYDFENDDEIRRLTNCRHIFHRGCLDRWMMGYNQMTCPLCRTQFIPDHLQLEFNQRL

SEQ ID NO: 1478 - protein, 189 aa, Zea mays
MAITHDDYVSLCLMALAAAGGGGHAAAASARTTTTMTTQECELRFRCSVCGKAFASHQALGGHKASHRKPPPPLAQAPSSSSSVTTNTSSAGGSGAGQGRHRCSVCHRGFATGQALGGHKRCHYWDGLSVSLTASAASGSASSLRGFDLNLVPAAGAARWREEEEVQSPLPVKKRRLSSGPSTELSLTI

SEQ ID NO: 1479 - protein, 433 aa, Picea mariana
MEHLNTAAAQASSSLYGVGMAEYGDAGVSSMMALITQHEPHDSESIMSTRMPSSFSSFHGHADCLLSAAMFQASQGDHKLKRQPGMDQLVSEQAVMSDSSMPSVKTEVCSGLRNQFEFHREQTGNCYTDQSPNTPVNPLVTSLASQARGEAQMIPSLDANSPHFNVDNEEYAIKSKILAHPQYPSLLGAYIDCQKIGAPPEAVARLDALTHEYQNQQRRTVSIGMDPELDQFMEAYCEILTKYHEELAKPFKEAMTFLMKIEAQFNSLGKGTIRISPPAENDEKTEGGGSSEEVEDGSGGETDFQEVDHHAVEDRELKDHLLRRYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 1480 - protein, 442 aa, Picea mariana
MKKLFHSDMEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYCEMLTKYHEELTKPFKEAMSFLKKIEAQLNSLSKGTIRISPSAENDEKTEGGASSEEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 1481 - protein, 237 aa, Populus trichocarpa
MEMASSARTVEEIFKDFSARRAAVVRALTHDVDAFYGLCDPDKENLCLYGHPSETWEVALPAEEVPPELPEPALGINFARDGMNRKDWLSLVAVHSDSWLLSVAFYLGARLNRNERKRLFSLINDLPTVFEVVTERKPVKEKPSVDSGSKSRGSIKRSSDGQMKSNPKLMEDSYEDEEDHTETLCGSCGGNYNADEFWIGCDVCERWYHGKCVKITPAKADSIKQYKCPSCMKRSRS

SEQ ID NO: 1482 - protein, 266 aa, Arabidopsis thaliana
MGGVKRKIAIEKIQNKNPRAVSFSKRRKGLYSKASELCLLSDAEIAIIATPVSSNSNAAFYSFGHSSVDNVVAAFLANQRPCDERFWWEDESLLKSENLEELREAMDSMSTMLRDLKELEKQRDHQTQTLIHQPCSARVCIQDYVTVNFDGFNTEEQTLAVSDNSNNNGLLGNLDECNEDFDDLDQIFDTVTNSEFLSVNLEMDDVTVNSEGNTEEQTLAVSDNSNNNGLLGNLDECNEDFDDLDQIIEYLTSSEALSMNLKMDDV

SEQ ID NO: 1483 - protein, 446 aa, Solanum habrochaites
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIDIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFVVEESRSSPARAYDSSNPANQACVKLELFPEDNDFVKEGSDEASSTQCLKLFGKTVLVTDAHKPPTDETLTRSSFPAKYLPWDSECPQSTFSIVPPTPSYYFPTPNGSPGPNQSGVATHLPWGSSCAVPCTQVHSPIPMKGRPLFNDRDLEGKEAQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 1484 - protein, 390 aa, Picea sitchensis
MTRKCSHCGNNGHNSRTCPNRGGVKLFGVRLTDGPIRKSASMGNLMMMASPSSPADPSEPASAAAAAAAAAADGYLSDGLVEASTSSNSRERKKGVPWTEEEHRMFLLGLQKLGKGDWRGIARNFVITRTPTQVASHAQKYFIRQSNMTRRKRRSSLFDMTPDPSATAVSVEDYSKVSSIDPICDSSVQNQILPTGHTVCDSSSQNQILPTGHTVCDGSAQNQILPTSLSSAFNQGPLVESNNGAPLSSQTASDQEFESNNSENTAEAETSFSQGVAAMACGVPMVFPGFMAPLLPFPFPMWPGFRPATTELPPNSNIFKPRAEIPKAPMNIIDETGISKLSIGDPPGSIEPSGLSLKLLNKSSRQSAFHTNPALSDSGFSSSSNAIHVV

SEQ ID NO: 1485 - protein, 431 aa, Zea mays
  misc_feature (213)..(213): Xaa can be any naturally occurring amino acid
  misc_feature (233)..(233): Xaa can be any naturally occurring amino acid
MIATTGGSSAKAAAVGGKAARACDGCLRRRARWYCAADDAFLCQGCDTSVHSANPLARRHERLRLCPASPLQTPPARSAAAATATNKRERHDEVAVPAWFGRKARTPRGGHAKSVGQVALSRRLVVPHAAGGDSDSPDERNGGEEEQLLYRVPILDPALAEFCSPPPLEDPAKPDPAAPLAQFCPVGGHFNFGPTDAELREFAADMEALLGHXLDDGNEEESSFYMETLGLLXPMEVGDDATQVKVETDGSSACCEASGTLACGLELDLEASDEMLDIDFDYASPQDTATDERAASSDTGADAQFLQTSLSLTLNYEAIIQSWGSSPWTGGGERPHVKLDPRWPHDYTNMWVVGGVVGPGGEDLPGTPRLGMDGGREARVSRYREKRRTRLFSKKIRYEVRKLNAEKRPRMKGRFVKRATAGGSLAIAGLA

SEQ ID NO: 1486 - protein, 342 aa, Zea mays
MGVPKQRWTPEEEAALKAGVAKHGPGKWRTILRDSDFSALLRLRSNVDLKDKWRNLSVTAGGYGSREKARMALKKGRRVVPKLTAEPMDVDEKDMDNAHDTVIDVEPLAMAFEPLPLLESPDKSVARLDDLIVEAIRKLNEPSGSNKAVISGYIEDQYWPPADFQYLLSTKLKSLVNSGKLIKVNQKYRIAPSSSLGGISTKVSSSEGMNTENNNVKRLTKPQVVAELEKMKGMTREEAAAFAAKAVAEAEVAMAEAEEAARVAEAAENDAEAAKAFLDAVILSMRNRNTFAASASFSAASATLAASSASAIATSASATALAAKAAASSLVMPFIFSSSATT

SEQ ID NO: 1487 - protein, 513 aa, Zea mays
  misc_feature (296)..(296): Xaa can be any naturally occurring amino acid
MSLATLLLPSPGSMATKAGTAGDHHTDSRRHDHDHHGSKCKKKPPASPQPSSLASAPRTPPSGARSQRVMVMAASSSSPRKKSPKAPAAGKNSRAQYQQHRGQATKKKATAAASWDWEQVKSLLSCRSVTAAARVHDPAAPSALARLRGSGAGTCGASLCAMRDVVDAASSAASSAAASASASGDRDTAPLNRRRAHRGASSSSAGAGSSHHSSLRGLSGCYECRAINVEPMSRRYPRPRELCACPQCGEVFTKADTLEHHQAIRHAVSELGPEDSGRNIVEIIFKSSWHKRDRPXICHIDRILKVHNAPRTVARFEAYRDAVRSRCRAVVAARAAADGNELLRFHSAPLACALGLGGATALCCAAADADADAPAPPCGVCTAIRHGFAPWLGAHPLGVRTTASSGRAHDCASDNNNPSPPPPHQTQSAASDVSNAAACRAMLVCRVIAGRVRRDGDGDTSAAAGEDQEGPFDSVAGEDAASSSVYGNLEELFVANPRAILPCFVVIYRVLDS

SEQ ID NO: 1488 - protein, 446 aa, Solanum habrochaites
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFVVEESRSSPARAYDSSNPANQACVKLELFPEDNDFVKEGSDEASSTQCLKLFGKTVLVTDAHKPPTDETLTRSSFPAKYLPWDSECPQSTFSIVPPTPSYYFPTPNGSPGPNQSGVATHLPWGSSCAVPCTQVHSPIPMKGRPLFNDRDLEGKEAQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 1489 - protein, 966 aa, Physcomitrella patens subsp. patens
MQNCPAVQLLETVGSLHMGGGGGYHRAKVLSHHNIRVQSNLCIMEYNLNGTVKPLLYNSPWSTSTQNLGFCRKLQSHLGSLVITWLWNVWMAPPTGRSWVLRWHYSCDSGHQNEPVSVSNSGSGPTLVVLCLDNEYIVLFSSVTLASSGCGFLLDHAPDGVQRGDRTKPAGLYLSVGPGDYRSGSRKRTTQIFTCEGRLQEWPETKDEHSTEPGGVVSQVSEVGNITLCIDEDLHAVERHLIQNEEKDKRCWVQEDEIRRTKGRARADQGDVSWASFGDSGRKEEGDATKISTFLALVFLTTECSPTCCPLTSPRSNLAVDRRLKPWLQACVLFHLFIELNRFSFRARQCVRRPHSPLGRPVENACDMDRESTSWSNLPECERELQVRIRSHASDLERNPTSLPETPTSPAILLQENNVSGQLLSSKRVRLIQNMHRYNSPNNMTYDDSRYFNGNQESTFDVENEAPETAGRNMMLNFGGAMDRLDPSASFPGLGELPSNGMEPAVEQNLTGTFTGDLNSTAYEVGDDHSHLLQEMLQQHPQSQQAQSTDAHSQAPATASHGSWEDSLHVLQEMVHLQQQQQQQVHQIYNQTQTEHAFNQGYNADRFRSAAFGGSAKFPGESDLLNLFQFPRSTTTSAIPSFGYTAGIRGKGPLYSTSTISGPVNTGSIYENRGIGYDPLLAHHLQNSSESFFHNLSRGNTPETSRHGGPNILVDLDQEREDLSGKNVASAYGSKRDHGAASGKGEPRGVNHFATERQRREYLNEKYQTLRSLVPNPTKADRASIVADAIEYVKELKRTVQELQLLVQEKRRAAGDSSGGKRRRSMDDADNYAGSCTTENASNGHLVMQKGNDTFSTDGSQLRSSWLQRTSQNGTHVDVRIVHDEVTIKVNQRRGKNCLVFDVIAVLQELQLDLLQASGATIGEHDVFLFNTKILEGSSTFAGYIAVKLLDALDRHLDITIDDSNR

SEQ ID NO: 1490 - protein, 235 aa, Zea mays
MKVQCDVCAAEAAEVFCCADEAALCDACDRRVHRANKLAGKHRRFSLLSPAPPPPPPLCDICQDKRGLLFCKEDRAILCRDCDVSVHTASDLTMRHARFLLTGVRLSAEPAAACPAPEDEEEEDHENSSGSFCCSAGDAAAHPPPLPSSAPATSHGSDSSSISEYLTKTLPGWHVEDFLVDEAAAAAATDIGVSAADASYQVGAAVRVSVRPFLSRAGLSAPIAYPDSRARRRRH

SEQ ID NO: 1491 - protein, 412 aa, Arabidopsis thaliana
MDPRLIVATQIGSIDELYAHIHENPYILEIIDAIPFINTPLHIASASGNLSFAMELMNLKPSFARKLNTYGLSPLHLAIEEGQTRLVLSLLKVDSDLVRLRGREGMTPFHQVVRRGETDLMTEFLLACPGCIKDANVNGETALHIAVSNDRYEELEVLLGWVQRLRQTDAESLEMQFLNKRDQDGNTALHIAAYQNRFKAVKILVKCSAVNRNIHNRTGLTALDILHNQRDHHANSNIENIIRKWGGKSGNSLPKSKKVSEILRSPISFTEHLFTQTARYRNQTSEGTRSALLVIAALIITATYQTALQPPGGVYQENAAEESKKSVAGEGYVWWFLWIAVPLYVSYLVSMSVISPDTVWYVSTNAGSVIIVVFAYMVVFFLRWKRSKKKVPGTSSELILEGLTTLDLAKGS

SEQ ID NO: 1492 - protein, 108 aa, Schizosaccharomyces pombe 972h-
MPRAAKSSRKKDPNTPKRNMSAFMFFSIENREKMKTDNPDATFGQLGSLLGKRWKELTSTEREPYEEKARQDKERYERERKEYDTKLANGEKTGKASAPAAAAAAKEE

SEQ ID NO: 1493 - protein, 454 aa, Arabidopsis thaliana
MPRPKRPRSNIAPSSPDSSMLTREGTTKANMDPLPASGLSRVLQGQEYSTLRTKHTESVECDAPENSVVWQSSADDDKVDVVSGSKKYGSENWMSSARHEPTYTDLLSGFGTNIEPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQKNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNQGTLSCRSEEEAVVGEGSDAKDAKSASNPSLSSAGNS

SEQ ID NO: 1494 - protein, 369 aa, Physcomitrella patens subsp. patens
INSELWHACAGPLVSLPPVGSQVVYFPQGHSEQVAVSTQKEADTHIPNYPNLRPHLVCTLDNITLHADLETDEVYAQMVLIPSQDPDKETMLLPDAVVQNKQPTEYFCKTLTASDTSTHGGFSIPRRAAEKVFPTLDYNQQPPAQELVARDLHDQDWHFRHIYRAGQPRRHLLTTGWSVFVSAKRLQAGDAVLFIRDDKGQLLLGIRRANRLQTMMPSSVLSSDSMHIGILAAASHAAQTSSRFTIFYNPRQSPSEFVIPLAKYQKAVYSTQVTVGMRFRMVFETEESTVRRYMGTVTGIGDLDPVRWPNSHWRSLKVGWDESTAGERQRRVSLWEIEPLTTPFLSCPPPLASRSKRARGIHGKTLLSF

SEQ ID NO: 1495 - protein, 224 aa, Oryza sativa Japonica Group
MTSMRGKGRRRERRRKRRAEERSCSVVCGMSLTHSLNNFFFFFFFFFFFFFFFFFFFFFFILSWTTKNIMGFPVGGYSGVPRLLLHLLFLLTHLRRLSSCLLRLAGADIDDSPTAVDAEYDGSYSYSSQSSQLLELDDHSPALRFDALSSSLQPPLHVATCAVCLRDFHKSAQVRRAHRCRHVFHRACLDAWAHHGHRTCPLCRSPLLPSSAPPVLLPLPLPAS

SEQ ID NO: 1496 - protein, 89 aa, Populus balsamifera
YFMDNNDGSSSSVKAKIMAHPHYHRLLAAYANCQKVGAPPEVVARLEEACASAASIAPTNTGCIGEDPALDQFMEAYCEMLTKYEQELS

SEQ ID NO: 1497 - protein, 391 aa, Glycine max
  misc_feature (34)..(34): Xaa can be any naturally occurring amino acid
VSSQTISRVPVQVDSFDKLPTSLDKNPLTNQTEXQSLQLQKVQLSNLVSGDTEHQEESAMADASPRTDISTDVDTDDKNPRFDRSQSLVAVASDSSDRSKDKSDQKSLRRLAQNREAARKSRLRKKAYVQQLESSRLKLTQLEQELQRARQQGIFISNSGDQAHSMSGNGAMAFDVEYARWLEEQNRQINELRAGVNSHAGDTELRMIIDGIMAHYDEIFRLKANAAKADVFHLLSGMWKTPAERCFLWLGGFRSSELLKLLVNQLEPLTEQQLVGITNLQQSSQQAEDALSQGMEALQQSLSETLSTGSLGSSGSSGNVANYMGQMAMAMGKLGTLEGFIKQADNLRQQTLHQIHRILTTRQSARALLAIHDYFSRLRALSSLWLARPRD

SEQ ID NO: 1498 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNFNNNAGSPIRPYKQRYLLKNRANSSTSSENPSLTPLISNLIMTAKFQKFLLMTKKKKKPDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRVKK

SEQ ID NO: 1499 - protein, 92 aa, Populus deltoides
CYFMDNNDGSSSSVKAKIMAHPHYHRLLAAYANCQKVGAPPEVVARLEEACASAASIAPANTGCIGEDPALDQFMEAYCEMLTKYEQELSKP

SEQ ID NO: 1500 - protein, 249 aa, Brassica rapa
MSNNDGVMISNGSLIEHQRQQQQQNLKQSSDGALVVKKPPAKDRHSKVDGRGRRIRMPIICAARVFQLTRELGHKSDGQTIEWLLRQAEPSIIAATGTGTTPASFSTASVSVRGSSTTISTSTNCTLSSSLDHKPFILGKRLREDSGGGKDEMGSFATPAGFWAVPARPDFGQVWSFASHQEMFLQQQQQQQQQPAAAALFVHQQQQQQAAMGEASAARVGNYLPGHLNLLASLSGGAPGSGRREDDQR

SEQ ID NO: 1501 - protein, 93 aa, Populus nigra
GCYFMDNNDGSSSSVKAKIMAHPHYHRLLAAYANCQKVGAPPEVVARLEEACASAASIAPANTGCIGEDPALDQFMEAYCEMLTKYEQELSKP

SEQ ID NO: 1502 - protein, 465 aa, Aspergillus oryzae
MADVGDRMFCHACGGVWLRRDHGLECPHCHSEFTEIIEIPPDTEEEVPDPPTSVPEDRSAPPRNPWADHNPWDHDNMNTDTPDWGSGNGFRHHTYRSPDGRFTFSSTTYTRRGSSGQQMPVDPLMPMVRGLDTIFHGLADTYRQTEYRQPNERDSSPGLWRTDRQNQGFGPNGSRIYSTSFDIDMNTRSNGGVGSEFHTTGGLHPRDADGPQPMGTPLRTLGEYVLSLGCGEIEKVTDLYSILELFRADFGNNGPPGGGPGVRVMTGPNPIAILSTLLNLDRHGDAVYSQEELDRVISQLIDQNARGTAPPPAAPNEIQSLPKKKVDQEMLGSEGKAECSICMDPVELGTEVTVLPCKHWFHYNCIEMWLSQHNTCPHCRRGINIPAGPEGSSDNPVVINSSPETSPRRPSGAAPEHSGQSPPRWNGPGPETGGQEQDQGQSSRNDNQGGGFAGWVRSHFGGGNQ

SEQ ID NO: 1503 - protein, 204 aa, Arabidopsis thaliana
MMSSQTSSHNKLIKLPQRFFFLHKQFFLHKQILLFVVVMAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 1504 - protein, 329 aa, Oryza sativa Japonica Group
MQEPKHTDPAAMRGAHHRRARSEVAFRLPDDLDLGGGGAGAFDEIGSEDDLFSTFMDIEKISSGPAAAGGSDRDRAAETSSPPRPKHRHSSSVDGSGFFAAARKDAAASLAEVMEAKKAMTPEQLSDLAAIDPKRAKRILANRQSAARSKERKARYITELERKVQTLQTEATTLSAQLTLFQRDTTGLSAENAELKIRLQAMEQQAQLRDALNDALKQELERLKLATGEMTNSNETYSMGLQHVPYNTPFFPLAQHNAARQNGGTQLPPQFQPPRPNVPNHMLSHPNGLQDIMQQDPLGRLQGLDISKGPLVVKSESSSISASESSSTF

SEQ ID NO: 1505 - protein, 917 aa, Arabidopsis thaliana
MDLKTLNQFSPLTKLTVPNHRDVQVRTDQLITYERSKRKSSLHDDEDLISKRRCLDFQRKIEDNECANDGVFVAPPRFKSGQVSIRQRSDAPLSSQAVKHDEFANDAFYKPWLDSFRLKRQRLGDDEDPSSSSSPSEVDIAALTLLQFSCDRRHPQTQTLTRPQPQTHKTQLQRPPPQLQSQTQTAPPKSDLFKCSICEKVFTSYQALGGHKASHSIKAAQLENAGADAGEKTRSKMLSPSGKIHKCDICHVLFPTGQALGGHKRRHYEGLLGGHKRGNDEAVLKLSPNSNKSVVTKVLDAEQSLRASDNIHKRNQDEVVPSRDKWSLSNVSVVKNVLDLKLSLGESDGGHKDSQDEVVVHEDKCSPSSNGSIVTNVSDPEQSVRRLIDLNNPPSLEFDQSRGGDVEEVEKEVVLALSSQMKQPSKDVSALIKRLEFAMQERKDGLLADDNVLIEMIMELEGNISTTNGDDEDPYSEGRLIKVIEPIGLDEDDECVEIGLGSCEQEPIQERFGDDKDPSSDHGNVESIRLEEEDAVLFEPWLKSRLKSRDREQSQRQGFGEYEDCFSERRFLQEEEEECFGDDEDSFSDQISFLESNRLEEEFEEEKEAARFSNDNDFVELLFQGIEQSKSKPKPKSCSYYDDDDDDDDDGDEDDDDDDDDVDPSSKDIRLEEENECENRAVIRPSLNSVAPNQQRFGDDEVPSSSSSLSKDETAALCPTPHSQTQPQSQTQLQKVTQPQTQMLPKSDSYQCNVCGRELPSYQALGGHKASHRTKPPVENATGEKMRPKKLAPSGKIHKCSICHREFSTGQSLGGHKRLHYEGVLRGHKRSQEKEAVSQGDKLSPSGNGSVVTHVPDPKQSRKGLIVINKVPSPEFNDPGDKDILEGESALLANKLEQDRGITSTRMINGLKFFNFL

SEQ ID NO: 1506 - protein, 136 aa, Triticum aestivum
  misc_feature (70)..(70): Xaa can be any naturally occurring amino acid
FPVQEAPDLLHNLNQQALGGQHSSRSPSPPKQNADAGMRIKATFGSEKVRFRLKPECSFQELKQEMARRXLSIVDTSFLIVKYLDDDLEWVLMTCDADLQECLHVYKLANLQTVKISVHLAPIPEARVTIGHTGLS

SEQ ID NO: 1507 - protein, 570 aa, Zea mays
MDLHQLLKYRLTGANVYYEFPTENNLANTPWPASPLKSEFSSSSYTPLSSQLECDNLSALSNTPDNQSSTETISAQSISPLEVDSSYKQAAILRENTQVRPDPLYTTSRHNMQHALREIETVLMAPDADDAATSTKHEFEEHKPAQLMRQRSRTWSHESRQPSPGVVRTQLASGYPTASYEFRPEKRLRELREDPQSMVKQLLTKCAEALSEERIEEFLNLVQQARGVVSITGEPIQRLGAYLLEGLVARHANSGTNIYRALKCREPESNELLSYMKILYNICPYLKFGYMAANGAIAEALRNEDRIHIIDFQIAQGTQWITLIQALAARPGGPPHVRITGIDDPVSEYARGEGLDLVGKMLKSMSEEFRIPLEFTPLPGIYATQVTKEMLDIRSGEALAVNFTLQLHHTPDESVDVNNPRDGLLRMVKGLSPKVTTLVEQESHTNTTPFLMRFTETLDYYSAMFESIDTNLPRDNKERINVEQHCLAKDIVNIIACEGKDRVERHELLGKWRSRLTMAGFRPYPLSSYVNSVIRKLLACYSDKYTLEEKDGAMLLGWKNRKLISASAWH

SEQ ID NO: 1508 - protein, 252 aa, Oryza sativa Japonica Group
MPGELNFHLLHSLDAAAAAASSTAASASSQPTVDYFFGGADQQPPPPAAMQKRSRATAGFHGGGPANGVEKKEKQRRLRLTEKYNALMLLIPNRTKEDRATVISDAIEYIQELGRTVEELTLLVEKKRRRREMQGDVVDAATSSVVAGMDQAAESSEGEVMAAAAMGAVAPPPRQAPIRSTYIQRRSKETFVDVRIVEDDVNIKLTKRRRDGCLAAASRALDDLRLDLVHLSGGKIGDCHIYMFNTKVTTTN

SEQ ID NO: 1509 - protein, 59 aa, Vitis vinifera
MSEQEEDLIYRMYRLVGDRWDLIAGRIPGRKPEEIERFWIMRNRQGYAERGKEASQKKQ

SEQ ID NO: 1510 - protein, 281 aa, Glycine max
  misc_feature (164)..(164): Xaa can be any naturally occurring amino acid
  misc_feature (199)..(199): Xaa can be any naturally occurring amino acid
MGSASVTKAPPSSSSSPNSSSTESLDGLKFGQKIYFEEVSVAAAAATTTQGGNKTRGGVSASKKGRGGSVQAPRCQVAGCKVDLSGAKAYYSRHKVCAMHSKSPTVTVAGLEQRFCQQCSRFHLLSEFDQGKRSCRKRLAGHNERRRKPPPSSILTSRYGRLSXPIFDNNGRDDGFLMEFASYPKLTLRNTLPTQRSTXSRLLGNHAATLTWQGGSDTPSEFFLQGSGSSGGTSFLNSKHPLVESYTGVTDSNCALSLLSSQTLGFRNTAPATKFELNNNL

SEQ ID NO: 1511 - protein, 156 aa, Physcomitrella patens subsp. patens
RKPRGRPPGSKNKPKPPIIITRENGQAMRPHILEIAGGCDVGDSVASFSRRRQRGVHVLGASGIVSNVTLRQPTTPGATVTFHGRFEIISLSGAFLPHLTSQPTTGLTVTLAGAAGQVLGGSVVGTLMAAGPVLVIAASFLGPTYERLPLDPDDEG

SEQ ID NO: 1512 - protein, 238 aa, Glycine max
TVCPTTLKRICRQHGISRWPSRKINKVNRSLKKIQTVLDSVQGVEGGLKFDPYTGGFIAGGSIMQETEAHKYLVFPEKSSVKDPKPATQKKVSVAPAPASTIENSTIKLNDDEGVCLVGNKLVHSRSIPNSNSGEGELKKDNVSSDDSKSMTMNDGSCHKACHWKKTKDCPEQTCSMSLVTDEVEVGVDRVEGADEHNHPTSSSTTNSSNGSGSMMHGSSSCSHENHKYSKVKSNCVD

SEQ ID NO: 1513 - protein, 443 aa, Solanum chmielewskii
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDLVVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQCGAATHLPWGSSCAVPCTQVHSPIPMKGRPLFNDRDLEGKGTQKEGSSTGSNAESVDAEYLEIEAQSSPNVVEELVRVRASVPSLFERRANSTKRVKGFVPYKRCLAERGVSSSTLTGEEREEQRTRLCL

SEQ ID NO: 1514 - protein, 380 aa, Medicago truncatula
MGHLHFATEIMTLKPSFALKLNPQGFSPIHLAMQNDQKQMVYRFVKINKDLVRVIGRDGLTPLHFASQIGEVDLLAHFLFSCPESIEDWTVRCETPLHIAIKNEQFESFQVLVGWLEKNKRRGAKERKSRILNERDEAGNTILHIAALSSEPLVVQELLSLVKTKINLHKKNLENKTALDIASIPEIKSILFSAGSKPSLEVTDAPSPTHWLRSKTTLMDKFFSQNLFSRTNITGEERNAWLVVATLIATTMYESTLSPPGGVYQISADDNNLNITSSNSTISTLKNVGKSILSKTDFTTFSVLNMFSFFMSFLTIIIMTPTREPGIFVYPAMFFFLMCYMTSMSEISPASVDPMNAQATFVFTSLMFGFVIIMKITLKS

SEQ ID NO: 1515 - protein, 275 aa, Gossypium hirsutum
MAFPPHAFMFQPHEDHHNDHLPSPTSLNFLPSCPPQLFHGGGAPFMMKRSVSFSGVDKSEEVHGDDELSDDGSHLGEKKKRLNLEQVKALEKSFELGNKLEPERKVQLAKALGLQPRQIAIWFQNRRARWKTKQLEKDYDALKKQFEALKADNDALQAQNKKLNAELLALKTKDSNETSCIKKENDCSWSYGSDKNSCDVNLDISRTPLTSSSKHLFPPSVRPTSMTQLLQGSSRPDLQCVKLDQVVQEESFCNMFNGVDEQQAFWPWSEQQSFH

SEQ ID NO: 1516 - protein, 650 aa, Oryza sativa
MGLCQSRLERQEAVSRCKARRRYTKQPPPPPPLSPTPTTTSWTTNSSSISASPILPPPPPPPMPSSWDFWDPFAPSSSRSATEDAEWDDAATTIVDAPNAPPVVTVAAAAAPPPSVVTATTTTSTASELTVVAVPRGGGGAGKKDLAEIATELDEYFLKAADAGARVAALLEAPNCEPPETNNSSFPGKTISKSVTRLSSILLTFHLFLTNYLLHATEIDECCREGTELRQELEADGMVMGRKRVQQSGILSHSSTVEKLYAWEKKLFLEVKCSVASVSMICAMLLEFIEVKGSFQLYYYHGRDFLVLSMTAQLAQSYEGLKQEHDKKIGLLRKQEVKGVDYLKMEKNKMEIESLDSKMLVATQSIETTTSEIMRLRESELFPQLLELVAGLMSMWRGMYECHQVQTHMVQQLEYLNNSLSTNPTSNVHRQAALQLEIEVDRWYSAFCSLVKSQRDYVYSLTGWLRLSLFQSYHDPYNKAHQNSDIYSLCEEWQLAIDRIPDKVASEGIKTLLTVIHAVVVQQAEEQKQKKRSESAFKELEKKAEELRSLESKYGPYSGAEGYGDMSRKSPVSDKRAKVEALRCRADEEKSKYEKSIGVTRAMTLNNLQTGFPNVFQAMTGFASVCMEAFESVYNFKSSDRILDSKRLLT

SEQ ID NO: 1517 - protein, 176 aa, Perilla frutescens var. crispa
MAADEEPNTSLNKGAWTADEDGILAQYVAQHGPKRWKSLAIDAGLNRCGKSCRLRWLNYLRPDIKRGNFSDAEDDLILRFHRLLGNRWSLIAKRIPGRTDNEIKNYWNTHLRKKARLMEKLPAISVTAAMELNIWHDESSSSGTEIRDDDESFDFTAQGTSGLDWVKTFLELEEDA

SEQ ID NO: 1518 - protein, 134 aa, Brassica napus
MDDPSNTTKSNQCPPPLSTAPPTSTPFRGPYHRRAHSEVQFRLPEDLDLSEPFGGFEDLGSEDDLFCSYMDIEKLGSGSDSAGPSAPRSDNPFSEAGDSRPRHRHSLSVDGGSSTLESIEAKKAMAPDKLAELW

SEQ ID NO: 1519 - protein, 211 aa, Elaeis guineensis
MSTDTGRSSTESEVSGLDYEETELKLGLPGGSRTAGSETEKKRGFAETVDLSLGAESRSGDLGDRSTGDFGSGAGKPPAVKAQVVGWPPVRSFRKNALKSCTYVKVAVDGAPYLRKVDLEMYGGYQQFLTAIEDMFSCFTVRNCPNERRLVDPVNGTEYVPTYEDKDGDWMLVGDVPWKMFVASCKRLRLMKSSEAINLAPRTPQGSTRAR

SEQ ID NO: 1520 - protein, 423 aa, Arabidopsis thaliana
MAVEDDVSLIRTTTLVAPTRPTITVPHRPPAIETAAYFFGGGDGLSLSPGPLSFVSSLFVDNFPDVLTPDNQRTTSFTQLLTSPMFFPPQSSAHTGFIQPRQQSQPQPQRPDTFPHHMPPSTSVAVHGRQSLDVSQVDQRARNHYNNPGNNNNNRSYNVVNVDKPADDGYNWRKYGQKPIKGCEYPRSYYKCTHVNCPVKKKVERSSDGQITQIIYKGQHDHERPQNRRGGGGRDSTEVGGAGQMMESSDDSGYRKDHDDDDDDDEDDEDLPASKIRRIDGVSTTHRTVTEPKIIVQTKSEVDLLDDGYRWRKYGQKVVKGNPHPRSYYKCTTPNCTVRKHVERASTDAKAVITTYEGKHNHDVPAARNGTAAATAAAVGPSDHHRMRSMSGNNMQQHMSFGNNNNTGQSPVLLRLKEEKITI

SEQ ID NO: 1521 - protein, 223 aa, Oryza sativa Japonica Group
MARERREIRRIESAAARQVTFSKRRRGLFKKAEELAVLCDADVALVVFSSTGKLSQFASSNMNEIIDKYTTHSKNLGKTDKQPSIDLNLEHSKCSSLNEQLAEASLQLRQMRGEELEGLSVEELQQMEKNLEAGLQRVLCTKDQQFMQEISELQRKGIQLAEENMRLRDQMPQVPTAGLAVPDTENVLTEDGQSSESVMTALNSGSSQDNDDGSDISLKLGLP

SEQ ID NO: 1522 - protein, 369 aa, Nicotiana tabacum
MDLVLAQSPLFMIPPGLSPSGLLNSPGFLPPLQSPFGMSHQQALAHVTAQAAFSNSYMQMQAEDQCSSQVASAEALGHELTTELKEASLQLKEPSQTRMDSEPSDKQGKKFELQEFSQSENKPSFVAIEKPACDGYNWRKYGEKKVKASECPRSYYKCTHLKCPVKKKVERSVDGHITEITYNGRHNHELPQTNKQRKDGSALVGTDCSEVRPEHDSPVMNSSDGSSHTRSDRVSNQMVSELLVKSEYDETKNVLVAVDEGHDGPNAKRTKTAVKTLPSSHGTVAESKIVLQTRSEVDFLDDGYKWRKYGQKVVKGNQHPRSYYRCTYPGCNVRKQVERASSDPKTVITTYEGKHNHDIPTVRNRNSQR

SEQ ID NO: 1523 - protein, 402 aa, Phaseolus acutifolius
MDEALGSSCSLPPFLAKTYEMVDDLSTNSIVSWSVSSKSFIVWNPPEFARDLLPRFFKHNNFSSFIRQLNTYGFKKIDPEQWEFANDDFVRGQPHLMKNIHRRKPVHSHSLQNLQAQGPLGDSERQGFTDGIEKLKRDKERLLVELQKFQHEWQTYEIQIHCSNDRLEKLEQKQHKMVSSISHVLQKPVLAVNILPLTETMDRKRRLPRSGHYYDESSIEDAIETSQMLPRENAENTTVLTLNVERLDQLESSVAFWEAIAHDIGDNFAQIQSNMDFDESTSCADSPSISCAQLDVDVRPKSSGIDMNSEPTAAAVPDPLASKDQPAGITVAATGVNDVFWEQFLTEDPGASETQEVQSERKDCDGRKNEGKPNDHSKFWWNIRNANNLSEPMGHVGQAEKT

SEQ ID NO: 1524 - protein, 405 aa, Oryza sativa
MAAAGNSFLNQELVKVADGVSDWHLPSSSHGGATMVPQQQQTQAAGSNDNPGLVKGGWTREEDEVLRQMVRHHGDRKWAEIAKSLPGRVGKQCRERWTNHLHPDIKKDIWTEEEDRMLIEAHQTYGNSWSAIAKQLPGRSENTIKNHWNATKRSLNSKRRLRKKNSEQTVPGQPSLLESYIRSCQHMLPSETVPPPPAPFDISRYGNSGVIGASPTLPVVQEPGTSTPPGLVMFLDLLNQAIPHPPQPETMDLFNMTPEVSHLNTSGYCLQLDAGGNLYYGRLPAPAPVQPHGISTQELQDTPQLSLYYPLSSFAGSHTDGTVEFNHQLSNPNGGHYGEEAGPSSVATGGSANGMDDNDVVQMASNQFMMPSEDEGNSFLNQELLMVVNNMTDRHIMRSHGGASY

SEQ ID NO: 1525 - protein, 356 aa, Streptocarpus dunnii
GSAGNVNMTSSFKGANSYMGFGDNVNGLCPMMMMMPANDPNGDCSQPLFLPLPAANQQGINRNSSSAAACGGSMMPEHQSNTSTGYYFMEGDGVAGGGSVKSKIMAHPHYPRLLAAYVNCQKIGAPPEVVAKLEEACASTITIGGRNERSCVGEDPALDQFMEAYCEMLTKYEQELSKPFKEAMLFLSRIECQFKALTLSHSSDSGACGEAVMERNGSSEEEFDVNNSFIDPQAEDRELKGQLLRRYSGYLGNLKQEFMKKRKKGKLPKEARQQLLDWWSRHYKWPYPSESQKLALAESTGLDQKQINNWFINQRKRHWKPSEDMQFVVMDATHPHYYMDNFIGTPFPMDISPSFL

SEQ ID NO: 1526 - protein, 358 aa, Streptocarpus rexii
MEGSAGNMNMTSSFKGANSYLGFGDNVNGFCPMMMMMPANNPNGDCSQPIFQPLPAANQQGINRNSSSAAACGGSMMPEHQSNTSTGYYFMEGDGDAGGGSVKSKIMAHPHYPRLLAAYVNCQKIGAPPEVVAKLEEACASTITIGGRNERSCVGEDPALDQFMEAYCEMLTKYEQELSKPFKEAMLFLSRIECQFKALTLSHSSDSGACGEAVLERNGSSEEEFDVNNSFIDPQAEDRELKGQLLRRYSGYLGNLKQEFMKKRKKGKLPKEARQQLLDWWSRHYKWPYPSESQKLALAESTGLDQKQINNWFINQRKRHWKPSEDMQFVVMDATHPHYYMDNFMGTPFPMDISPSFL

SEQ ID NO: 1527 - protein, 317 aa, Arabidopsis thaliana
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTNLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 1528 - protein, 353 aa, Streptocarpus saxorum
MEGSAGNLNLNSYRGANSFMGFGDNVNGFSPMMMMMHANDPNGDCSQPIFLPLPAANHQGINRNTGGGGGLTPEHHSNMSTGYYFMEGDGDAGGSSVKSKIIAHPHYPRLLAAYVSCQKIGAPPEVVAKLEEVCASATSTGCRNERSCVGEDPALDQFMEAYCGMLTKYEQELSKPFKDAMLFFSRFECQFKALTLSHSADSGACDEAVLEQNGSSEEEFDVNNSFIDPQAEDHELKGQLLRKYSGYLGNLKQEFMKKRKKGKLPKEARQQLLDWWSRHYKWPYPSESQKLALAESTGLEQKQINNWFINQRKRHWKPSEDMQFVVMDAAHPHYYMDNIMATPFPMDISSSFL

SEQ ID NO: 1529 - protein, 548 aa, Oryza sativa Indica Group
MGFFRRIAGMFGISRDDADHHPHHHHHDGAAGDSAAAAEVPQDKVVAAAAAAAAAGNVQRRGFSVQVPVPVERPGPGPVLVPCPQGDGGVQGFRWYTRKLRIDEDGDVADEFLDEVVPEISINNDSTPAGRYQVKYNTKSAALAMRKQISVIDGDICHSLEYQGRLRWNCQSLLAKGLQEFDMRVCLGASQECGSVEFLVDASFLNLSVLGCLMGTNDPGTPSKATKASEPEQSPATTSGTTAPVYPEWPGFQAYSAIPPHGFFPPPVAASPQAHPYMWGAQGVHPFNHYPMLANGNVETAGTAPGASEINGKNELGRTSGPSANGITSHSESGSESESEGSDANSQNDSHSKENDVKEDGSSQNGISHTALNQNMSMAPTQTGVVIGGVAPTTNLNIGMDYWGAAGSSPVPAMHGKASSGSVRGEQWDERELKKQKRKQSNRESARRSRLRKQNIMDSLIEAPKYLFQAECEELSVRADNLRAENSSLRAELERIKKEYEALLSHNASLKEKLEGNSDSIPYMNEQNDTNGTHQKQQDSDAQPNDAP

SEQ ID NO: 1530 - protein, 246 aa, Dendrobium nobile
MGRGRVQLKRIENKINRQVTFSKRRSGLLKKAHEISVLCDAEVAVIVFSNKGKLYEFSTDSSMEKILERYERYSYAERALFSNEANPQADWHLEYHKLKARVESLQKSQRHLMGEQLDSLSIKELQHLEQQLESSMKHIRSRKTQLILDSISELQKKEKILLEQNKTLEKEIIAKEKAKALTQIAPWEKQNLSQYSSAPLHVISDSVPTPTSRTFQAIANEEESPQAQLRVSNTLLPPWMLGHMNG

SEQ ID NO: 1531 - protein, 355 aa, Zea mays
MSVLYMRNNMSNRATHWCYACRRPIRLRGQDIICPNCNDGFIQEISEMGGVLNTYGLIEPDFEERQARRFGMMDAISSLMRQRLSEIGRDSLFDIHGRQGTGTEYGRRSTAIPTLVFGGIPSPAVGSSDVNVVIREGRRAGAARPNFSSLVVGPSLEALFEQLLLQNNRQGPPPAPQSAIDSMPVVKINRRHLDEDPQCAVCKDKFEVGAEAREMPCKHLYHTDCIIPWLVQHNSCPVCRHPLPSQRSGSSTSSARVPSAYYNETACPPAVARADFDPVPSAYYNETATDPPAVTRADFDPAPGNYGSESQESHDPFSFLWPFGPSSSYQYEENVDEPAVYDPNQIAYSAWHYDH

SEQ ID NO: 1532 - protein, 470 aa, Zea mays
  misc_feature (65)..(65): Xaa can be any naturally occurring amino acid
MQLDLNVAEAPPPVEMEASDSGSSVLNASEAASAGGAPAPAEEGSSSTPAVLEFSILIRSDSDAXGADEDEDATPSPPPRHRHQHQQQLVTRELFPAGAGPPAPTPRHWAELGFFRADLQQQQAPGPRIVPHPHAAPPPAKKSRRGPRSRSSQYRGVTFYRRTGRWESHIWDCGKQVYLGGFDTAHAAARAYDRAAIKFRGVDADINFNLSDYEDDMKQMGSLSKEEFVHVLRRQSTGFSRGSSRYRGVTLHKCGRWEARMGQFLGKKYIYLGLFDSEVEAARAYDKAAIKCNGREAVTNFEPSTYHGELPTEVADVDLNLSISQPSPQRDKNSCLGLQLHHGPFEGSELKKTKIDDAPSELPGRPRQLSPLVAEHPPAWPAQPPHPFFVFTNHEMSASGDLHRRPAGAVPSWAWQVAAAAPPPAALPSSAAASSGFSNTATTAATTAPSASSLRYCPPPPPPSSHHHPR

SEQ ID NO: 1533 - protein, 283 aa, Physcomitrella patens subsp. patens
MELVPANGAQSASSNQDIPSAYGATFSSDGGVSSADPKPRLRWTPELHERFVDAVERLGGADKATPKSVMRVMAVKGLTLYHLKSHLQKFRLGKQLHRDSSGHEGAKGGSADIQVTISACSDGPSTPKPQNQESFQISEAIRMQMEVQRRLQEQLEIQRQLQLRIEAQGKYLQSILEKAKEALGSHIGASPGLETVHAELTELASKVNSEPMNMCFPPLTLPELPTQSADARIGNLPRQESRVSDSSSQKSHVTNGAANPEDSGGASASCENQASIGIQKFET

SEQ ID NO: 1534 - protein, 321 aa, Avena sativa
MMTMDLMGRYGRADEQVAIQEAAAAGLRGMEHLILQLSRTGTGTGTSESSLAGASEPAAQGQQQQQQVDCREITDMTVSKFKKVISILNHRTGHARFRRGPVVAQSQGPSVSEPAPVRTASSSRPMTLDFSKSASVFGNKDAAYSVSAASSSFLSSVTGDGSVSNGRGGGSSLMLPPPPSASCGKPPLAAAAAGPKRKCHEHAHSENVAGASGGRCHCSKRRKSRVKRMTRVPAISSKAAEIPADDFSWRKYGQKPIKGSPYPRGYYKCSTVRGCPARKHVERDPSDPSMLIVTYEGDHRHTPGDQEAAAALTPLPELHKL

SEQ ID NO: 1535 - protein, 300 aa, Oryza sativa Japonica Group
MGAPKQRWTAEEEAALKAGVAKHGTGKWRTILRDPEFTALLRLRSNVDLKDKWRNLSVTAGGYGSRERARVALKGGKRGPKALAEPMDADEKNPDIDDNAIIDAQPLAVVVEPMQLESTPEKEKSVARLDDLILEAIKKLKEPSGSNRTTISSYIEEQYWPPEDFQRLLSTKLKALVATGKLIKVNQKYRIAPSSNSSGGKSIKVYSTGEMNIENNNVRQLSKPQVDAELDKMKSMSKEEAASFAARAVAEAEAAIAEAEEAARAAEAAEAEADAAKAFLDAVVTTMQNRNHASAMLRAC

SEQ ID NO: 1536 - protein, 501 aa, Avena sativa
MAMTPPTSFPPASPSSYFNNMSTGFLDSPILLTPSLFPSPTTGSFPLEPLNWMGTAPESNDGLQLGSVKDGQQRQYSGFTFQTTAAPVPAAMPGTNTTASSFLQSSMPMAQQGHDSYTGEQQQPWSYQDAGSMDAMTTRPASFSTPYEAPDMVGNGGYNNAPVSSSGTTAGYGRVQSRRPSSDDGYNWRKYGQKQMKGSENPRSYYKCSFAGCSTKKKVEQAPDGQVTEIVYKGTHNHPKPQNPRRSSAPASSSYASPDASSDALSGTPENSSASYGDDETNGVSSALAGQFGGGGEEFADNEPDSKRWRTDSDAEGVPVGANRTVREPRVVVQTMSDIDILDDGYRWRKYGQKVVKGNPNPRSYYKCTTAGCPVRKHVERASQDLRAVVTTYEGKHNHDVPALRGSAAAAARYRAAPMQAASYLQGGGGGYSSLRPDGFGGGAPAQPADQSGFALSGFDYNNSSYSYSGMQQQNDAMYYDAARTKDEPRDDMFFEQSLMF

SEQ ID NO: 1537 - protein, 227 aa, Zea mays
MEQTDEASSVNEQSAERHSTAWLDLTLAVSASLPAPDDGDSSSAGGSNDGDPANNKPGSPPPDPAPAPAPPKVFSCNFCMRKFFSSQALGGHQNAHKRERSAAKRSATTPSSASAYRYHHLHHAQRMAIAGLPLEAHAALVRAALRVSPASAAIHKDASQELAAATTSTAPRFHDGDVSATAAAQWAPAQLCEEPVSSTWPGSFRTRTQAEPPSPEQSQKMDLDLRL

SEQ ID NO: 1538 - protein, 233 aa, Pinus taeda
MGRTPCCEKAHTNKGAWTQEEDARLVAHIQAHGEGGWRSLPKAAGLLRCGKSCRLRWINYLRPDLKRGNFSEQEDELIIKFHSRLGNKWSLIARILPGRTDNEIKNHWNTHIKKKLVRMGLDPKSHLPLGEPRDSNTTYTVLASPKHKIPPFQSPRTPDIADFFQYDRSGSSTMELVASKAEEHPELNLDLSISLPSHSTPATTRASTVHRTVDSNSNSGSGLWCLTGMEAIS

SEQ ID NO: 1539 - protein, 534 aa, Pinus taeda
MGRHSCCYKQKLRKGLWSPEEDEKLVRHITKYGHGCWSAVPKQAGLQRCGKSCRLRWINYLRPDLKRGTFSPQEENLIVELHSVLGNRWSQIATHLPGRTDNEIKNLWNSCIKKKLRQRGIDPNTHRPLSEVNAEAGDSKNDNSNKKVETQAAMDESHVSAGNEFKHLNAIPRADTANPKFFHVPVEDNTLIASDSQAMLQNGFINSNSTTTTTTATSTASAANFSLPKEFFLERFNSVNATPTSVEAGFNFINQTTSTQGFTGERDQKLIDNPVLWVLQAPNRSVGFPTENLMPWPGQGLAKAVSDAFSDFSSDVCDYNSIMANPSMYRPGPCLSSLLYSERSLDQDLLDNAGTNCMNGSGAAGSAQYWDNTDNNNNNNVRSSSRSSSCNSSTANLEVNNGAAFGHFWGFGERLDATDITSENERKAPLFLERADQSEYAVKWSEMLPPFSSHTQEETLPIYITTDSKSQDLVSSENINNPNHAALNSAIFPISWQQLQNTEYPVLGDRTATMLSTPLSDPDFHRIAAVLDQI

SEQ ID NO: 1540 - protein, 174 aa, Zea mays
MAPRTSEKTMTPAAAAAATGLALSVSGGAGASGPHFRGVRKRPWGRYAAEIRDPAKKSRVWLGTFDTAEEAARAYDAAARDYRGPKAKTNFPFPSSCMPLAAGAGAGSLPAAKAVTGGGGSRSSNSSTVESFSSGSDVQAAPMQAMPLPPSLELDLFHRAAAAGTGTGGAAVRF

SEQ ID NO: 1541 - protein, 217 aa, Glycine max
MDLQRQEPCPSENLNIITFSDTVPCQNPSINTQTKTNQTQMEDQKHQHDSVPRVLLDLSLSSNKDSGDDNSKLKPELNLLNCFHTNFSENSSESSQGNELDPRVFSCNYCQRKFYSSQALGGHQNAHKRERTLARRGYKAGAADFGHTYSNIHFLPSHGLYNKALGIQVHSMINKPSYQTPFFGLCRSNNGWQRQPLDSQPAIGNFRVAETESSSLA

SEQ ID NO: 1542 - protein, 374 aa, Pinus taeda
MAMSNGRLCEDLDRIKGPWSPEEDASLQRLVQKYGPRNWTLISKGIPGRSGKSCRLRWCNQLSPQVEHRPFTPSEDAAILQAHAQHGNKWATIARALPGRTDNAIKNHWNSTLRRRCRDPEKGIVVHLDDEISSLDAARKRSSDGFSHDGSSALEDNGCSSWEVDSKRLKRLGELGTEQGPEVEAEVEVSDRSDANPGRVLYRPVPVVSFFSSFGKTVANLQETAAGAVGVDPPTSLSLSLPGLDPAIPSPKLSTQKDSHNNSTVNNNIPIPPVVEYMRADEAVVERLSTAVKATVASMLTPVLNSSPRGYNPPAVSSDVLALMRDMVAKEVQKYMSSHHQPGMYTPLSPHPEFLGAANLVRNVVLGGALHLNK

SEQ ID NO: 1543 - protein, 250 aa, Solanum tuberosum
MGRGRVQLKRIENKINRQVTFSKRRSGLLKKAHEISVLCDAEVGLIVFSTKGKLFEYANDSCMERLLERYERYSFAERQLVPTDHTSPGSWTLEHAKLKARLEVLQRNQKHYVGEDLESLNMKELQNLEHQLDSALKHIRSRKNQLMHESISVLQKQDRALQEQNNQLSKKVKEREKEVAQQNQWDQQNHEINSSTFVLPQQLDSPHLGEAYQNTNVVDNGEVEGGNSSQQQGAANNTVMPQWMLRHLNG

SEQ ID NO: 1544 - protein, 150 aa, Nicotiana tabacum
QDGILKYMLKMMEVCKAQGFVYGIIPEKGKPVTGASDNLKEWWKDKVRFDRNGPAAIAKYQADNAIPGKNEGSNPIGPTPHTLQELQDTTLGSLLSALMQHCDPPQRRFPLEKGVPPPWWPTGQEDWWPQLGLSKDQGPPPYKKPHDLKK

SEQ ID NO: 1545 - protein, 140 aa, Triticum aestivum
  misc_feature (118)..(118): Xaa can be any naturally occurring amino acid
MPDSELNSPASSSASPPPSPTTAGGGVLEKRERDSGGNGAGGRHRGYRGVRMRAWGKWVSEIREPRKKSRIWLGTFPTPEMAARAHDAAALVVKGPAAVLNFPELASSLPRPASAAPXDVQAAAARAAAMDLASVGAGVS

SEQ ID NO: 1546 - protein, 238 aa, Oryza sativa
ENTMNRQVTFFKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 1547 - protein, 542 aa, Zea mays
MSARDSNHSYKCSDDSQMPYYNNSAPVGENGRIHMAENSLGHHYSSSDIGSQRINNSNPQVFEAQYCTLESSSANGVYPAQSSTSSHSISPLSGSPLSQHDSHSDHTYSSPPSASCLTEVADLLGREKELENSGVGPGLDISSDCSRSLLQAHVPVRPDNWRQLLGINGGDLMQVVIACGKAVAENDVFATELLISELGHLVSVSGDPMQRLGAYMLEGIVARLSSSGSMLYKSLKCKEPTSSELMSYMHLLYEICPFYKFGYMSANGAIAEAIKGENFVHIIDFQIAQGSQWVTLLQALAARPGGPPYIRITGIDDSNSAYARGGGLDIVGRTLCDVANSCGLPFEFNAVPAASHEVELQHLAIRHGEIIAVNFAYQLHHVPDESVSTENHRDRIIRMIKSINPRVVTLVEQESNTNTAPFFPRYMETLNYYTAMFESIDVALPRDDRRRMSAEQHCVARDIVNLIACEGAERVERHELFGKWKSRFAMAGFRPYPLSSVVNNTINTLLHTYNSYYRLEERDGVLYLGWKNRVLVVSSAWC

SEQ ID NO: 1548 - protein, 242 aa, Panax ginseng
MSFYDDQSGNLSPQRKLGRGKIEIKRIENTTNRQVTFCKRRNGLLKKAYELSVLCDAEVALIVFSTRGRLYEYANNSVKGTIERYKKACTDSPNTSSVSEANAQFYQQEASKLRQEISSIQKNNRNMMGESLGSLTVRDLKGLETKLEKGISRIRSKKNELLFAEIEYMQKKEIDLHNNNQYLRAKIAENERAQQHMNLMPGSSDYELAPPQSFDGRNYIQLNGLQPNNHYSRQDQTALQLV

SEQ ID NO: 1549 - protein, 1232 aa, Chlamydomonas reinhardtii
MASDLANIFNDEEAGSDRANSITSSDLDPFLLQGDDQTWAVEDWNWDPFNMFAAPKETPNVACCQALKRRKVTEQSATSAPQQAAQQHHQHAACQPCHGASGSRAGPPAAPTAACCSMAPGVQQHAPAPAPAQQLTGPLQTALNSMMPGQQQQRVADACGVSNMCHAPGMVAPPPPMPVAAPLAATGHQAGGMGMGHMNPAMGHMGWPAMPDMSNPAAAAAAAAAAASFFPTMGAGGRGPLATMGWGAQPMALQMPSMGLPGFPGGHTQCAPALQMPAVAFPTPSSGIFHQQASMAVPPSALPSPALGCSGDTTSLQGSADNCAKPPCCSGNRATGPTCSGGRQQADSSNKAAPPPPKQPAQNTVGARGGAAAPAPGDLSDFNISDSEDDDEVARRPSAAGTQRGGVGNAAALNAAAYANLGDIVSLQDVGDDTGAMVCQVPGCGKDLTNLKEYHQRYRICDVHIKLQQVLKDGRLQRFCQQCGRFHDLTAFDGNRKSCRDQLSKHNARRRRRAQAEQAKGRAAAQEAAVAAAGAMAAAAAVGGAAGGAPAVPGFEGGDVGKLLACLMQNPTQLHALRLLLGVPTHPALPAAAPAAGLGMAAGGDTAAQPDQARTYGLARDILAGRNEFSPAFESEHRMIRLSMKLFNKTPADLPHDLRNQVTSWLASAPLAMEASIRPGCVFLTVQMLVDEAGAQQAAAPGALHGLVEHLLTRTGCPFWHMGMYTVQMGTDMLLVRDGKMAGDANVNASGAAAPAATGEGAEAAARVRGDGRFPVVRRLGPLAAVAGQPTVLKLHGLNLDAPGCSVILRWGNKHLKAHMQALSTHRAIVRLPPLPDLCGPVWVEVARGAYLSPAKQLLVARNEELVQEINKLDVKTGPLRHDTVELLLQDLALVLQHIAAQPGVAAQLQHAVIALKARRLLAMACDMGWAAVASAVLPLACARCSCASEMVAAIHSASTPSQTGAADKRGLTLLHRAVRSGSVSLLAGMLAWGDSHGYRWRVDAEGPAGITPLHLSAMLDDARIGLLLLDHCGWPAAFTHLRSDGGVTPFHLAFQMGHYQVDALMSALGGLHQVADPNNAAAINNAAAAAAAAMSPSRRSRCGNAAAMGCKPDPDEDVKPDLAALQRGGRNGGGGSGGCTELDPCENCHCTLPPLLLSIMASCTDCGRRRMCMETECNNAAQRCGDCGCGGARPTARVDSGEVCSSRQHGTIFSITALCQGCHANRTLAVA

SEQ ID NO: 1550 - protein, 922 aa, Pisum sativum
MEYGGGIVDDGGVFGTMVGGDQGDIIEELLGEGCWIEASENNMMAMQQTASPPQQHYIGNNIPIGMGEGDHFNHHQVDQESGFVVGKRWWIGPRGSQGPSTSVKERLVVAVGYLKEYTKNSSNNVLIQIWVPALRRRSAIHYLQQDSSSSVPVSVNPNMNVHVRFFRSHEYPRHQQQQQQYGSLLALPVFERGSGTCLGVIEFVIANQNLINYRPQLDHLSNALEAVDFRSSHNMNIQPAVKVIFEELYEAAVNEIVEVLASVCKTHNLPLALTWAPCIQQQGGGKGTTGGGGCSVSVTVPTDQMNNNNHMMMSCISTVDSACYVGDMEVLGFQEACSEYHLFNGQGIVGTAFTTTKPCFAIDITAFSKAEYPLAHHADMFGLHAAVAIPLRSVYTGSAADFVLEFFLPKDCRDTEQQKQMLNSLSLVVQQACRSLHLHVVMEDDNANHHEDQDQFTFPTTTNNYMPSSASDAATTASLSQVDAASGCSTKDTTSSSCSWIAHMMEAQNKGKGVSVSLEYLQEPKEEFKVTTCNWEREGNSVFSEFGQVIQHDQSSNSRASVEAGEESGGGGTGGGRRSSSSSSGRKSGDKRRTKAEKTISLPVLRQYFAGSLKDAAKSIGGCPTTLKRICRQHGITRWPSRKIKKVGHSLKKLQLVIDSVQGAEGAIQIGSFYASFPELSTAAAHGGGGGGDHINNNSFYNSHGDLVTNLKSPPSACSQTHAAGNKSIINGDHHHHHHQHLVMTENLAAPSAVDALMQHASTINIQDYQQLQEDHDTKQLLLHFNNNNNNSNNQTLPPRPTVTWNNNNSSSSGLLERGAFRVKATFADEKIRFSLQAVWCFRDLQLEIARRFNLNDMNNLVLKYLDDEGEWVVLACDSDLEECKDLHTSSHTRTIRLSLFQASPLNNLANSFRNNSSSPSS

SEQ ID NO: 1551 - protein, 241 aa, Glycine max
  misc_feature (27)..(27): Xaa can be any naturally occurring amino acid
  misc_feature (155)..(155): Xaa can be any naturally occurring amino acid
SRELMSKQVSAKTCEAVKPKDGDCKLXGFSLISGPTLPEPSLSQRNVSEAADQMHLTAHQQRTSENDEKLDHSKGSRPVDDIVVDDQDRPLRTSQLHTKDVQAKPLSGSARSCTKVHKKGIALGRSVDLTKYSGYDELVAELDQLFEFGGELFVXKKDWLIVFTDNEGDMMLVGDDPWQEFCAMVRKIYIYPKEEIQKMSPGTLSSKNEENHSVTASEGADAKVVKCQPHQKFNSENGLDA

SEQ ID NO: 1552 - protein, 924 aa, Pisum sativum
MEYGGGIVDDGGVFGTMVGGDQGDIIEELLGEGCWIEASENNMMAMQQTASPPQQHYIGNNIPIGMGEGDHFNHHQVDQESGFVVGKRWWIGPRGSQGPSTSVKERLVVAVGYLKEYTKNSSNNVLIQIWVPALRRRSAIHYLQQDSSSSVPVSVNPNMNVHVRFFRSHEYPRHQQQQQQYGSLLALPVFERGSGTCLGVIEFVIANQNLINYRPQLDHLSNALEAVDFRSSHNMNIQPAVKVVFEELYEAAVNEIVEVLASVCKTHNLPLALTWAPCIQQQGGGKGTTGGGGCSVSVTVPTDQMNNNNHMMMSCISTVDSACYVGDMEVLGFQEACSEYHLFNGQGIVGTAFTTTKPCFAIDITAFSKAEYPLAHHADMFGLHAAVAIPLRSVYTGSAADFVLEFFLPKDCRDTEQQKQMLNSLSLVVQQACRSLHLHVVMEDDNANHHEDQDQFTFPTTTNNYMPSSASDAATTASLSQVDAASGCSTKDTTSSSCSWIAHMMEAQNKGKGVSVSLEYLQEPKEEFKVTTCNWEREGNSVFSEFGQVIQHDQSSNSRASVEAGEESGGGGTGGGRRSSSSSSGRKSGDKRRTKAEKTISLPVLRQYFAGSLKDAAKSIGGPTTLKRICRQHGITRWPSRKIKKVGHSLKKLQLVIDSVQGAEGAIQIGSFYASFPELSTAAAHGGGGGGGDHINNNSFYNSHGDLVTNLKSPPSACSQTHAAGNKSIINGDHHHHHHHQHLVMTENLAAPSAVDALMQHASTINIQDYQQLQEDHDTKQLLLHFNNNNNNNSNNQTLPPRPTVTWNNNNSSSSGLLERGAFRVKATFADEKIRFSLQAVWCFRDLQLEIARRFNLNDMNNLVLKYLDDEGEWVVLACDSDLEECKDLHTSSHTRTIRLSLFQASPLNNLANSFRNNSSSPSS

SEQ ID NO: 1553 - protein, 921 aa, Pisum sativum
MEYGGGIVDDGGVFGTMVGGDQGDIIEELLGEGCWIEASENNMMAMQQTASPPQQHYIGNNIPIGMGEGDHFNHHQVDQESGFVVGKRWWIGPRGSQGPSTSVKERLVVAVGYLKEYTKNSSNNVLIQIWVPALRRRSAIHYLQQDSSSSVPVSVNPNMNVHVRFFRSHEYPRHQQQQQQYGSLLALPVFERGSGTCLGVIEFVIANQNLINYRPQLDHLSNALEAVDFRSSHNMNIQPAVKVFEELYEAAVNEIVEVLASVCKTHNLPLALTWAPCIQQQGGGKGTTGGGGCSVSVTVPTDQMNNNNHMMMSCISTVDSACYVGDMEVLGFQEACSEYHLFNGQGIVGTAFTTTKPCFAIDITAFSKAEYPLAHHADMFGLHAAVAIPLRSVYTGSAADFVLEFFLPKDCRDTEQQKQMLNSLSLVVQQACRSLHLHVVMEDDNANHHEDQDQFTFPTTTNNYMPSSASDVATTASLSQVDAASGCSTKDTTSSSCSWIAHMMEAQNKGKGVSVSLEYLQEPKEEFKVTTCNWEREGNSVFSEFGQVIQHDQSSNSRASVEAGEESGGGGTGGGRRSSSSSSGRKSGDKRRTKAEKTISLPVLRQYFAGSLKDAAKSIGVCPTTLKRICRQHGITRWPSRKIKKVGHSLKKLQLVIDSVQGAEGAIQIGSFYASFPELSTAAAHGGGGGGDHINNNSFYNSHGDLVTNLKSPPSACSQTHAAGNKSIVNGDHHHHHHQHLVMTENLAAPSAVDALMQHASTINIQDYQQLQEDHDTKQLLLHFNNNNNNSNNQTLPPRPTVTWNNNNSSSSGLLERGAFRVKATFADEKIRFSLQAVWCFRDLQLEIARRFNLNDMNNLVLKYLDDEGEWVVLACDSDLEECKDLHTSSHTRTIRLSLFQASPLNNLANSFRNNSSSPSS

SEQ ID NO: 1554 - protein, 59 aa, Populus balsamifera
ELHYKWPYPSETEKVALAETTGLDQKQINNWFINQRKRHWKPSEDMQFMVMDGLHPQNA

SEQ ID NO: 1555 - protein, 231 aa, Arabidopsis thaliana
MVKQERKIQTSSTKKEMPLSSSPSSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 1556 - protein, 227 aa, Nicotiana tabacum
SIIWGFTLEPKLTQVCPLSPNDVAASSTYVADQDLTRRRSSPISELGITNASSDPPETMLDKHNENNHPAELFPANPVDSSSDIAVPDSRALVIVPPVNLDALAMVPLNQKSKRSELSQRRIRRPFSVAEVEALVEAVEHLGTGRWRDVKMRAFDNADHRTYVDLKDKWKTLVHTASIAPQQRRGEPVPQDLLDRVLAAHAYWSQQQRKQHVEPLKILDTKARKVGA

SEQ ID NO: 1557 - protein, 924 aa, Pisum sativum
MEYGGGIVDDGGVFGTMVGGDQGDIIEELLGEGCWIEASENNMMAMQQTASPPQQHYIGNNIPIGMGEGDHFNHHQVDQESGFVVGKRWWIGPRGSQGPSTSVKERLVVAVGYLKEYTKNSSNNVLIQIWVPALRRRSAIHYLQQDSSSSVPVSVNPNMNVHVRFFRSHEYPRHQQQQQQYGSLLALPVFERGSGTCLGVIEFVIANQNLINYRPQLDHLSNALEAVDFRSSHNMNIQPAVKVFEELYEAAVNEIVEVLASVCKTHNLPLALTWAPCIQQQGGGKGTTGGGGCSVSVTVPTDQMNNNNHMMMSCISTVDSACYVGDMEVLGFQEACSEYHLFNGQGIVGTAFTTTKPCFAIDITAFSKAEYPLAHHADMFGLHAAVAIPLRSVYTGSAADFVLEFFLPKDCRDTEQQKQMLNSLSLVVQQACRSLHLHVVMEDDNANHHEDQDQFTFPTTTNNYMPSSASDAATTASLSQVDAASGCSTKDTTSSSCSWIAHMMEAQNKGKGVSVSLEYLQEPKEEFKVTTCNWEREGNSVFSEFGQVIQHDQSSNSRASVEAGEESGGGGTGGGRRSSSSSSGRKSGDKRRTKAEKTISLPVLRQYFAGSLKDAAKSIGVCPTTLKRICRQHGITRWPSRKIKKVGHSLKKLQLVIDSVQGAEGAIQIGSFYASFPELSTAAAHGGGGGGGDHINNNSFYNSHGDLVTNLKSPPSACSQTHAAGNKSIINGDHHHHHHHQHLVMTENLAAPSAVDALMQHASTINIQDYQQLQEDHDTKQLLLHFNNNNNNNSNNQTLPPRPTVTWNNNNSSSSGLLERGAFRVKATFADEKIRFSLQAVWCFRDLQLEIARRFNLNDMNNLVLKYLDDEGEWVVLACDSDLEECKDLHTSSHTRTIRLSLFQASPLNNLANSFRNNSSSPSS

SEQ ID NO: 1558 - protein, 657 aa, Coprinopsis cinerea okayama7#130
MATDSQMTVARAGKSLPPAPLSKATRQVVPAFLQKLYEMVNDPKNSDLIRWSDTGDSFFVLDHERFAHDVLGRWFKHRNFSSFVRQLNMYGFHKIPHLQQGVLKSDNETEFWNFAHPNFHRGQPDLLCLIQRKKASSQQVNNDDIDLRDSTPTANGQVLDIQSVINGITAIKRHQTTISAELNELKRSNQLLWQDAMAARQRYQKQQDTINRIVKFLAGVFGSTVNRTKDGSPEPHVVIPRRAARFLIEDAKREGKGIVELDDLYAPEDMATPISITSVESDNHVETTPVPQPAPVQPEPEPKPTDRAVTPRQPSPSYDFDPRVHGMLSQLTQSQIQTLLNTLASQPLGDANTASSNPTSSTHLTPYQPPPFDFSMIPSTPGTSNESHVPVVSPPAAPPTEGLISFNSFDGFPTERMERQWQQAEDIDRDVNALNTSIHSLIQTFGLDPNMFDSMDTSTDPTNPTNPAAPNPSVSIDHNAHPPTAPNVSAPSADTMAGPSGALSNDLGPVPPADFDFDAFLNTLPSASANDGMDYTDAASTAFLDEVPSPASTTTSPVQNLRGLSPEISTNGGSGLAVPQPVIPTANAGTKPPTASPGLGRKRKSDVSELDGGALAMQFQTVTPSAILPGVTGSPHLHSASLSTNAANSKSKRRKEK

SEQ ID NO: 1559 - protein, 264 aa, Euphorbia esula
FMDTNTSTTASVKAKIMAHPHYHRLLAAYINCQKVGAPPEIAARLEEACASAATMGPSGTSCLGEDPALDQFMEAYCEMLTKYEQELFKPFKEAMLFLQRVESQFKALTVSSPHSACAEANDRNGSSEEEVDVNNNFIDPQAEDHELKGQLLRKYSGHLCSLRQEFMKKRKKGKLPKEARQQLLDWWSRHYKWPYPSESQKIALAESTGLDQKQINNWFINQRKRHWKPSEDMQFVVMDATHPHHYYMDNVLSNPFSMDISPLL

SEQ ID NO: 1560 - protein, 166 aa, Zea mays
MASSGDEGRVVVDLGSAAESVAADEEAHATPLHEIESLCMRCGENGITRLLLTLIPHFREVVLMAFECPHCGERNNEIQFAGQLQPKGCCYSLEVPLGQSEMLNRQVVKSDSATIKIPELDFEIPPEAQRGTLSTVCFISFCICFVGKQFLSKCFLLLLAWLFFAL

SEQ ID NO: 1561 - protein, 249 aa, Ipomoea batatas
MVISSVWSGSSSRVRKGSWSEEEDQLLRECIQKYGEGKWHLIPLRAGLNRCRKSCRLRWLNYLRPDIKRGEFSPDEIDLILRLHRLLGNRWSLIAGRIPGRTANDVKNLWNTHLQKKVSAMASSRQDNYWKGKAPEITENTVVRPRPRRFLKASSSPTTLLTGNATMVAYDGQLQEHMTTQPETTSDLLMENVQQKNLTTTLPSALETTPHDNVKWWEDVLSDKELNEEGQICWSEFPTDIDLLSELLS

SEQ ID NO: 1562 - protein, 262 aa, Chrysanthemum lavandulifolium
MEDTRLELELPGFRFHPTEEELLGFYLKNMVLGNNTRVEIIGFLNIYLYDPWVLPDMSKIGEREWYFFVPRNKKHGNGGRPNRTTKNGFWKATGSDRKIFSLSDTSKHLGLKKTLVFYKGRAPGGHKTDWVMSEYRLPDSCPLPKDIVLCKIYRKATSIKVLEQRAAMEEAQHPPSPSSIDSQHLDLSAPQPVTSSHMASDSTNDTDKKPGLKLPMGAAKISELRLPKCDMDWSHDSQLRSPWLQNLIFTPPPYANMLNFLN

SEQ ID NO: 1563 - protein, 242 aa, Arabidopsis thaliana
MGRGRVQLKRIENKINRQVTFSKRRSGLLKKAHEISVLCDAEVALIVFSSKGKLFEYSTDSCMERILERYDRYLYSDKQLVGRDVSQSENWVLEHAKLKARVEVLEKNKRNFMGEDLDSLSLKELQSLEHQLDAAIKSIRSRKNQAMFESISALQKKDKALQDHNNSLLKKIKEREKKTGQQEGQLVQCSNSSSVLLPQYCVTSSRDGFVERVGGENGGASSLTEPNSLLPAWMLRPTTTNE

SEQ ID NO: 1564 - protein, 331 aa, Oryza sativa
MDAFSHVPPGFRFHPTDEELVDYYLRKKVALKKIDLDVIKDIDLYKIEPWDLQEQCKIGNEEQNEWYFFSHKDKKYPTGTRTNRATTAGFWKATGRDKPIYVKNCLVGMRKTLVFYRGRAPNGQKSDWIMHEYRLETNEYGAPQEEGWVVCRVFKKRVAAVQRAAGDGGDSPFWFNEHVAFMAPAPGLDSPYHGHRQSHPCKLEVEYHHHLLPQEAAPFMHLPRLESPKLPAADIIVATAASSALQPCGHTTAQQLQLQIEPVYVTADASAADWRDLDKLVASQFGHGDSTAKEPSYCNPVQVFQVEGKQEDSLDYVSTSASCGGEEDLWK

SEQ ID NO: 1565 - protein, 281 aa, Glycine max
MEDEMYGVSSTTEYSDGALMTPENIFPAEYHSFLMSSAARIPMFGSDELLSAVTAGNETEPYPGATIAPEIQRQNDASSLIKAKIASHPHYPRLLQAYIDCQKVGAPPEIACLLEEIRRENDVCKRDVVVSTCVEADPELDEFMETYCDMLVKYKSDLTRPFDEATTFLNKIETQLTDLCSGSSLLTLSDDGGVSSEEGFSAGDGDPQDGQLRSEDRELKDRLLRKFGSHIGYLKLEFSKKKKRGKLPKDARQTLLQWWNIHYKWPYPTEGDKIALAKSTG

SEQ ID NO: 1566 - protein, 857 aa, Oryza sativa Indica Group
MATAEVGGGGGEGDAAAAAVARAGGGGGGGGGGEDALFTELWSACAGPLVTVPRVGEKEFYFPQGHIEQVEASTNQVGEQRMQLYNLPWKILCEVMNVELKAEPDTDEVYAQLTLLPELKRQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKRNYSIGMRFKMRFESEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQTPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGLMMPNSHMDDTQPRLIKPKPLVVAHGDVQKAKGASCKLFGIHLDSPAKSEPSKSPSSVVYDGTPQTPGATEWRRPDVTEVEKCSDPSKAMKPLDTPQPDSVPEKPSSQQASSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNLRSEDSHANSMERGSVGREMRGCLSTSSLNSENC

SEQ ID NO: 1567 - protein, 134 aa, Arabidopsis lyrata
FLYLLSFLGLIRKLISTMFKVIGLPDFLEPEPVSTSWPDPPPTLTKPESAAILAGEMLPVVRFSDLNRPESECCAVCLYDFEKDDEIRRLTNCTHIFHRGCLDRWMMGYNQMTCPLCRTQFIPDHLQLEFNQRL

SEQ ID NO: 1568 - protein, 447 aa, Solanum pimpinellifolium
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDLVVEESRSSPARAYATSNPANQACVKLELFPEDNDFVKEGSDEASSTQCLKLFGKTVLVTDAHMPPTDETLTRSSFPAKYLPWDSECPQSTFSIVPPTPSYYFTTPNGSPGPNQSGVATTHLPWGSSCAVPCTQVHSPIPMKGRPLFNDRYLEGKETQKEGSSTGSNAESVDAELSGEKNMEIEAQSSRNVVEESVRASVPSLFERRANSTKRVKGFVPYKRCLAERGVSSSTLTGEEREEQRTRLCL

SEQ ID NO: 1569 - protein, 260 aa, Oryza sativa
  misc_feature (59)..(59): Xaa can be any naturally occurring amino acid
GTDSGGGAAGTGDGRLGLGRLRARRRLARDTAGDSRRTTRRAAARQVTFSMRRRGRNPXVSTRPEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEGQSSESVMTALHSGSSQSQDNDDGSDVSLKLGLPCGAWK

SEQ ID NO: 1570 - protein, 255 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRNDLELTLEPVYNCNLGCFAA

SEQ ID NO: 1571 - protein, 284 aa, Zea mays
  misc_feature (200)..(200): Xaa can be any naturally occurring amino acid
  misc_feature (237)..(238): Xaa can be any naturally occurring amino acid
MGRAPCCEKMGLKRGPWTPEEDKILVAHIHSHGHGNWRALPKQAGLLRCGKSCRLRWINYLRPDIKRGNFTDEEEQSIIQLHQLLGNRWSAIAARLPGRTDNEIKNVWHTHLKKRLDLSAQEQHEEASAAKKRKKPAAAARKREGKVKMRKLDALTAKAAPVLSSPERSVSSTVTESRHRPRAGEEQHGNSGSSASVRVXKEESFTSSSEAAEEFQFDDTFWSETLSMPLDSFDDVXXEPCSSGAFGDVAASSSSSSVGADADLDYWLGVFMKSGDAHQQLPQV

SEQ ID NO: 1572 - protein, 225 aa, Picea sitchensis
MCAEVSQSAMAVHTMQMARMEMKRDIGVCEVEASSAVKETHFRGVRKRPWGRFAAEIRDPLKKTRVWLGTFDTAEEAARAYDNAARNLRGAKAKTNFGPSPLHDSNALFNNGVARAASAQKQDCLPRPVFYSKQEPGVAVLPSPSDNLRAFTCVSIGDSLLNPPVETQTVSNKKKKPLFGTHLSVPSRNLQQQQNEEICRSPARPAPLWLDLNLPPAASDFDLHI

SEQ ID NO: 1573 - protein, 186 aa, Glycine max
MASDAKLSSSESLNGLKFGQKIYFEDVGFATPATSLTSSATTATTVTSSSSSSSRKGRGGSVQPAQPPRCQVEGCEVDLSNAKTYYSRHKVCGMHSKSPTVIVAGLQQRFCQQCSRFHQLPEFDQGKRSCRRRLAGHNERRRKPPPSSLLTSRYARLSSSAFDHSGRGGNFLMELASYPKLSLRNS

SEQ ID NO: 1574 - protein, 773 aa, Oryza sativa Indica Group
MDNNIDKLTPNWCAWKNDNNLCSGTSHEQRNHRLLTKQPPCKLKATEAKRKEMVFQKRSSLEMESGGGSHVAEMPRVPKSARGKRSIRKKESQGQVMCAFDLLATVAGKLLDEGEGSLGNASPKDVRVKQEQCDEEAKHFKNEVMDQDSCNESALVSHIAFQRPVNHHGRKGEDPEGSHAVIEDPKAKSEALDKESSMISCTKAELGCNFAAIADRWSPESVESGAFTGDAAAIAMPATTSGFHKNAPDMYNLLDPMDVDVKPPPLVSSDSTGEMPLYGNKIRRSTSFPRVPKGGAGFTVDRDEDDDDKSSGCTHPSTATNRGFRPNCTAGHSRVKKLLACKHRKVAPARMHKGDLSYSGEHCEIPFTFSFFEEHCIDGTHIQTCLLYSYLSSLILLDVDRKPSFRNKKMYYTRQRTQRSTFKRRKMFDRHSAQVSEEYAKANTKFAARDSHAVSLEANKGTNSTAFQKSQESSDCHVKLRIKSFKVPELLIEIPETATVGSLKKTVLEAVNAILGGGLRVGVLHHGKKVRDDNKTLMQAGISHDEVLDNLGFSLEPNCAPHPSQLSPPEDNEFMETVDTTEPLARIAPADSSSKHGEVDASQELALAPLSANYQGSDHDFVHSPGGMSSPDKASTNSRAIVPVTPADSNAGAIVPANKAKRSPEQGQRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPPLAEALLLT

SEQ ID NO: 1575 - protein, 223 aa, Triticum aestivum
  misc_feature (128)..(128): Xaa can be any naturally occurring amino acid
MAGDMCEGSIAGCELCGGVTGVHCAEDSGFLCVPCDAKVHGANFLVSRHLRRRLVHSAADEDAGSAGSGSGSESSSSSSCVSTADSCAAASAVTRAVGRSRVGCKHRRVRAEVVVEGWAKRMGLAAGXAVRRAGKAVGALRALGRGVSCSGVPIRVGMARLLWSEDGGSGCVEAFLHRRLEASLYFPGKLDDPGCPLAWGPPGFGAPVPRAQQRQGWPLSLQI

SEQ ID NO: 1576 - protein, 297 aa, Euphorbia esula
MIAFGDNSNGNGGGGLSPMMMMMPLTTASSHHHQHHNHHHHHHHHNADSSSNSLFLPLPLPHPPNQEHHNRNNTSTTGGSSSMILDDHNNTNSNSNTACYFMDTNTSTTASVKAKIMAHPHYHRLLAAYINCQKVGAPPEIAARLEEACASAATMGPSGTSCLGEDPALDQFMEAYCEMLTKYEQELFKPFKEAMLFLQRVESQFKALTVSSPHSACAEANDRNGSSEEEVDVNNNFIDPQAEDHELKGQLLRKYSGHLCSLRQEFMKKRKKGKLPKEARQQLLDWWSRHYKWPYPS

SEQ ID NO: 1577 - protein, 136 aa, Arabidopsis thaliana
MESKLTSVDAIEEHSSSSSNEAISNEKKSCAICGTSKTPLWRGGPAGPKSLCNACGIRNRKKRRTLISNRSEDKKKKSHNRNPKFGDSLRQRLMELGREVMMQRSTAENQRRNKLGEEEQAAVLLMALSYASSVYA

SEQ ID NO: 1578 - protein, 225 aa, Glycine max
MNNPSSPSPCAAFADFYEQWFEELQSLMQQLRGEGRKEEVMEKVMWHHQNYYVAKSAAAEKDPLNVFLSPWATTLERSLHWITGWRPTTAFHLIYTESSLMFESHIIDILQGLRTGDLGDLSPSQFRRVSDIQCDTVKEENAITEELSEWQDSVSEMMGPGANINDKIGRLVCIIKKADDLRLRTLRSVVGLLSPQQAIEFLIASAELLVGIRGWGLNHDRPRGR

SEQ ID NO: 1579 - protein, 284 aa, Picea abies
MEHMNTTAQSSSSLYGVHMVEYGGDVGVGSMMALMTEHQPESEIIMTSIPIPSSYSSYSHGHGHGHGHGHGHGQSECLLSAAAMFQSSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 1580 - protein, 191 aa, Arabidopsis thaliana
MGGTKRKIEMKRIEDKNVRAVAFTKRKSGLFHKASELCLLSPGTQIAILATPLSSHSHASFYSFGHSSVDHVVSSLLHNQHPSLPTNQDNRSGLGFWWEDQAFDRLENVDELKEAVDAVSRMLNNVRLRLDDAVKSNQRDGSLVIHQEDEEVLQLGYKDTNQITKLEGETSASASLLKNVVDNLHIDDRYY

SEQ ID NO: 1581 - protein, 246 aa, Oryza sativa
MGRGKVQLKRIENKINRQVTFSKRRSKLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHERIGLPPWMLSHING

SEQ ID NO: 1582 - protein, 545 aa, Oryza sativa Indica Group
MKEKEVLVEIVEDDELKRSIGRNQLDLNEEVMDVESEEGEVGDDEDDEDEEDDDDDDDGGSTTDVAGSRSSSNNSSTNNVSESKLKGDKDSGGGRLEGINGGEQRVPSVRQYNRSKLPRLRWTPDLHMAFVHAVERLGGQERATPKLVLQMMNVRGLSIAHVKSHLQMYRSKKLDHEGRQIRGAIASVFSPMDFHLMRGDRRFHDMLLQRAAALSSSRQEHGGFFSSRSGGGGGGLPPEASRLYGLLQHRQSPAIATMQTFDFKNSSFRNQEWSFSFNHQRKETMNPSSSSSTTAAIRRWPSAAGAVADVAGERQRLAERFGYYTGNGGASSTSLPLITRAAMAAPPPMFAAAVAPPGRDHHRLPFGWHAGGGGGCGGNKNRSSSDPVVIDEALDSRRLEHQQKHVEQPRTTPTPTTTPAGKRPPEWSPPDLQLTLSPTTAPAAADGGGAKRSKTSTTTTNTTAAISGEQEAEKNMDRCKNKLSISLSLSPPAAAAAAANFSSMDLSMEQQKQKQEKTTIGSSEEEAGDLGQSTLDLTMSIRALE

SEQ ID NO: 1583 - protein, 534 aa, Vitis vinifera
  misc_feature (148)..(148): Xaa can be any naturally occurring amino acid
  misc_feature (203)..(203): Xaa can be any naturally occurring amino acid
  misc_feature (466)..(466): Xaa can be any naturally occurring amino acid
  misc_feature (527)..(527): Xaa can be any naturally occurring amino acid
MEKSGEQMVDVRSVVEAISTDNEDAPLYQVESLCMRCTQNGTTRFLFTEIPHFRKILLSAFECPHCGERNNEVQFAGELQPRGCSYSLHFSAGDQKMLNRQVVKSESATIKISMVGKKFKDFVDRWRTIELIWEIPELDFEIPPEAQXGSLSTVEGILTKAVDDLQALQEERKHLYNLSYMVSQKVDSQTAEAIDQFLLKLKXCATGDSSFTFNLDDPAGNSFIENPFAPSPDPSLTIKFYKRSPEQQASLGYLVDSSQLGESCDEESIKEVKNTSDQMKREPHGSIGAAAGHRAIAQVNSAEIAENLFRYSTPEEVMTFPSTCGACAARCETRMFVTNIPYFQEVIVMASSCDGCGYRNSELKPGGRIPVKGKKITVCVKNVNDLSRDVIKHYLTVAMWTYQSDTAGVSVPELDLELASGTLGGVVTTVEGLITKICENLERVHGFTFGDSLDDSKRSKWQDFRXRLSKLLSLEEPWTLIIDDALANSFVAPTTDDIKDDHQLTFEEYERSWEQNEELGLNDMDTXSADAGYN

SEQ ID NO: 1584 - protein, 267 aa, Oryza sativa
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDHESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 1585 - protein, 447 aa, Solanum pimpinellifolium
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDLVVEESRSSPARAYATSNPANQACVKLELFPEDNDFVKEGSDEASSTQCLKLFGKTVLVTDAHMPLTDETLTRSSFPAKYLPWDSECPQSTFSIVPPTPSYYFTTPNGSPGPNQSGVATTHLPWGSSCAVPCTQVHSPIPMKGRPLFNDRYLEGKETQKEGSSTGSNAESVDAELSGEKNMEIEAQSSRNVVEESVRASVPSLFERRANSTKRVKGFVPYKRCLAERGVSSSTLTGEEREEQRTRLCL

SEQ ID NO: 1586 - protein, 345 aa, Physcomitrella patens subsp. patens
MGAPKQKWTAEEEAALRAGVEKYGPGKWRAIQKDSKFGPCLTSRSNVDLKDKWRNMSVSANGLGSARKPLAITGGPGMMTLMEDAVSVLPLAVLPPIDDAQALKRESADTSGDRKSLGSRYDDMVFEAVMGLKETYGSSNASIASYIEERHAVPSNFRRLLTTKLKELALAGKLVKVRQNYKMNEGNESPAPVVEEPEYRERENTIVVNDGRVQKESRLRRQDVQIEESNKRHPSRLPRDSWDPRDSSKKLRPESQPYKKPKTDIEHLARARAKTAEEAARAAAVAVAEAEAAAAAAEAAAREAEAAEAEAEALEAAAEVAAAAAIRPQKKLQGMAMMQEVAVNG

SEQ ID NO: 1587 - protein, 211 aa, Picea sitchensis
MAVDTMHMARIGVKMEIGGGEETASSPVKGTHFRGVRKRPWGRFAAEIRDPWKKTRLWLGTFDTAEEAARAYDNAARNLRGPKAKTNFAFHDDTAALFSNDVTRAVPAQRQEWPPRSAFCSKQEPGVISNIYAPSHALPSVAGNDRASSCVMAVENRAASAKKQKLLFGIHLFESSRNLQQQEDAVICSSSRRQPPFLLDLNLPPAANDVD

SEQ ID NO: 1588 - protein, 433 aa, Triticum aestivum
  misc_feature (78)..(78): Xaa can be any naturally occurring amino acid
  misc_feature (108)..(108): Xaa can be any naturally occurring amino acid
MSCSGKAADGAMGSKAARACDGCLRRRARWYCAADDAFLCQGCDTSVHSANPLARRHERVRLRPTSPLLPGCGPAGEXRGDEVVPAWFKRKARTPRSQAKSVGRLLSXRRLVVPQASGGDSPEEQKCDVETDEEELLYRVPIFDPALAELCSPLTLEEATTAVASCCNEDGAIVEDPTKPAATPSPVPVQFFPDSLVNLGPTDAELMEFAADMEALLGRPGMDDGDEEEPFCMEALGLIEPMDVDGGRVKLEIDPMRACGLEQKPEVSGDMFDIDFDYDSPLGTPDENAASSGASADAQFTPRSLALNLNYEAIMENWGSSPWADGERPHVKLDDCWPHDYYSLQEGAWMMGGVVGHGGEGLGTPRLRMDGGREARVSRYREKRRTRLFSKKIRYEVRKLNAEKRPRMKGRFVKRANGAGGGVPVAIATACVA

SEQ ID NO: 1589 - protein, 250 aa, Cynodon dactylon
MERVEVLGGGSSAGQVRKKRMRRKSTGPDSIAETIKRWKEHNQKIHEDRKAPAKGSKKGCMAGKGGPENGNCAYRGVRQRTWGKWVAEIREPNRGRRLWLGSFPTALEAAHAYDEAARAMYGPTARVNFSESSADANSGCTSALSLLASNIPPASQRSDDKDEVESVETEVHEVKMEVNDDMRSVHVERKTLEVFQSEESVLRKEGDVSYDYFHVEDVLEMIIVELNAAKKIEVHEEYQDGDDGFSLFSY

SEQ ID NO: 1590 - protein, 250 aa, Cynodon dactylon
MERVEVQGGASSAGQVRKKRMRRKSTGPDSIAETIKRWKEHNQKIHEDRKAPAKGSKKGCMAGKGGPENGNCAYRGVRQRTWGKWVAEIREPNRGNRLWLGSFPTALEAAHAYDEAARAMYGPTARVNFSESSADANSGCTSALSLLASNIPPASQRSDDKDEVESVETEVHEVKMEVNDDMRSVHVERKTLEVFQSEESVLRKEGDVSYDYFHVEDVLEMIIVELNAAKKIEVHEEYQDGDDGFSLFTY

SEQ ID NO: 1591 - protein, 368 aa, Oryza sativa Japonica Group
MDPRFPPPAPSGGAPPRGHHRRAHSETFIRLPDADLLLDPDGEFGFSDLDFPSLSDDSPAASDPTPPPPPPALPQAAPRPPGGAHLRSLSLDAAFFDGLAFQGGGGGGGAGSGSSGGGAGHKRSGSMDGESSLFEGESAPPDYAKKAMPADRLAELALLDPKRAKRILANRQSAARSKERKIKYTGELERKVQTLQTEATTLSTQLTLLQAYWDAMIIKSVSLCLVVFILNCEYRYSSVLANCTFQDKQGHYKAIEIKESKYIYPDKQSNLLRKPSLFNAALNDALREEVQRLKIAAGQVPNMNGNSFNGGLQQQQQQQMPTYFSQQQQMHYLSGHQGRHHHPNNPHNSLNGGQSMSGQTLNDSMDFM

SEQ ID NO: 1592 - protein, 511 aa, Arabidopsis thaliana
MDMIKPDFQQIRRDKFRVEQMNDFPNTWTQQQHQNIRIPNNLDLIGILQNQISVPVQTDLYQDSAATFMNMPQSIHRDPQGPSNWRISDLSQPSTVNHGYDQAGIRPNNVADLLSDHFSSRNQILDRPLYVGRDSIPQSSMIRRSEVSCLDDNQKGCVTVACSGTGNEILRSSYDQGSSSGSYRGEFSFLPSLENQSVAHNASNWNHGPVNVTATSHTNSKKGFPLSLLSDIPPSRDVGNAAVLSTMNIHGPLGPFTGYASILKSSRFLEPAQKMLEEFCISYASKIISRSESTSMEDDDDDDDNLSGFSSSSEPLEPKNRLKKAKLLFLQEEVCKWYKLYNHQLQTVMSSFNTVAGLNTATPYISLALKRTSRSFKALRTAIAEHVKQISSHSSNGNNNNRFQKRQRSLIGNNVGFESQQQHIWRPQRGLPERAVAVLRAWLFDHFLHPYPTDSDKQMLATQTGLSRNQVAQLCNSLFGETFKYACLLNYCSWPVLFSSIGLKHVDGTIT

SEQ ID NO: 1593 - protein, 493 aa, Arabidopsis thaliana
  misc_feature (132)..(132): Xaa can be any naturally occurring amino acid
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTXEGILARAADELSALQEERKKVDPKTAEAIDQFLSKLRACAKAETSFTFILDDPAGNSFIENPHAPSPDPSLTIKFYERTPEQQATLGYVANPSQAGQSEGSLGAPSTKTAYVPNGTIGATAGHRAIAQSNSTDISDNLFRYSAPEEVMTFPSTCGACTEPCETRMFVTKIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 1594 - protein, 86 aa, Brassica napus
MSAEFESKVVILSLLNISCLISSSSSSTTTRSKSCLAALHFCVKQRLVLESPSLSMRLRPKRTYSGVEVFGGFHIKQQKFSFFIVR

SEQ ID NO: 1595 - protein, 237 aa, Prunus persica
MVKMMREKIKIKKIDYLPARQVTFSKRRRGIFKKAAELSVLCESEVAVVIFSATGKLFDYSSSSIKDVIERYEVRTNGVEKSDEQSLELQLENENHTKLSTELEEKNRQLRQMKGEDLEELDLDELLKLEQLVEATLVRVMETKEELIMSDIVALEKKGTELVEANNQMVMLRERMVMLSKRNTGPALMEPSESATSTSCNSALSLSLEDDCSDDVVLSLKLGLTVRAGRRPMCLKT

SEQ ID NO: 1596 - protein, 235 aa, Prunus persica
MMRNKIKIKKIDYLPARQVTFSKRRRGLFKKAAELSVLCESEVAVVIFSATGKLFDYSSSSTKDVIERYNADINGVEKLNNQEIELQLENENHIKLSKELEEKSRQLRQMKGEDLEGLNLDELLKLEQLVEASLGRVMETKEELIKSEIMALERKGTELVEANNQLRQTMVMLSGGNTGPALMDPERLNNNIEGGGEEEGMSAESAISTTCNSAVSLSLEDDSSDEVTLSLKLGR

SEQ ID NO: 1597 - protein, 244 aa, Zea mays
  misc_feature (63)..(63): Xaa can be any naturally occurring amino acid
MAMSEPSSDTSCTSSCSSGPSTSTSPRAAPSSAAAAASGGGKKRRPRSNDGGGGGSRSRSSSXPTYRGVRMRAWGKWVSEIREPRKKSRIWLGTFATAEMAARAHDVAALAIKGRAAHLNFPELANDLPRPATAAPKDVQAAAALAAAADFQAPANAAAATDPDDGPDAGADSASASPPPPPPQLDNPDDALFDLPDLLLDLRHGASSCQLSCAPSWYDDACFSGAGAGAGALFRLEEPLLWEY

SEQ ID NO: 1598 - protein, 283 aa, Physcomitrella patens
MGRGKIEIKKIENTTSRQVTFSKRRGGLLKKAHELAVLCDAEVALVIFSSTGKLFEYASSGSMRDIIERYKKSPNGAMKSGASTDFLGREVLKLQEQVERLKSSQRRMLGEDLSALKVPDLLQLEQQLDLGASRVRARKNQLILEEIEGLQKKEQELMVANEDLRKKIADAEAVARANLSEARPESPRHLARTLSRDVSASSHPAATVYPHPNLRDVQRSQTSLQLGMFSSESYPPSSSRWPSEQQFPSASEGCAGESSMKWDHPHYHIQNRLHANILPSVRI

SEQ ID NO: 1599 - protein, 282 aa, Vitis vinifera
MFSYLCFVFPRKLVDDPSTDDVISWSESGNTFVVWKTADFAKDLLPNYFKHNNFSSFVRQLNTYGFRKIVPDKWEFANEYFKRGQRELMSEIRRRKTTTSSTAQALPGGKSAGGGTSSPTNSGEDLGSTSTSSPDSKNPGSVETTTTAQFADLSDENEKLKKDNESLSTELAQTKRQCEELIAFLTEYVKVAPDQINRIMKQESCGSGHGGLVGEIGGSVDDDDDDEKDEDPNEESLKLFGVWLKGKKKRGREEKMGYGGPHQKEMKTVDFEAPWMTSKVCN

SEQ ID NO: 1600 - protein, 238 aa, Prunus persica
MMREKIKIKKIDYLPARQVTFSKRRRGLFKKAAELSVLCESEVAVIIFSATDKLFDYSSSSTEDVIERYKAHTNDLEKSNKQFLELQLENENHIKLSKELEEKSRQLRQMKGEDLQGLNMDELLKLEQLVEASLGRVIETKEELIMSEIMALEKKGAELVEANNQLRQKMAMLSGGNTGPAFVEPETLITNVGGGGEEDGMSSESAIIATSTSCNSAHSLSLEDDCSDVTLSLKLGLP

SEQ ID NO: 1601 - protein, 185 aa, Coffea racemosa
PNKVAKLNASSKTVDHAQAEATMRKARVSVRARSEAPMITDGCQWRKYGQKMAKGNPCPRAYYRCTMAVGCPVRKQVQRCAEDRTVLITTYEGTHNHPLPPAAMAMASTTSAAANMLLSGSMSSADGLMNPNFLARTILPCSSNMATISASAPFPTVTLDLTQTPNPLQFQRQPSTPFQLPFGTP

SEQ ID NO: 1602 - protein, 361 aa, Arabidopsis thaliana
MDGREAMAFPGSHSQYYLQRGAFTNLAPSQVASGLHAPPPHTGLRPMSNPNIHHPQANNPGPPFSDFGHTIHMGVVSSASDADVQPPPPPPPPEEPMVKRKRGRPRKYGEPMVSNKSRDSSPMSDPNEPKRARGRPPGTGRKQRLANLGEWMNTSAGLAFAPHVISIGAGEDIAAKVLSFSQQRPRALCIMSGTGTISSVTLCKPGSTDRHLTYEGPFEIISFGGSYLVNEEGGSRSRTGGLSVSLSRPDGSIIAGGVDMLIAANLVQVVACSFVYGARAKTHNNNNKTIRQEKEPNEEDNNSEMETTPGSAAEPAASAGQQTPQNFSSQGIRGWPGSGSGSGRSLDICRNPLTDFDLTRG

SEQ ID NO: 1603 - protein, 158 aa, Beta vulgaris
MRVESTWPDEGVVSSDEDYSGGEIDVQDLQPKDEERDLKDQLLRRFGSHISSLKLEFSKKKKKGKLPREARQMLFEWWNAHYKWPYPTLAWTYVSIISQHPAIAVQEADKIALAEMTGLDQRQINNWFINQRKRHWKPSENMQYALMENFSGQYFTDD

SEQ ID NO: 1604 - protein, 378 aa, Arabidopsis thaliana
MPTLYKKAGCMSPSMEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTVPNCLLIDKTNTSSFTGSNFTVDKALEASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 1605 - protein, 629 aa, Ustilago maydis 521
MNPPASGSGDGGEDAASATQRSSSINQMAFCHECGIEIRPLMTPDPTCPRCNGQFVEIIDENSAADGMSFALETDEDDEIPLPGHFASLSSVQGGGLLNHLLTAMATGRAAQRSPHTPGSSDSNPRTATAADSPGRNQSPYTTTRSGTTSFGPFGLQWNVQYGSGGGDPYQRAAEQQAEQDQRQQQNSNLQSPPTLSNFLRFAFGGADSTDDPATRPDTYFHEDGMGGAGGVADGRHFNHDNRGTFHQPDRSNDPSSRDSGTNAGSPNNDLPPELSALRNLFTSLFGEPGAQGGSLLDVLAAGAQGGGPRGQWGDYVLGQQGLDDIISQLMEQTQGSTAPPPATEDVIEKLERFTLEDKQRIQKARNQDCPTCKDDFLPSSEANKQDGSGEKGEDADEQQQDLISMPCGHIFHVDCLVPWLRMHGTCPVCRISIVKPTEGQEEQSSSNTTTQQPQGSSGGNTSDASAARATAIPGGWPSPPNPFASSFNHNMHQGVQVPRDSPEVSTMTIHPQPATSTTVTSTTYPAHVIGTPSTTGATGPAGIVINSIMSSPPIVSDREEFFAEPPSMDESQQQAHSGIREDMRETLRRAAEDRARNAGAQADGSTGGAGQRQRQRQRQPWLEPDELD

SEQ ID NO: 1606 - protein, 540 aa, Debaryomyces hansenii CBS767
MVNTDFEKIHLNQSKNYGRMRIADSGLGWKASVTNNASASNNAPFLLPSEEILASQWSRGSRGYELRVQTKNKGVVMLDGFDVEDFANLKQELQRNFQVNLEHKEHSLRGWNWGKTDLARNELVFQVNNKPDFEIPYSEISNSNLTGKNEVAVEFNLDGANSKAGDEMVEMRFYIPGTLENETTPAVKNEENGEVKEEETEEISAATVFYEQLKDKADIGQVAGEAIVSFSDVLFLTPRGRYDIDMYPTSLRLRGKTYDYKIQYNQIERIFSLPKPDEAHHLLVIQIDPPLRQGQTKYPFLVMQFAKEEEIELDLNVSEEEYNDKYKDRLKKSYDSQTHLVMSHCFKGLTERRLVVPGSFQSRFLQPGISCSLKASEGYLYPLDRCFLFVTKPTVYIPFSEISSITMSRTGAGGVSTSRTFDMDITLRGSNQSHNFGSIEREEQETIENYCLQKGLRIKNEEKLAKAMLAKAMNETADDDDDADVDMGSAGDDDDESADDDFNSGSDSDVAEEFDSDASVSDAEMSDSNQEPPQKKPKNE

SEQ ID NO: 1607 - protein, 279 aa, Brassica napus
YASSSVRIPGRPTRPEGCRMDLSNAKTYYSRHKVCCIHSKSSKVIVSGLHQRFCQQCSRFHQLSEFDLEKRSCRRRLACHNERRRKPQATTTLLTPHYSNIAPSLYGNAIRSVLGDPTRWSTTRGSAPWQSHQLMNVFPYGNSSFTNSTDSSCALSLLSNYTNPNQQEQQPLQTPTNTWRPSSIAADRVTMAQTPPVSIQNQYLNQTWEFMSGEKSNAHYTTPVLELSQISEPVDFQISNGATMGGFELSPHQQVLRQYLEPENTRAYDSSPQHFNWSL

SEQ ID NO: 1608 - protein, 336 aa, Physcomitrella patens subsp. patens
MRVQCDVCEKNKAAVMCCADEAALCTSCDTRVHAANKLANKHVRVPLVGQLEPPRCDICQEKPGFFFCLEDRALLCRDCDVSIHSANKLSSNHQRFLLTGTRVGLDSISGQEGAEVVLEESPRVPTPSTATSTLPSISKSTLSSGSKLKDNSQPVPANATPTPNPSWLTNGGRNSERAKIKSKPVGTTSANVSDPHGSSFGKRNSIPADFLSDAVPVWGVDELLNLPELAEGYHIGDIGSSKADMNNLGDYDWMADLSMFEEQMYAAGSFHEVPQLSAPAPTVGLTRGGRATALSKGKGKQDAAIVPQFDDAFVVPDLGLSVSPSSPAPVTKRRRT

SEQ ID NO: 1609 - protein, 584 aa, Oryza sativa Japonica Group
MAMVEQEGCVENRQPLAASSSSVSDGSSYGGGGGGLAQMSPPVSSSANSISGLRRTSGPIRRAKGGWTPEEDETLRKAVEAYKGRNWKKIAECFPYRTEVQCLHRWQKVLNPELIKGPWTQEEDDQIIDLVKKYGPTKWSVIAKALPGRIGKQCRERWHNHLNPEIRKDAWTTEEEQALINAHRIYGNKWAEIAKVLPGRTDNSIKNHWNSSLRKKQDMYNTSNNMVVPKLLVHDKFKDKPKLMAMEGHLDLNKAPIINSKDQPGTAHRSNCSGFLSRSSLPTAQPLTSREASVVDGSAVTLVAQALESDSVRGKGLEIDSVHEKGLEVNSAPDHTGNSWTIQLEAAPSKGEAELSLKNEARSLGPLCYQIPNMEDVVPVSSSLFSDHLTGNHTSEHCGDDILSPAGCTTPPPTKGKLTSQLSVDSILKSAANSFPGTPSILKRRKRDKSTPVSASEMKISGSNTDRFYTPMGMEPATATPESFKTTSFLSLGSLDGSVKSFDVSPQYRARSKRMALTKTVEKQLDFSSDGLDTCGSEILNSSCNNSQSTLSITEAPKLKEKEHAVQLENLTKNFAHTTNLDVT

SEQ ID NO: 1610 - protein, 215 aa, Hyacinthus orientalis
HVEFEYRGFVANSLADLEPYLLESAPNPRNGPDEIEAVAVNSIFELHRLLAREGAIDKVLSTVKAIKPKIMTVVEQEANHNGGLFAERFTEALHYYSTMFDSLEGGASADAVSGGQQNQVMSEVYLGRQICNVVACEGAERTERHETLVQWRNRLSPAGFEPVHLGSNAFKQASMLLALFAGGNGYRVEEKDGCLTLGWHTRPLIATSAWRVADA

SEQ ID NO: 1611 - protein, 357 aa, Zinnia elegans
MDTMNQSSCTVPPGFRFHPTDEELVGYYLRKKVASQKIDLDVIKDIDLYRIEPWDLIERCRIGYEEQNEWYFFSHKDKKYPTGTRTNRATMAGFWKATGRDKAVYEKLRLIGMRKTLVFYKGRAPNGQKTDWIMHEYRLESEENGPPQEEGWVVCRAFKKRATGQTRTTPAWESNYFLDESSLLTSTMDDYTTIQPSNIPLTSSFMCKQELEASENLNFIHCDQFIQLPHLESPSLQSIKRPISSILYEHDQQEDDQITKRITNNVRSKDEVRDWRDLDKFVASQLSQEEEIRCVEEGFSTNFQENIDHSTSLSHMFNYQDGIEEYSGCDKGGKLNGFLSSTSSDHFDVGICIFDKL

SEQ ID NO: 1612 - protein, 925 aa, Oryza sativa
MAAAATAAASPVEGLTGGGGGGGGGVDGLFVELWRACAGPLVTVPAVGERVFYLPQGHIEQVEASTNQVAEQQGAPLYNLPWKIPCKVMNVELKAEPDTDEVYAQLTLLPEKQQDGNGSGNGNVSKDKVEEEEVVPPAATERPRVHSFCKTLTASDTSTHGGFSVLRRHADECLPPLYSFFDRLIVAMPLTSLLDQDMSQHPPTQELVAKDLHGVEWRFRHIFRGQPRRHLLQSGWSVFVSAKRLVAGDAFIFLRGENGELRVGVRRAMRQQANIPSSVISSHSMHLGVLATAWHAVNTGTMFTVYYKPRTSPSEFVVPRDLYKESLKRNHSIGMRFKMTFEGEEAAEQRFTGTIVGVGDSDPSGWADSKWRSLKVRWDEAASVPRPDRVSPWQIEPANSPSPVNPLPAPRTKRARPNVLASSPDLSAVNKEVASKVMANSQQNGLPRAFHSQENMNLRSRFGDSNELNTSQKLTMWSSGSNQEKNNVSVQRELGSQSWMQMRRPDGSSEILSGFQPLKDTRNPLSSFPSQISGNRSNTWNTINVHYPDQNANHNMYPGTWSLMPPNTGFGVNQQNYLMTPDITLPQRSLNAKFGGNGAFTSLRAHGIDQRSSGWLGHIEPSSHIDDASSSLIKPQPLVIDHNVQKAKGSSCMLFGISLDSPAKPELLISPPSVAFDGKLQQDALEEDECSDPSKTVKPLDGAQHDSAREKHQSCPDGTKNIQSKQQNGSSRSCKKVHKQGIALGRSIDLTKFTCYDELIAELDQMFDFNGELNSSSKNWMVVYTDNEGDMMLVGDDPWNEFCNMVHKIFIYTREEVQKMNPGALNSRSFVVCKNRRRHIHGRKESFRGVVVVAGALYVSGKPRSTPFVDGACPGISCPLFVFDKFWVCFVEVLSYCMICPVVVKGAEAKLPRPVRLLACALPPS

SEQ ID NO: 1613 - protein, 329 aa, Zea mays
MAGAAGDRSEEDVGADWPFGGVDAFTEYSSFFAEPGWPGGLAGELIPVLDLPEAAAPLPAQLSTEEPSEEPAPARSGDAGASSSSSGDGAAPGNGDGDDDRKAAPAAEAAGRKPAAKKGQKRARQPRFAFMTKTELDHLDDGYRWRKYGQKAVKNSPFPRSYYRCTNSKCTVKKRVERSSDDPSVVITTYEGQHCHSIGPFQRGGGGGAAAARYHSAAAVALAEQMYSSSTTSSFIPAARQQLFSLPPLHPQSSPPSSETTPPVVSSVTTTSFQRANDGDELWRTGYGSGVPVAQSPSTPPSVPPPAISVQKAGLLDDMVPHGVRHGTP

SEQ ID NO: 1614 - protein, 168 aa, Brassica napus
MGFPVGYSELLLPRIFLHLLSFLGLLRKLISTIFWLIGLPDFLEPEPVSSSWPEPPPTSSHQDSHLFSAALLAGDILPVVRFSDLNLPESECCAVCLYDFENHDEIRRLTNCRHIFHKGCLDRWMMDYNQITCPLCRTQFIPDDLQVAFNHKLWAESSEVSELLVESF

SEQ ID NO: 1615 - protein, 116 aa, Brassica napus
MAKTRPGVPSKIKTGRKELDTYTIKGTNKVVRAGDYVLMRPSDAGKPPYVARVEKIEADARNNVKVHCRWYYRPEESLGGRRQFHGAKELFLSDHFDVQSAHTIEGKCIVHTFQKL

SEQ ID NO: 1616 - protein, 275 aa, Physcomitrella patens subsp. patens
MNSGFCVRFHWINRNQPKDCETAIIAIATKEQDNVIAEVGAAAVAFTADEGAPSYEVESLCEHFGENVVKRLILTRTLHFREIRYSNSAPDLSCLNNEVQFTGQLQPHGCVFTLKIPAGDSQANMSLVLNRQVVNSDAATIKVSELKFEVPPQSQRGTLYEEEHERTLEQNLVLGLNDMNNSTADAAYPSKQKFYPHIILKRLIENECGVRNYPFVLQIDPSWILFVAKYELHEQHGINCKAYDFVCRRMAGTLRNRIGANNNLQCRAQFGEHIS

SEQ ID NO: 1617 - protein, 241 aa, Glycine max
MKGKTCELCDQQASLYCPSDSAFLCSDCDAAVHAANFLVARHLRRLLCSKCNRFAGFHISSGAISRHLSSTCSSCSPENPSADYSDSLPSSSTCVSSSESCSTKQIKAEKKRSWSGSSVTDDASPAAKKRQRSGGSEEVFEKWSREIGLGLGLGVNGNRVASNALSVCLGKWRWLPFRVAAATSFWLGLRFCGDRGLASCQNLARLEAISGVPVKLILAAHGDLARVFTHRRELQEGWGES

SEQ ID NO: 1618 - protein, 620 aa, Coprinopsis cinerea okayama7#130
MDLRGGGGKQGDSSLSATSTTASPATPQQQYIPPPPLLQYTSAEPHHGHQLHHHHLPNGVIPSSTSTTTTTSLYTSDPVHWQHYPPHQGYHHNQAFPDASSSSSAHPSPILPPQSQHLSAKPASASTLGKRTRDAETSFAGNAASTSASTNTTTVAASSPTTTTTAAPPRKQVKRERGQSVSTISNTTTTNTNTKMASSSGSRGTSKERGSNDDPMPQTSDFVKKLYKMLEDPTFQPVVSWGPQGDCFVVKHSNFASFVRQLNKYDFHKVKNTDDNQFGEHSWIFRHPDFQADRRDALENIKRKVPAQRKNAAAAAAAAQQQQQQQQQAAAAAAAALLGGSPSSLGFPPGLAGSLGVAGFGPQGPIGYVQELHSEIRRLKDDNEDLKGRLRNLERNYENVLVEMVGFQRGMAQQDGLMQSLIAYFLGSEGDQQRQGQHQLSPQQIAHLVSLQQQSQQQQSQSQLGTLASSALGGASGLGLGGGGIGAGIGGGGGIGGGGGGLGGGGGGGIGGGGLGGGQAQQQPTPGLTNSMFCPVGGYKRPRRPRLIVAVLAALVSSSLSSLSSLVPAVLAEALKPTSARSQRDPPPTFLLAVDANTDAGVAILDLYPSDKPACPSISH

SEQ ID NO: 1619 - protein, 178 aa, Glycine max
MMAVARKEMDRIKGPWSPEEDEALQKLVERHGPRNWSLISRSIPGRSGKSCRLRWCNQLSPQVEHRAFTPEEDETIIRAHARFGNKWATIARLLSGRTDNAIKNHWNSTLKRKCASFMTADEAAAGGFSPRPLKRSFSAGTAVPPPGSPSGSDVSESSAAPGVFSVSVSSRGGVIGNL

SEQ ID NO: 1620 - protein, 480 aa, Oryza sativa Japonica Group
MALSTLLLPSSSSSSSKTATATDTSDRRRHHHHHNHTKRKKKPPPPPLSPTPRTPPPAGSGSHRAMAASSKKSTKQVVVAAKTTTGHRPKKAAAAPTTPSRGAPSASAAPVSSSWEQLKSLLSCRSATAAARVHDPAAPSSALSRLRSHGAGACGASLCAIRDVVDAASSASAASTAAASLDRDTTPLTRSSRRAHRAATSSSGGGGGHHASLRGLSGCYECRAINVEPMSRRYPRPRELCACSQCGEVFNKADSLEHHQAIRHAVSELGPEDSGRNIVEIIFKSSWQKRDRPICQIDRILKVHNAARTVARFEAYRDAVRTRCRATAARAAADGNELLRFHPAALACPLGLNGATSLCDDDDACGVCAAIRHGFAPWAGAHPLGVRTTASSGRAHDCGAAAAAAQQAGGCRAMLVCRVIAGRVRRNDDDGGAEEEEGAFDSVAGDEAASSVYGNLEELFVANPRAILPCFVVIYRVVPE

SEQ ID NO: 1621 - protein, 337 aa, Triticum aestivum
  misc_feature (63)..(63): Xaa can be any naturally occurring amino acid
  misc_feature (123)..(123): Xaa can be any naturally occurring amino acid
  misc_feature (221)..(221): Xaa can be any naturally occurring amino acid
RRPTRPGGGFAPGLGAGAWESEKAAIEAHPLYERLLEAHVACLRVATPVDQLPRIDAQVAARXAPTVPPAAALAGAEELDLLMTQYVLLLCTFKEELFQNVRVHAMEAVMGGCKLDQTLHSLXTGASPAERTGGTMSGDEDNPVDSESHMFDGNDESDGMVLGMLTEGQRTLVDRVRQEPNHELKPGYREHLVDIRQASLRQPRAEKGRGDTGVTLKACFXAEAPFPYPPEVARPADSGRHSRGHPNTTHRWVQHAAQPELEIHRCAPSGPRHKTSNKGAASAGATAGKPGFVALRWLRRGQNGRQRRPQYRFQTTFPTLGGAPSTPFTTTGGRAPR

SEQ ID NO: 1622 - protein, 131 aa, Physcomitrella patens
SNTSSAKRKTPDRALDESEDIQPLDEPDPKKQTTKKEKKGAVKLNKRVRVPRYAIHTRSEIDVMEDGYKWRKYGQKAVKDSPFPRSYYRCTNQTCPVRKRVERKAGDAGLVVTTYEGTHSHLSPVTEAATV

SEQ ID NO: 1623 - protein, 186 aa, Picea glauca
VHTNNKGAWTKEEDERLIAHIEAHGEGSWRSLPKAAGLLRCGKSCRLRWINYLRPDLKRGSFAEEEDDLIIKLHSLLGNKWSLIAGRLPGRTDNEIKNYWNTHMKRKLLSRGLDPQSHRPLGQPCKTTLSSPHVLEHEIQAFQSPRTAEVADFFQYDRPESSAIERADSDAEERPDLNLDLCIWHM

SEQ ID NO: 1624 - protein, 279 aa, Zea mays
PLEGYSRAAAAEGEERQLLKGEIAVHPLCEQLVAAHVGCLRVATPIDHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEAPMLEVGLDMGSDGHDMMGFGPLMPTDSERSLMERVRQELKMELKQGFKSRIEDVREEILRKRRAGKLPGDTTSILKQWWQQHSKWPYPTEDDKAKLVEETGLQLKQINNWFINQRKRNWHNNSQTSTLKSKRKR

SEQ ID NO: 1625 - protein, 248 aa, Triticum aestivum
  misc_feature (110)..(110): Xaa can be any naturally occurring amino acid
MAPRAAEKAPVSPPTGLGLGLGGGVGVVAGGAHYRGVRKRPWGRYAAEIRDPAKKSRVWLGTYDTAEEAARAYDTAAREFRGAKAKTNFPFPSSSSSSPVAGAGGGGSPXSSDSTLDSSGGGSGGCAQAPMQAIPLPPALDLDLFHRAAAVTAVAGGGMRFPFNGYPVAPRQPMHPYFFYEQAAAAAAAAASGYRALKVAQPVTVAAVARSDSDSSSVVDLSPSPPAVTAHKAVAFDLDLNRPPPSED

SEQ ID NO: 1626 - protein, 188 aa, Physcomitrella patens
RRKTDKKSKDPVPPPRMIREPRVVVQTTSDVDILDDGYRWRKYGQKVVKGNPHPRSYYKCTNVGCPVRKHVERASNDPKAVITTYEGKHNHDVPAARNVGHDVAMQTAAPVAATARSLQDQGISFGNSFGQPPEDSASRWNRGSGDVELGMSVGLGPRVQGAREQGPLDATAVSLAASIGHPSFDDAR

SEQ ID NO: 1627 - protein, 131 aa, Picea glauca
KGPWTLDEDQILVSYINKHGHGNWRALPKQAGLLRCGKSCRLRWTNYLKPDIKRGNFSPEEEDHIIKLNQLIGNRWSTIASHLPGRTDNEIKNVWNTHLKKRLARMKAEAEAESVAVHAQPAPSSSLDSST

SEQ ID NO: 1628 - protein, 150 aa, Zea mays
MEDLYSIHPGISRHGAAATSEASGVAGGPGSPPPPPPPAADLTELVKAQIAGHPRYPSLLSAYIDCRKVGAPSEVATLLEEIGRERCAAASAGGEVVGMDPELDEFMETYCRLLERYKEELSRPFDEAASFLSSVRTQLSSLCGGAASLS

SEQ ID NO: 1629 - protein, 169 aa, Oryza sativa Japonica Group
MEDLYSIHPGISRVGGAASEASGVGVVVGGGGGSSSSDLTELMKAQIAGHPRYPTLLSAYIECRKVGAPPEVASLLKEIGRERRAGGGGGGAGQIGVDPELDEFMEAYCRVLVRYKEELSRPFDEAASFLSSIQTQLSNLCSGATSPPATTATHSGNQHIHYICMHTWQ

SEQ ID NO: 1630 - protein, 93 aa, Saccharomyces cerevisiae YJM789
MATPREPKKRTTRKKKDPNAPKRALSAYMFFANENRDIVRSENPDITFGQVGKKLGEKWKALTPEEKQPYEAKAQADKKRYESEKELYNATLA

SEQ ID NO: 1631 - protein, 118 aa, Physcomitrella patens
SMEQGQKMKGPKRPREPRYEFKTRSEVDVIDDGYKWRKYGQKPVKSSPHPRNYYRCTTANCPVRKRVERSIEDPGLIVTSYEGTHTHPKINRPKNSSGVGWTSNEFEGPQDLWSQVQN

SEQ ID NO: 1632 - protein, 332 aa, Arabidopsis thaliana; identical to SEQ ID NO: 174

SEQ ID NO: 1633 - protein, 247 aa, Petunia integrifolia subsp. inflata
MVFPNQEFESSSSQRKSGRGKIEIKRIENTTNRQVTFCKRRNGLLKKAYELSVLCDAEVALIVFSSRGRLYEYANNSVRATIDRYKKHHADSTSTGSVSEANTQYYQQEAAKLRRQIRDIQTYNRQIVGEALSSLSPRDLKNLEGKLEKAIGRVRSKKNELLFSEIELMQKREIEMQNANMYLRAKIAEVERATQQMNLMPGGGSEYQQQPMSSTSQPYDARNFLPVNLLEPNPHYSRQDQTALQLV

SEQ ID NO: 1634 - protein, 207 aa, Beta vulgaris
MDELYGLHPTSGDYSDKALMSPDNLILPSDYHSLIMNSGNTAAVRFGSDELISATCISESASITPDMPPDDNTSTSIKAKIASHPHYPRLLQAYIDCHKVGAPPEIANILEEIKQENDMYRRDFGSLRTCLGTDPELDEFMETYCEILDKYKSDLSRPFDEATNFLNKIETQLRNLCKGAFVKTASAALLVHTNSFNHASQHYDFTP

SEQ ID NO: 1635 - protein, 219 aa, Ageratina adenophora
MATLIQFNTPYTSLSADNIPTTESSSTSDYSTGTSFSDEEVMLASKNPKKRAGRKKFRETRHPIYRGVRRRDSGKWVCEVREPNKKTRVWLGTYPTADMAARAHDVAALAMRGRSACLNFADSLWRLPIPESSNVKDIQKAAVKAAEAFRPTETDVAVIEESNELTGNVFCVDDESIFEMQGFLADMAEGMMLPPPRTIEYDNCQDDLEFFVDASLWSF

SEQ ID NO: 1636 - protein, 552 aa, Oryza sativa
MEEELCGNNWDLDAVVRLGCCRRRISPAAVAQQVDPFASFLQQGVAMEVAAEKEVGVEAAWSFPELTVRDGGGGGLGRDADELLKAFCAAFPSSSSSKSSPLPTPPPPPPTQPQPEQQKPVTVQENLPAPTTAPARASQPAAARQVPAGGVPRSKRRKNQQKKVVRHVPADGVSADVWAWRKYGQKPIKGSPYPRGYYRCSSSKGCPARKQVERSRSDPNTFILTYTGEHNHSAPTHRNSLAGTTRNKLPSSSAASAASAQPQPPPPSVVVVGAGGGGAEAAGLSPTTPLRTPSMEEDEEEEEEEELLVEDMEMAGEDELLFLNGGDDNAALDGTPIRGALLFLALPFSVQQPNLSACSSLGMFDWDLNSHHSSLFLHPQLLMVGDDGGIADVASLGDGNAITTEDDGGGADPVRGDGGGGGCSDAVRGGGSGSNVARGGGGCAVAASGGNDCTVVAYVGVGGVSLGGWIWDPSSSLSPGSGIHAGCAIRVELKLLRFNGELRGEVWLSPFLWRRPKGINGSSSGLHAKGDPRLQLSWLCRCSLSIRAFCTV

SEQ ID NO: 1637 - protein, 593 aa, Oryza sativa Japonica Group
MMGAAVTMVDRRMAFAAEADVDSKAAFGFFGGECFVGEGDLVNPAPPPPQQQQVHEGGFAAEDESDGDDDDDDDDDVDDIEELERRMWRDRVRHKRLKELQQSRAGRESRAGDAGGGGRQQRQSQEQARRKKMSRAQDGILKYMLKMMEVCNAQGFVYGIIPEKGKPVSGASDNLRSWWKEKVRFDRNGPAAIAKYQADNAVPGCDGDAGGAAPAGPHSLHELQDTTLGSLLSALMQHCDPPQRRFPLEKGVPPPWWPEGSEAWWPEAGVPKELGPPPYKKPHDLKKAWKVAVLTAVIKHMSPDVDKVRRLVRQSKCLQDKMTAKEIVTWLAVLKQEEDLYLKLHPGALPPPLSAASFNASVSGEYDVEGVDGDEAGNNNLQKAQNDATAFMDLTTTMDAALSNNKFLIMPLMKEEAIDVDFIQKRSEPELMLSSDSHARVYTCGNVQCPHSNYALGFLDRNERNAHQYACKHNAAAAAAESKPPPPHIFEPLGSFDFDLPVDGQRCLAGLMTMYDNDVAAATQMHHHHHQQQQANFFIRDDAPFGGDVAATAAAAPEFRFSSNFNVTGGGAVDYGGAMQQPPAKYAGSNWFY

SEQ ID NO: 1638 - protein, 321 aa, Glycine max
RIRMPATCAARVFQLTRELGHKSDGETIEWLLQQAEPAIIAATGTGTIPANFSILNVSLRSSGSTLSAPPSKSAPHTFHGALALAHHPYDQLRRPPPLLGFHPHAHQPQQLLSADHIPESLPSGAGDSGDNYLRKRYREDLFKDDNINNNNTQSQNESGDGDGSSPKLPKQQSEAGSGLLRPSNLLPATAMWAVAPSPASGPPGSTIWMLPVTAGASSSASSETQMWPFPQSVSGFMPRFNLPVPGALEFQGARAGSLQLGSMSMPQQQHLGLAMSDSNLGMLAALNAYTRASLNVNSDHHQHQHQSQPSESGEDDPNSSQ

SEQ ID NO: 1639 - protein, 204 aa, Zea mays
MDTDDAQEPATPTSPSPSPSSSSSSSSSSSSSPKKRARRDGGRHPTYRGVRMRSWGKWVSEIREPRKKSRIWLGTFATAEMAARAHDVAALAIKGARDAHLNFPGLARLLPRPATAAPRDVQAAAALAAAADFPLPNAESGGSASDGAPQDDAEPSPDDALFDLPDLLLADLRCCGPPPSWAVDDDVVGGGAFRLIEEPLLWEY

SEQ ID NO: 1640 - protein, 337 aa, Oryza sativa Indica Group
MCGGAILAELIPSAPAARRVTAGHVWPGDANNAKKKGARADDFEAAFRDFDNDSDDEEMMLEEAEEEEATSEHKPFVFRAKKARKAAAAAASSRRRKPAQYRGVRRRPWGKWAAEIRDPVKGIRVWLGTFTNAEAAALAYDDAARAIRGDRAKLNFPSATTPDTRKRGRATAAAAPAVKATPVINLVEEEDEEEEVAAAMASIKYEPETSESSESNALPDFSWQGMSASDEFAVAAAALSLDSDDDLAKKRPRTEPEDTTTTTDSGSGDDTDALFDALLFADQYNYFNGGAYESLDSLFSADAVQTTAAAAAADQGMGLWSFDDGCCLVDVEASLSF

SEQ ID NO: 1641 - protein, 394 aa, Zea mays
MDADVGAGATNQPWPEPDDAHLSPPPPPPPPPASAPTPAAEAAAPTASAAVSPPAPAEANGNSDRKRRRKADDGDGCKACSCKKSRCLKLYCVCYASGSHCTELCGCEPCHNKPPQGAPWTAPVLPLKPVQTLEAGQEIVEQLIRSPMDLIRRKCTCKKSGCLKKYCDCYQGGAGCSINCKCDDCRNPFGRKVGVILDGKSSGLPAPVHVHERNGTEADSSGDDEEDDDLYMNRQLSPSPVSRESSFQQETLVGVEVQTMNGHLYPKPLTQVRPEPSSWQLSAARRPAEEPRGEVWRFSGRPGEDGASDAVEAARAVAVAPPRESRRPGTRGGDRLRFSIPRCVEAMSAMAELSPVEKSLAPDVFLDESNREIFLSLSVDVRPIWLRRKMKSLV

SEQ ID NO: 1642 - protein, 143 aa, Brassica napus
MVKLCELCGAEAHLHCDADSAYLCRSCDVKFHASNFLFSRHVRRAICPGCSSLTGDIVSGSLSPWPAKITCSCCGTSSSSASSCCSELSSSTTRKTIVNRGPRRREKGVNAVADGIFVNWCDELGLNGDSKNEVVSLASLALA

SEQ ID NO: 1643 - protein, 158 aa, Poncirus trifoliata
MGLASMPSASEGMLCLILMNTAMPISIVKGIFRSILKVVGFQLAESSSTPYSYFASPQVVSAEPYDVNLSPPLSYVEEFRNQNPAIKYETLLHCEDAEHDCSVCLTEFEPQSDINNLSCGHLFHKVCLEKWLDYLNVTCPLCRTPLIPEFEDDPSCFW

SEQ ID NO: 1644 - protein, 241 aa, Arabidopsis thaliana
MFSNIDHKAVAALLHGQGCANILKTVLDNCKVSSVSTEPLINTILDSFSLALSSVNSPNRQPHHESSSRDMAGLVPQRSSKKKICGVKGLEIYRDDSPNPRLDDGFTWRKYGQKTIKTSLYQRCYYRCAYAKDQNCYATKRVQMIQDSPPVYRTTYLGQHTCKAFGVHDNTYGSEMINFDQVVSESVMRQLATIGEQAVLMEDEANHIMNQEYDINDYLVDDEVFWGNEFPLFSSEDLMLF

SEQ ID NO: 1645 - protein, 264 aa, Poa pratensis
MSRKKKVRRRSTGPDSVAEIIKKWKEQNQKLQEENGSRKAPAKGSKKGCMAGKGGPENSNCKYRGVRQRTWGKWVAEIREPNRGNRLWLGSFPTAVEAAHAYDEAARAMYGATARVNFSERSPDANSGCTSAPPVLMSNGPTAVSYPSDEKDESESPPSLMSDAPTATLHRSDAKGEPESAGTLVHEVKTEVSNDSRSIREERKTVEVFQPEGKALHKEEKVSYDYFNVEEVLDMIIVELSADRKMEVHEEYQDGDDGFSLFSY

SEQ ID NO: 1646 - protein, 254 aa, Sinapis alba
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSSKELQNLEQQLDTALKHIRSRKNQLMHDSINELQRKEKAIQEQNSMLSKQIKEREKILRAQQEQWDQQNHGHNMPPPPPPQQIQHPYMLSHQPSPFLNMGGLYQEEDPMEMRRNDLDLSLEPVYNCNLGCFAA

SEQ ID NO: 1647 - protein, 257 aa, Oryza sativa Japonica Group
MGRAPCCEKMGLKKGPWTPEEDKVLVAHIQRHGHGNWRALPKQAGLLRCGKSCRLRWINYLRPDIKRGNFSKEEEDTIIHLHELLGNRWSAIAARLPGRTDNEIKNVWHTHLKKRLDAPAQGGHVAASGGKKHKKPKSAKKPAAAAAAPPASPERSASSSVTESSMASSVAEEHGNAGISSASASVCAKEESSFTSASEEFQIDDSFWSETLSMPLDGYDVSMEPGDAFVAPPSADDMDYWLGVFMESGEAQDLPQI

SEQ ID NO: 1648 - protein, 467 aa, Zea mays
MDNHIHSQPAANLYYQFGMGTEQQYPPPFASPPSTNIPHMDWNPATMLDNLTFIEEKIQQVKDVIRTMVDNAGQVQVQCHHQAGELLAQKQKQQVVNADLTCLIVQLISTAGSLLPSLKNSSFLSHPHPAGHVDMANHVGPSSSLVPNAMTVSEDYEELFKGWTDGGIEVDDDGVLVEEQEITKDGDSLSYELLQLEEDEILAPHTHFCTICGKGFKRDANLRMHMRGHGDEYKSPAALAKPPRDPGAEQEPAKRRYSCPFAGCKRNKLHKSFQPLKTILCVKNHYRRSHCEKSHTCGRCHAKKFSIVADLRTHEKHCGRRDRWVCSCGTSFSRKDKLFAHVALFQGHTPALSSPLEEEPPKACSDQHQTGRAGSRREPAKVPAGSVGGGSGSSFVWGASSSGENSALDIKGFVDGCSGDFLSTANFGSFNLSFGPADGFTGEPSSGGSFSMLPPEHFQSAQKKGQN

SEQ ID NO: 1649 - protein, 422 aa, Zea mays
MSRGAEKKNWPPSRSSSSSSSSPTSSWVASRSMAGFYRYPSSTRTSGKDRTQPPPAPAAPTQQQGDKSSSKKKRRSISIGRSITCAGSICSTKESSVMSRDRRGASSRSLRAPYVDVDVNDASAAAISATSSFNSETTVASTTTVTSSSSSSSVGTSFRGVHIRKLSGCYECHSVFDPRSFGAAAFPCADCDEVFAKAESLELHRATRHAVWELGPEDTSRNIVEIIFQSSWPAGKQQQAPVCKIERVLKVQSSDRTLERFEQYKESVRERASSDRGRKNNPRCVADGNELLRFHCTTFTCSLGLAGSTALCRAPCKLCAIVRDGFRVDDDGKIATMGTSGRAHDMAQVLSESDGDKRAMLVCRVVAGRVKKKASDEKKPSEDSGFDSVSPSTEGVCSDLDQLFVFNQRAILPCFVVIYSGY

SEQ ID NO: 1650 - protein, 353 aa, Zea mays
MQQQPEPADPPGRALPPPAVPAPAPAPVAARAAHHRRARSEVAFRLPDDLGLGGGGGPDGDTFDDIGSEDDLFSTFMDIEKISSSGPSDRDRAAETSSPPRPKHRHSSSVDGSGLFFSPGIGGGAGKDAAASLAEVMEAKKAMTPEQLAELAAIDPKRAKRILANRQSAARSKERKARYITELERKVQTLQTEATTLSAQLTLFQRDTTGLSAENAELKIRLHAMEQQAQLRDALNDALKQELERLKLVTGEMTNSSEAYNMRFQHVPYNSSFFPLSQQNASPHPGTTQLPPPFHPPHPNVPNHQMLSHPNTLPDIMQQESLGRLQGLDIGKGPLVVKSESSSISASESSSTF

SEQ ID NO: 1651 - protein, 238 aa, Glycine max
GCVILKEKIGRVGGLVWCKSMDSLEDSGYWDFLDYSFIDQAPPDFLWSNNTISVNTEVDIPGDAAACQENTKKRGHADSSCQVGSKACREKLRRERLNERFCDLSSVLEPGRPVRTDKPAILDDAIRVLSQLKTEAQELKKTNEKLLEEIKCLKAEKNELREEKLVLKADKERIEKQLKALPVAPAGYMTPPVAAAAYQAGVNKMALYPNYGYIPMWQYLPQSVRDTSHDHELRPPAA

SEQ ID NO: 1652 - protein, 853 aa, Oryza sativa Japonica Group
MATAEVGGGGGEGDAAAAAVARAGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 1653 - protein, 158 aa, Picea glauca
GRSPCCEKSHTNKGAWTKEEDDRLIAHIRAHGEGGWRSLPKAAGLLRCGKSCRLRWINYLRPDLKRGNFSEEEDELIIKLHSILGNKWSLIAARLPGRTDNEIKNYWNSHIKRKLLSRGLDPGSHRPLCFPHHNNTTSPSRPAPDHEFPAFQNLKTPE

SEQ ID NO: 1654 - protein, 295 aa, Prunus mume
MSSSDLQLPPGFRFHPTDEELVKHYLCRKCQSQPISVPIIAEIDLYKYNPWDLPGLALYGEKEWYFFSPRDRKYPNGSRPNRAAGSGYWKATGADKPIGSPKPVGIKKALVFYAGKAPRGEKTNWIMHEYRLADVDRSPRKKSSSLRLDDWVLCRIYNKKGTVEKQQQQQQQQQQQTTSRMSSGSEFEDRKPENLACPPPPAAVAPTRPNDYVYFDTSDSVPRLHTDSSCSEHVVSPEFTCEVQSEPKWKEWEKALDFNYNYMDTSVENGFGPQFQSANQMSPLQDIFMYLQKPY

SEQ ID NO: 1655 - protein, 260 aa, Picea glauca
AVAERIKGPWSPEEDATLHRLVEKYGPRNWSQISRGIPGRSGKSCRLRWCNQLSPQVEHRPFSPHEDATIIQAHARHGNKWATIARLLPGRTDNAIKNHWNSTLRRRYHGEKDHSNGLVVNLESAAEDKEAMISLTAPAMVPALVFAAAADSSRKRSNSSCSANDNPGDAEVESRRLKRLNFSESPTSSDNNNNNNEEDTISGHCNSVAPGSSPVQQLHRPVPRQSAFNCYEAVKMHEEASASVSASGSAGAFDPPTSLS

SEQ ID NO: 1656 - protein, 514 aa, Oryza sativa Japonica Group
MPPCVWGSHTPLSLLSPPAAWAGERMEGDQAGGDLTDIVRAGGGAMPGSVVVDLPSTAAEWQLPAEPMLFPPPPSLSSTTDGCGAGGAAGADIFGGGGGDLFSGLVDPFSSDYSSGADFLDAMPDAMAKVGFDTAVGGGCGGGGGGGGGSGGHLLDMSRKPLLPRGMPMAAVGGLAAPRVMPSPLSPRAIRPYPPISAGDMMKLGITAGQAAGCAIDAAVAGMQMSSPRSGGIKRRKNQARKVVCIPAPTAAGGRPSGEVVPSDLWAWRKYGQKPIKGSPYPRGYYRCSSSKGCSARKQVERSRTDPNMLVITYTSEHNHPWPTQRNALAGSTRSHHSKNSGGGGGSGSKGSQNDKSQQQPSVKEEQKDQATTATTTTTSTITTTNSASPVVVKEEEAALAGSSEALELERVMDTTAAGVVDHSELMDHVFSESYKPMIPETGQPDDFFADLAELESDPMSLIFSKEYMEAKPSGGDHAQEKAMAKELDPFDMLDWSTTTNSSAGSSFEQGKRG

SEQ ID NO: 1657 - protein, 216 aa, Gossypium hirsutum
MDFLVQDYDMVDSGSVSESGTDRPVNFSDGYVMLASSYPKRRAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMEKGFYLDEEALFGTQRFWANMAAGMMMSPPRSGHDGGWEEHEVDDYVPLWSYSI

SEQ ID NO: 1658 - protein, 153 aa, Triticum aestivum
  misc_feature (34)..(34): Xaa can be any naturally occurring amino acid
MESARAPAGDVNLDLRLVHPMAAAAWRPHPQTPXAADRTFSCTYCRRKFYSSQALGGHQNAHKLERSLAKRSRELSAASQVAIASSSAASSPPPSDLISWYTPGGGDSGQATGSAAAAAAVVSWIADGGRRRYVHRVHPAGNGEDDIDLSLKL

SEQ ID NO: 1659 - protein, 260 aa, Picea glauca
MALSNGRSLEDLDRIKGPWSPEEDASLQRLVQKYGPRNWTQISKGIQGRSGKSCRLRWCNQLSPQVEHRPFTPSEDTAILQAHAQHGNKWATIARSLPGRTDNAIKNHWNSTLRRRCRDSDKGILVHLDDEISSLDAARKRSSDGFSHDGSSALEDNCCSSWEVDSKRLKRLGELGAEQGPDVEVELEVSDRSDSNPGRVLYRPVPVASFFGSFGKTVANLQETASGSVGVDPPTSLSLSPPGLDPAIHSPKPPSQKDFH

SEQ ID NO: 1660 - protein, 349 aa, Solanum lycopersicum
MSPPLLGVGEEEGQSNVTLLASSTSLGSICIKGSALKERNYMGLSDCSSVDSCNISTSSEDNNGCGLNLKATELRLGLPGSQSPERGEETCPVISTKVDEKLLFPLHPSKDTAFSVSQKTVVSGNKRGFSDAMDGFSEGKFLSNSGVKAGDTKETSRVQPPKMKDANTQSTVPERPSAVNDASNRAGSGAPATKAQVVGWPPIRSFRKNTLASASKNNEEVDGKAGSPALFIKVSMDGAPYLRKVDLRTCSAYQELSSALEKMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 1661 - protein, 193 aa, Arabidopsis thaliana
MRPSDAGKAPYVARVEKIEADARNNVKVHCRWYYCPEESHGGRRQLHGAKELFLSDHFDVQSAHTIEGKCIVHTFKNYTRLENVGVEDYYCIFDYKAATGAFTPDRVAVYYKCEMPYNSDELMELLLCHYRVHLACVGVTIEEAKKLEHFVCVECSSDEDGVKRFQNGFASSTTNDLKVEAKRRKDDRCKSLL

SEQ ID NO: 1662 - protein, 252 aa, Picea glauca
DEPDRIKGPWSPEEDAALQHFVQKCGPRNWSLISKAIPGRSGKSCRLRWCNQLSPQVEHRPFTPEEDATIIRAHAQHGNKWATIARVLSGRTDNAIKNHWNSTLRRRCQGGGALVIDDEITSGADGFRKRSLSEDADASRKLKKLSLGTTATTTTTEPCSSSASDRSDSSLALGSPPVYRPVPRAAPLSLTNEANLNPSHHEASCSSTDPPTSLCLSLPGTDAPARPTVALSALPLPGTSSPLAPPGYIKAE

SEQ ID NO: 1663 - protein, 215 aa, Glycine max
  misc_feature (109)..(109): Xaa can be any naturally occurring amino acid
MRRGRTAAAAAAVVDPTPDQAKETTRFRGVRKRPWGRFAAEIRDPWKKQRVWLGTFDSAEDAARAYDKAARSFRGPKAKTNFPPLPRPGRGGPPLADSALPGPWAFHQXEPVVQVNRPTSSGMSSTVESFSGPRVPSSSSRAKPLVVVVNPIIPLNDDEDDCHSDCDSSSSVVDDGQDCVLISSFRQPLPFDLNLPPSDADDDNDDDLPATALCL

SEQ ID NO: 1664 - protein, 217 aa, Brassica napus
MATEQEAETVRETSSVSGRFPRNRDLYLFLPFFLGFSNQESPDRDGDVASTRDRVILVNPFTQGMIVLEESSGLNPLLRGLIESREEGHPPASKASIDAMPVVDIEDCQGECVICLEEWQAGETVKEMPCKHRFHGGCIEKWLGLRGSCPVCRFEMPVDGDEAGKKSNDGREIWVRFSFNGGGRSVRDSSGHDHGNSDGDGNTVRSGVTRPVLESEN

SEQ ID NO: 1665 - protein, 505 aa, Arabidopsis thaliana
MSSTFNPAASSPDEEGTGEVKIEDQCVENKQSTPASCSSVSEGSAGSSHKSPTIASPATVSPTHRYLGRTSGPIRRAKGGWTPEEDETLRQAVDTFKGKSWKNIAKSFPDRTEVQCLHRWQKVLNPDLIKGPWTHEEDEKIVELVEKYGPAKWSIIAQSLPGRIGKQCRERWHNHLNPDINKDAWTTEEEVALMNAHRSHGNKWAEIAKVLPGRTDNAIKNHWNSSLKKKSEFYLLTGRLPPPTTTRNGVPDSVTKRSSSAQKRVFGSVAQTSSVTTDVNNLAEDGNGQINSSVPVEEVVAASRMTSLNEYARSPQLPNPEPLPENGGAANNGYHLYYTPQIDYYRASEVDTQRMYGNECGCSPSASPVSFFTPPPCRNVHSNGSTPRSPESYLREAGRTYPNTPSIFRKRRPRVVVQDNNNAKKTDEAKEVDQKVNDGKDSSEIQNNGSNAYNLSPPYRIRSKRTAVFKSRQLEFISREEEKADDETKSSEKDMLIDGDSQLLG

SEQ ID NO: 1666 - protein, 383 aa, Zea mays
  misc_feature (99)..(99): Xaa can be any naturally occurring amino acid
MEEERCFNNWDLDAVVRLGCRRRLSPPRQPDPFASLLPPTLPSPSPSPPQKEKPVVPALAKGPEPEPYAGWRFPNLGAGGGQDGDELMRAMLAVQPSLXSLCQRQRPTPTPTLPPAAGEHRQSTVTAVDVPLPQVRPAPAARAQPSGRQVPGSVPRSKRRKNQVKKVVCHVPADGSSSDMWAWRKYGQKPIKGSPYPRGYYRCSSSKGCAARKQVERSRADPNTFILTYTGEHNHAAPTHRNSLAGTTRNKFPSSAAPPPPPPSVVVGGAGAGDAQHQQPSPSPASTSTAGLSPTTPLRTPSMEEEEMDDDDDELLVEDMEMVGEDELLFLNIDADAEADSGAPLEPMPSLFDVVDEPFLNSPWVTATSSAGEPATGAAGARS

SEQ ID NO: 1667 - protein, 393 aa, Arabidopsis thaliana
MEAEIVRRSEVTGLRREVEESSIGRGDCDGDGGDVGEDAAGFVGTSGRGRRDRVKGPWSKEEDDVLSELVKRLGARNWSFIARSIPGRSGKSCRLRWCNQLNPNLIRNSFTEVEDQAIIAAHAIHGNKWAVIAKLLPGRTDNAIKNHWNSALRRRFIDFEKAKNIGTGSLVVDDSGFDRTTTVASSEETLSSGGGCHVTTPIVSPEGKEATTSMEMSEEQCVEKTNGEGISRQDDKDPPTLFRPVPRLSSFNACNHMEGSPSPHIQDQNQLQSSKQDAAMLRLLEGAYSERFVPQTCGGGCCSNNPDGSFQQESLLGPEFVDYLDSPTFPSSELAAIATEIGSLAWLRSGLESSSVRVMEDAVGRLRPQGSRGHRDHYLVSEQGTNITNVLST

SEQ ID NO: 1668 - protein, 156 aa, Brassica napus
  misc_feature (68)..(68): Xaa can be any naturally occurring amino acid
MGFPLGYSELLLPKIFLHVLSFLGLIRKLISTLFWFIGLPDFLEAEPVTSSWPDPPPNSTTSSHHDSXLFSAALLAGEILPIVKFSDLNRPESECCAVCLYDFENEDEIRRLTNCRHIFHKECLDRWIMDYSQMTCPLCRTQFIPDDLQRSFNQKL

SEQ ID NO: 1669 - protein, 142 aa, Brassica napus
VVLSITERLVQAVEHIRDYTTERGSLIQLWVPVNRGGKRVLTTREQPYSHDPTCQRLANYREVSVNYHFSAEKDDSKALAGLPGRVFLGRLPEWTPDVRFFRSEEYPRVHHAQDCDVRGTLAIPVFEQGSKVCLGVIEPTRP

SEQ ID NO: 1670 - protein, 307 aa, Glycine max
MEDIYKMNPLLSCPGGDVVREVNVNVNSAIAASASELNLGLVANNFFQLEEPESSDMSDRFIKTQIATHPLYPNLVSAYIECRKVGAPPELASLLEEIARESHPTDALREIGNDPELDEFMESYCEVLHRYKQELSKPFNEATLFLCSIESQLSNLCKGTLTMPLNNNRSDEAAGISEDELSWEKVEAVDGDESSGPRPGDQELKEMLLRKYGGYLSSLRKEFLKKRKKGKLPKDARMILMDWWNTHYRWPYPTEEEKVQLSEMTGLDQKQINNWFINQRKRHWKPTEDMRFAIMDGVSGSGLGGPM

SEQ ID NO: 1671 - protein, 636 aa, Zea mays
  misc_feature (250)..(250): Xaa can be any naturally occurring amino acid
MGCCQSRLERLEAVSRCKARRRYTKHLVQARRDMAAAHALYLRALRATGASLLHFASAEADHPHPHSSAAHHEPPPSPPPPPPPPPLSPSTTARSWTTNSSSISASAILPPPPPPPLPPLPSSWDFWDPFAPSSSRSAADDADWDDAATTVVDAPIAAPPPVVTAAAAVAAPPSIVTATTTSTTPSELTVVAVPRGGAGKKDLAEIATELDEYFLKAADAGARVAALLEAPVCEPPEPTTNSSLPGKVLXLQQELEAHGMGMGRRRVWERFGRGDGGMPMGNGGGGGMLSHSSTVEKLYAWEKKLFLEVKSYEGYKQEHDKKVSLLRKQEVKGVDYLKMEKNKMEIESLESKMLVANQSIETTTSEIIRLRESELFPQLLELIAGLMSMWRGMYECHQVQTHIVQQLEYLNNARNTNPTSNVHRQAALQLEIEVDRWYSAFCSLVKSQRDYVYSLTGWLRLSLFCHHDPLTKAQNSDIYGLCEEWQLAIDRIPDKVASEGIKTLLTVIHAVVIQQAEEHKQKKRAESAFKEFEKKAEELRALESKYVGAEGYREMSRKSSVADKRAKVEALRSRADEEKIKYEKSIGVTRAMTLNNLQTGFPNVFQAMTGFASVCMEAFESVYNFKRSSDPKRLLT

SEQ ID NO: 1672 - protein, 155 aa, Brassica rapa
MPVPLAPYPTPPATPLAPAYTPPSPANGSTGGQSQLVCSGCRNLLMYPVGATSVCCAVCNAVTAVPPPGTEMAQLVCGGCHTLLMYIRGATSVQCSCCHTVNLALEANQVAHVNCGSCKMLLMYQYGARSVKCAVCSFITSVGGSTSTTDQKLNN

SEQ ID NO: 1673 - protein, 221 aa, Nicandra physalodes
IIFSATGKLFDFASSSMKDILGKYKLQSGNLEKVDQPSLDLQLENSLNMRLSKEVADKTRELRQMRGEELEGLSLEELQQIEKRLEVGFNRVLEIKGTRIMDEITNLQRKGAELMEENKLLKHKMEMMNEGKLPIQTEIECMVMEEGQSSESIITTNNNSGPPLDQDDSSNASLKLGCNNNGPAVEDDSSNASLKLGCNNNGPAVEDDSSITSLKLGLSFS

SEQ ID NO: 1674 - protein, 335 aa, Oryza sativa
MSSTMPAQGGVRHHRTCRMYWCYQCGRAIRIISYPSTDVFCPRCFGRFLHEIDPPPRPAPPPPHFFPQPYHPHYDGHPRRWLIYGGEAPPVAAPGRAFRQPAPAVPGRAFRQPGPAPAPSPAPAPPRRRMPSPPPVARRPSTPPAIDPGNYFNGPNLNNLIEELTQNDRPGPAPAPSSAIDSLPTVQITGAHLSDGSQCPVCKEDFELGEAARQMPCKHVYHSDCIVPWLRLHNSCPVCRYQLLSSAAAGSNANSRARRGSANNGGGGGGGDGRDREQTIVRWGPFSWMWPPRGLEDPDDGWEYGRRGRPEAGDAGGRMCNDHGNFRKLVTMMDG

SEQ ID NO: 1675 - protein, 192 aa, Nolana humifusa
IIFSATGKLFEFASSSMNDILGKYKLHSASLEKVEQPSLDLQLENSFNTRLSKEVADKTKELRQMRGEELEGLSLEELQEIEKRLETGLNRVLEIKGTRIMDEITDLQRKGAELMEENKQLKEKMAIMNEGKLPLLSDMDCMVMEEGQSSESIITTNNVCSSNSGPLPEDDCSNTSLKLGCNNGPAVEDDCS

SEQ ID NO: 1676 - protein, 207 aa, Ostreococcus tauri
MASRRKDWLALVAVHGDAWLMAVAFYYGAKFDAKKRDALFAKINGVSTVYETLCAAHGRDDKAHESEASARNGGSSNGGAKARGGDAARSNGVKAKKVKIDPADAQGFNKPSPGFILEPSQPLSELKNAQIEVRIPVPGVRLRTIDDATATQLFWPDDNLWYRAEVISLNERNRTAKVLYATSDVETLDLDELIQEGHVNIRRDPQQ

SEQ ID NO: 1677 - protein, 552 aa, Saccharomyces cerevisiae
MSTDFDRIYLNQSKFSGRFRIADSGLGWKISTSGGSAANQARKPFLLPATELSTVQWSRGCRGYDLKINTKNQGVIQLDGFSQDDYNLIKNDFHRRFNIQVEQREHSLRGWNWGKTDLARNEMVFALNGKPTFEIPYARINNTNLTSKNEVGIEFNIQDEEYQPAGDELVEMRFYIPGVIQTNVDENMTKKEESSNEVVPKKEDGAEGEDVQMAVEEKSMAEAFYEELKEKADIGEVAGDAIVSFQDVFFTTPRGRYDIDIYKNSIRLRGKTYEYKLQHRQIQRIVSLPKADDIHHLLVLAIEPPLRQGQTTYPFLVLQFQKDEETEVQLNLEDEDYEENYKDKLKKQYDAKTHIVLSHVLKGLTDRRVIVPGEYKSKYDQCAVSCSFKANEGYLYPLDNAFFFLTKPTLYIPFSDVSMVNISRAGQTSTSSRTFDLEVVLRSNRGSTTFANISKEEQQLLEQFLKSKNLRVKNEDREVQERLQTALGSDSDEEDINMGSAGEDDESVDEDFQVSSDNDADEVAEEFDSDAALSDAEGGSDEERPSKKPKVE

SEQ ID NO: 1678 - protein, 207 aa, Glycine max
MGSSEMDKTTKEKESKTPPPPTSQEQSSTTGTGTINPEWPGFQAYSPIPPHGFLASSPQAHPYMWGVQQFMPPYGTPPHPYVAMYPPGGIYAHPSMPPGSYPFNPFAMPSPNGIAEASGNTPGSMEADGKPSEVKEKLPIKRSKGSLGSLNMITGKNNEHGKTLGTSANGIHSKSGESASEGEGTSEGSDANSQNDSQLKSGGRQDS

SEQ ID NO: 1679 - protein, 364 aa, Arabidopsis thaliana
MNNIDDAKTETSVSSGSSDSFLPLKKRMRLDDEPENALVVSSSPKTVVASGNVKYKGVVQQQNGHWGAQIYADHKRIWLGTFKSADEAATAYDSASIKLRSFDANSHRNFPWSTITLNEPDFQNCYTTETVLNMIRDGSYQHKFRDFLRIRSQIVASINIGGPKQARGEVNQESDKCFSCTQLFQKELTPSDVGKLNRLVIPKKYAVKYMPFISADQSEKEEGEIVGSVEDVEVVFYDRAMRQWKFRYCYWKSSQSFVFTRGWNSFVKEKNLKEKDVIAFYTCDVPNNVKTLEGQRKNFLMIDVHCFSDNGSVVAEEVSMTVHDSSVQVKKTENLVSSMLEDKETKSEENKGGFMLFGVRIECP

SEQ ID NO: 1680 - protein, 366 aa, Vitis vinifera
MERGSSSLTVSSSSANSSESLNGLKFGQKIYFEDLGVGAPAKSGTGSSSSSSAAGSGSGVVQGGQPPRCQVEGCKVDLSDAKAYYSRHKVCGMHSKSPTVIVAGLEQRFCQQCSRFHQLAEFDQGKRSCRRRLAGHNERRRKPPPGSLLSSRYGRLSSSIFENSSRVGGGFLMDFAAYPRHPERDTWPTTRASDRVPGNQTTAMGRFLPHPWQSNSENPLFLQGSAGGTSFHGPGIPSGECFTGASDSSCALSLLSNQPWSSRNRASGLGANSFMNPEGASMAQPTAPHSAAINHFPSTSWDFKGNEGSSSSQEMPPDLGLGQISQPINSQFSGGGELPQQSGRQYMELEHSRAYDSSTQQMHWSL

SEQ ID NO: 1681 - protein, 636 aa, Podospora anserina
MLEDPSYNSVVRWSPEGDSFVVLEKFTKTILPKHFKHSNFASFVRQLNKYDFHKVRHNEESGEAPYGRDAWEFKHPEFRADRKDQLDNIRRKAPAPRKPPPTEDAFPASQQIVVLSESLNATNVQIQTLQEQYLELDRTNRLLVAEVLSLQKMLRAQSQASNELISHLNNMEDRRRNSRHSAQSSHSSHSGTNYHQGTLGLLPDGTDEPAPELRRAREILNGVSPDSQADRELERLSMAYHQNGSPAESAGSSVMFTHAGPQTSMNVVHDPFSDPRHLVYPVGQTQGIDPFHADHIHNIPYSRPLSNPNVMTEAPSQISPPPGKEQNGSLWRGKKPQILLVEDDKTCARIGSKFLTNMDCSVETARDGLEAVEKINTDADRFDLVFMDIIMPNLDGVSATAMIRMVTPQIPIIAMTSNIRQEDIQTYFQFAKPFTRDGMVRILKKHLTRMLKDPQSAGVLNDPNDPTSAGNGGGGQQTAGGPGPPTGGYANANMAASMQAAINQAAQVQVKYEQTPIPSPSTTASWHSPGTTMQQVQHQQVQQQQQHASPRLDQGGYMNAVGSGQGVGGMVLTPGGSQRGPGPGQQQQQQYAGYMQAGPGPVTRLPEMGGMGGGAGDDRPEKRQRLYGPGQGGYVG

SEQ ID NO: 1682 - protein, 166 aa, Capsicum frutescens
MAANNPSANMLDGSFRSLDSPDSDDFSNHLINFELSDILEIDNWPIQQDPTLIPQYSNYAANQVVNTSSYQEEPSNNIGSSSSKRKEVKDKVAFRTLSQIEILDDGYKWRKYGKKMVKNSPNLRNYYRCSVEGCPVKKRVERDKEDSRYVITTYEGVHNHQGLSPF

SEQ ID NO: 1683 - protein, 480 aa, Zea mays
MEGRMTSLEATMKVSSSMASSISRNADPDQQTLRPNSVEQFYFPRPGQSLPGIPPFFGPPSSSLYLPNDNEAKFGNQFESNPSQNTDWDPQAIVSNLTFLEQKIKQLISTAGSLLPSMKNPLLSSNPAVRQLGNTLGSPMGLGMNANQRPSVDSKTDIPDTGKTSDYDELMNSLNPAQDERDEMIKCPNPCGGEGSEPTPMEDHDVKESDDGGEGENLPPGSYVVLQLEKEEILAPHTHFCLICGKGFKRDANLRMHMRGHGDEYKTPAALAKPTKDSGADHAPVTRYSCPFVGCKRNKEHKKFQPLKTILCVKNHYKRSHCDKSYTCSRCNTKKFSVIADLKTHEKHCGRDKWLCSCGTTFSRKDKLFGHVALFQGHTPALPMEDVKVSEASEQPQDSEPMNEMARSNMYSFPCSSSDGISNLDMKMADDVRGYFSPLNFDPCFGALDDFTRPGFDISENPFSFLPSGSCSYGQQNGDS

SEQ ID NO: 1684 - protein, 237 aa, Solanum lycopersicum
IANMADQSNGAGASGTLAFDAEYSRWLEEHNKHINELRTAVNSHASDPELRSIVNNVTAHYDEVFRVKGNAAKADVFHVLSGMWKTPAERCFMWIGGFRPSELLKLLVNQLEPLTEQQLAGIYNLQQSSHQAEDALSQGMEALQQSLAETLANGSPATEGSSGDVANYMGQMAMAMGKLGTLEGFLRQADNLRQQTLQQMHRILTTRQSARALLAISEYFSRLRALSSLWLARPREQ

SEQ ID NO: 1685 - protein, 434 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGKEAEAIKAKILAHPQYPSLLGAYIDCQKIGAPPEVVARLDALTHEYENQQHRTTVSIGMDPELDQFMEAYCEMLTKYHEELTKPFKEAMSFLKKIEAQLNSLSKGTIRISPSAENDEKTEGGASSEEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 1686 - protein, 420 aa, Picea sitchensis
MDRQRSVCSKQGQRFDLCTNNVATMDLITDPLNSEGPDRQGFTFPTLVRHQNLGFSNSSMQEMFEESASSSSSPSNGDAKLEGLDAWQNLRMPEASQAFGNSEILCSSSSFFPNLPSNGFGHSDGLVWRPSFQGQNQCSGESIGSAMVLYDLLHAQQIQQLQQQLQLQQHQSAAASIHQMGRNPLGPRAQPMKLHSSGLSKAAKLYRGVRQRHWGKWVAEIRLPRDRTRLWLGTFDTAEEAAMAYDKAAYRLRGEYARLNFPHLKRHLEANSFAPWTGNSVLPSAVDAKLQAICQSLKLPMEKMSKTEESEEISCAYENSGSLGSVQDEDAKKNDVVSVKSETCESDSSDDSTITALNSAGESESPSASKSETQADTETDTLCSMPSFSASSIWAELDDYLLSIPSLDMDINWDDINSCL

SEQ ID NO: 1687 - protein, 279 aa, Vitis vinifera
MEELEVDHQCTSEASSSSATSEGTPSKDGEKAKTLKMKGKGKVIAEGSEAEPKSESGSSLLLDLRLSNDDSTVELNLCNSLNMASSPKTKMMEREKQSDRRVFSCNFCKREFSTSQALGGHQNAHKQERAMAKRRQGMDMPGFGHPHFHYYTYSSIPHVPLYGSFNRSLGVRMESMIHKPPYSWMTPPPSGYQFGHGGWLKPTMMSPQSSFEHRMRREDFQIHGGGSSGFGAPAGPSSTIEGSGGGGAISSLVGGSNSNGNDSSILANKTSGGVMKNIY

SEQ ID NO: 1688 - protein, 934 aa, Chlamydomonas reinhardtii
MASMAAELRPSDGGSSLHMLDSLLMMGLSSGGGVGGGGSSQSQILDSAGAAELAALLLPQHSNDPLHLMSTGDAALGLAGPMAAAEHHQHHPHHQHHSVPATAGFPSQTPPPPLFSNATAGAAPATRVRAAGSCGSGGVAGGTTSHSSEDGVFHSADPHHHHQQHLQQPQPQQQQQQQQQPQHQQQQQQQQQQQPQQPQFHHHQPQQHQAQQAVAATAPAAAADHLFLPPAAAGAAGQQQAGWGAATGAHLFHSDAPNRPNGPKTPTNRNGYAMKPPPPAAAAAVMSGHAMAASGVVAGRGGGGGGCDAEEDELTFAAAAAAEVSSDDEVMGGRGGAVMGRAAVGGFRTPAPAPASAGAAVNVAAAAPAAPAGTWVPKGKPAVEVSAWAPAPAAPVAAAAAAAVAVSPTVAAFAAAPVVEAVALVRSQQRQEQEHQLVQVAAAEQQDQQQAKRPVRSSRRRAQESQQAAAEAQQAAQQAAAAQQQQQHTGSGNIVGDKQGKPQGGLQQGRPVATQPSPPPPAVATAAAAAAATAPVATAPVATVATAATADTMPQRLTAVQQHEAYPAVVRGTLDVRKACLPRFPLVAREQAEAELQSVATAALQQAAAAPGASAAVTAAAAAAAAAATAAGEGKAGEGKAATARRGGRGAAEAEAAAALPAVGASGNPGLDEAMGAYVRVAALYGDEAAAAVAECESLMADFDNKLQLGNLATTFAAAASPTAAASGRARGGARSGGVGGGGTKRVASGANASGANSSGMSGGGGGDSAGAEAAAGDEMEWAPGATSVDTATGGADDEDGEEEEGQQPGGAAAAAAVAAAGGEASQLAASIAATYGSQLVQVAASLAQRPKVGKLPPAATQLLKGWWDDNFVWPYPSEEDKKQLGEAAALNNTQINNWFINQRKRHWHKHFPNRRPPSTREEAERLLRAAGAI

SEQ ID NO: 1689 - protein, 226 aa, Triticum aestivum
MAGRRERIAIRRIENLAARQVTFSKRRRGLFKKAEELSILCDAEVGLAVFSATGKLFQFASSSMNQIIDRYNSHSKILKKADEPSQLDLHEDSNCARLRDELAEASLWLQQMRGEELQSLNVQQLQALEKSLESGLGSVLKTKSQKIMDQISELERKRVQLIEENARLKEQASKMEMQVAADSPVVYEEGQSSESVTNTSYPRPPLDTEDSSDTSLRLGLPLYNSK

SEQ ID NO: 1690 - protein, 428 aa, Sorghum bicolor
MSISVNGQSVVPPGFRFHPTEEELLTYYLKKKVASERIDLDVIRDVDLNKLEPWDIQEKCRIGSGPQNDWYFFSHKDKKYPTGTRTNRATAAGFWKATGRDKAIYASGARRIGMRKTLVFYKGRAPHGQKSDWIMHEYRLEPALDVDAAAGSASAHHAAAGAAADHHPYYTSSSPPALPTAIRGAAGDQQAAQEQEGWVICRVFKKKNLVHHGQSSGGGVTAAGSKMASAAAPMEGSPSHCSSVTVISDHTMNKHQAQAMLQHSASDDDALDHILQYMGGGGGKQPDTKPVLLDHHHHHHLAAAATTTTTACSAGGAGLYGKFMKLPPLEHAGGGGGLLPSPAGACDYGAADASGIADWDALDRLAAYELNGLSDASKNMSAFFDEPSATAAFSSSSSSVHAAAVDGDLWSLARSVSALHADLTMNNV

SEQ ID NO: 1691 - protein, 999 aa, Oryza sativa Japonica Group
MSSVMMTSDNGKAPEKGGEASGPSSAPQEGEISNEPQRRRPLSGRTTGPTRRSTKGNWTPEEDSILSRAVQTYKGKNWKKIAECFPDRTDVQCLHRWQKVLNPELVKGPWSKEEDDIIVQMVNKLGPKKWSTIAQALPGRIGKQCRERWHNHLNPGINKEAWTQEEEITLIHAHRMYGNKWAELTKFLPGRTDNAIKNHWNSSVKKKVDSYMSSGLLTQVSCLPLNEYSAHCNSSPALTQQNSEDSGSYAVREVENSSVCSQSSLAKVSCSQVHNANVALGCDLQVNANVDNNEAHDSQSSVGHEACYTSVGAVATAIPEVHYHVSSSNFDPDQHLQEEFAQGLNLHMSMDEVPSNSSFADNPTICSIENHERSLEPYDVAMEMPLSMLPSDSGAEQKLHFMSEADFNSPNCLKSELWQDISLQSLLSGPDAVETDSFSRSNHQSDVYSSQADNEFLAPPYLLQTSNSSSVMEATYGQSPQMSVPPSLICSNVMTDVPSDNRSEPKEMTVSQAEMVTQSSSSSGDAEMSANPGSSNGSDIPSMMERIPECADQHVTNAEEPEASIEKEPSVTPSATADEKQDEGALFYEPPRFPSMDVPFVSCDLVTSGDLQEYSPLGIRQLMRSTMNVCTPMRLWGSPTHDESPDILLKSAAKSFICTPSILKKRHRDLVSPIPDKRIEKKSGTEKDCGVSDTSSIGIQTCFINATKDDAVITKSVLRIERSASSKPLEKKLEFSDENKENLDNTIEQAKDGQSAGNYKHIDEQARGERRTATNITTTYDDLPGNLQPAGILIEHNGDDLVSPDYGKNTMKQKQNTNMESLSVCKEGVSAKKPAELIVEKSSACINVDYEYVNILADTPGIKRGLESPSAWKSPWFVDMQFQGSYFVSPANGSYDALGLVKQINVQTAAALAEAREVLASGGQSENINSDKENLENPDAKKEPGATTKLQAKIKTEGKILDFNECATPIRSSDKKAGSSLGRSLSSPIPSSHLLKSFR

SEQ ID NO: 1692 - protein, 892 aa, Chlamydomonas incerta
MASILPAELRPSDGGSSLHMFDSLLLGLSSGGGGGGGGGGGGGSHSQILDSASAAELLMSQHSGDQLHLLSTGDAAGAMEADPQHQTTASAAAAAPAAPAPAAGGSFPALPPPPFRGTITTTIGTAPAAPASAAGSGGSVAGGGGGGGGGTASQSSEGGVFHPHRYHHQQQVVTPTSAQATAAATAAATAVAAATAEHLFLPPVALGAVSAGHAAGWGAATGAHLFHSDVPSHLTGHSHPNNNRNGHGVQPTQPALAAALMPARTRGGGVDDGCGEGDTEEGELTFAAAAAAADLSFDEEVIGARRQGPAAASGPGGGGASSGQVAAPDAAPAATPMVPKGKRALAAGALAAAPAPAPTAAVAAAKAVAPAAPVVEAVALVQSPPHPESSQGLQAEQQDPQQLQGKRPPVRSSRRVQEAAAQQQQVAQAAAQQAAVQSHAAGDKRQQATRGSRVAVKQEKDGEEASRLPGPKSSPPRAKGAAAAAPAPTGVTAAAATAAAGVAGAAAAAAATADTPSQRLARVQQHPAYPAVVRASLDVRKACLPRFPMGARDQAVGELQAAAVAALHQAAAAPGAPAAVAAAAVEAAAVVAVGEGKAAAAATAKRGGRGATGPEAAAAALSALGGSGNSELDEAMATYVRVAAVYSDEAAAAVAECESLMQDFDDKLQLGNLATTFAVATPAANGRPRGGVNGGATRAGGVGGGGMKRGAASCSEDLNGSVSNGGDAAGAGVGAAAEEAMDWAPGAGAASVDTAAGGGAEDEDGDEEGQMDGDRAAAGGEAPQLAASIAATYGSQLVQVAVNLAQRPKVAKLPEAARRLLTAWWEQHFVWPYPTEDDKKQLGGAAELNNTQINNWFINQRKRHWHKHFPNRRPPATREEAERHLRAAGVVG

SEQ ID NO: 1693 - protein, 148 aa, Brassica napus
MKIWCDVCDKEEASVFCCADEAALCNGCDRHVHFANKLAGKHQRFSLTSPTFKDAPLCDICGRRALLFCQEDRAILCRECDIPIHQANEHTKKHNRFLLTGVKISASPSTYPKASNSISTTVLSRAKTRPKSVSGEVPSSASSEVFAS

SEQ ID NO: 1694 - protein, 192 aa, Nolana humifusa
IIFSATGKLFEFASSSMNDILGKYKLHSASLEKVEQPSLDLQLENSFNTRLSKEVAEKTRELRQMRGEELEGLSLEELQEIEKRLETGLNRVLEIKGTRIMDEITNLQRKGAELMEENKQLKEKMAIMNEGKLPLLSDMDCMVMEEGQSSESIITTNNVCSSNSGPPPEDDCSNTSLKLGCNNGPAVEDDSS

SEQ ID NO: 1695 - protein, 224 aa, Arabidopsis thaliana
MAKTRPGVASKIKTGRKELDSYTIKGTNKVVRAGDCVLMRPSDAGKPPYVARVEKIEADARNNVKVHCRWYYRPEESLGGRRQFHGAKELFLSDHFDVQSAHTIEGKCIVHTFKNYTRLENVGAEDYYCRFEYKAATGAFTPDRVAVYCKCEMPYNPDDLMVQCEGCKDWYHPACVGMTIEEAKKLDHFVCAECSSDDDVKKSQNGFTSSPADDVKVETKRRKR

SEQ ID NO: 1696 - protein, 188 aa, Solanum trisectum
IIFSATGKLFDFASTSMKDILGKFKLQSASLGIVDQPSLDLQLENSLNMRLSKQVADKTRELRQMRGEELEGLSLEDLQQIEKKLEAGFNRVLEIKGTRIMDEITNLQRKGAELMEENKQLKHKMAILKKGKLPLVTDMVMEEGQSSESIITTNNVCISNSGPPPEQDDSSNASLKLGGTPAVEDDCS

SEQ ID NO: 1697 - protein, 261 aa, Capsicum annuum
MALEALNSPTGTPTPPPFQFESDGQQLRYIENWRKGKRSKRSRSMEHQPTEEEYLALCLIMLARSGGSVNHQRSLPPPAPVMKLHAPSSSSAAEEEKEKMVYKCSVCGKGFGSYQALGGHKASHRKLVPGGDDQSTTSTTTNATGTTTSVNGNGNRSGRTHECSICHKCFPTGQALGGHKRCHYDGGIGNGNANSGVSASVGVTSSEGVGSTVSHRDFDLNIPALPEFWLGFGSGEDEVESPHPAKKSRLCLPPKYELFQH

SEQ ID NO: 1698 - protein, 240 aa, Physalis alkekengi
AGNNITARQVTFSKRRRGLFKKAEELSVLCDADVALIIFSSTGKVFDFASSSMMDILGKYKLQSANLEKVDQPSLDLQLENSLNVRLSKQVADKTRELRQMKGEELEGLSLEELQQIEKRLEAGFNRVLDIKGTRIMDEIAKLQRKGAELMEENKQLKQKMEMMKAGKLPLLIDMDCMVMEEGQSSDSIITTNNVCSSNSGPPPEDDCSNAYLKLGCNNGPAAVEDDFLITSLKLGQPLS

SEQ ID NO: 1699 - protein, 580 aa, Oryza sativa Japonica Group
MSSAAGGGGGYGGGGGEHQHQQQQHHLLLGQAAGQLYHVPQHSRREKLRFPPDHPAESPPPPPPGSWPLPPAFYSYASSSSSYSPHSPTLAHAQLVAHGMPPGAATSGGAQIPSQNFALSLSSASSNPPPTPRRQFGGGGGGGGAAGPYGPFTGYAAVLGRSRFLGPAQKLLEEICDVGGRPAQLDRGSDEGLLDVDAMDAAGSVDHEMDGSDRAVADAVTVSGAEQQWRKTRLISLMEDVCKRYRQYYQQLQAVVSSFETVAGLSNAAPFASMALRTMSKHFKYLKGIILNQLRNTGKGATKDGLGKEDTTNFGLMGGGAGLLRGNNVNSFSQPHNIWRPQRGLPERAVSVLRAWLFEHFLHPYPTDSDKQMLAKQTGLTRNQVSNWFINARVRLWKPMVEEIHNLEMRQLQKNPSLDKNQLSMQHTQHSSDSSGKPCDPSNSLQGQSSSMTRNHSISASRHIEDGLSQMPHDISGQVSFAYNGLAAHHSIAMAHHHQPDLIGTGGAANAGGVSLTLGLHQNNNRAYIAEPLPAALPLNLAHRFGLEDVSDAYVMSSFGGQDRHFTKEIGGHLLHDFVG

SEQ ID NO: 1700 - protein, 183 aa, Solanum sisymbriifolium
IIFSATGKLFDFASTSMKDILGKYKLQSASLDKVEQPSLDLQLENSLNTRLSKQIADKTRELRQMRGEELEGLSLEELQQIEKKLEAGFSRVLDIKSTRIMDEITNLQRKGAELMEENKQLKQKMEIMKKGKLPLVTEMVMEDGQSSESIITTNNVCSSNSGPPPDQDDSSKIGGNAVEDDCS

SEQ ID NO: 1701 - protein, 355 aa, Triticum aestivum
  misc_feature (60)..(60): Xaa can be any naturally occurring amino acid
  misc_feature (69)..(69): Xaa can be any naturally occurring amino acid
  misc_feature (124)..(124): Xaa can be any naturally occurring amino acid
  misc_feature (131)..(131): Xaa can be any naturally occurring amino acid
  misc_feature (153)..(153): Xaa can be any naturally occurring amino acid
  misc_feature (271)..(271): Xaa can be any naturally occurring amino acid
  misc_feature (344)..(344): Xaa can be any naturally occurring amino acid
APRGNTPPSTLPGPCPRPRRSRASADGLPTAPSLPVAIADESVTSRSASAQSASSRFKGXVVPQPNGRXWGAQIYERPARVWLGTFPDEDSAARAYDVAALRYRGPRGPPPTFPCAAAEAELAXLAAHSKXAEIVDMLRKHTYADELRQGLRXRGRGMGARAQPTPSWAREPLFEKAVTPSDVGKLNRLVVPKQHAEKHFPLKRTPETTTTTGKGVLLNFEDGEGKVWRFRYSYWNSSQSYVLTKGWSRFVREKGLGAGDSIVFSCSAYGXEKQFFIDCKKNKTMASCPADGGAATASPPVAEAANGEQVRVVRLFGVDIAGEKRGRVAQAEQELFKRQCVGTXQHSPALGAFVL

SEQ ID NO: 1702 - protein, 349 aa, Triticum aestivum
  misc_feature (141)..(141): Xaa can be any naturally occurring amino acid
MYHQQCELLMPHEGLDMDAGQSHHLAAASAVPAELNFHLLSYVDAAVSPQQPTVEYFFGGADQPHAQFEQLAANHQAMTVLRDYYGQYPATADAYLPGGGPRTGSSSLVFGAAEEESAYMVGGFQCSPKPRASGSRKRGRXAGSSFHGFPANGGVEKKEKQRRQRLSEKFTALMLLIPNRTKEDRATVIYDAIEYIQELGRTVEELTLLVEKKRGRREHQGDVVDPAPLVVAGEGECSAGELAAAVMPAMPPPPQPIRSTYIQRRSKETFVDVRIVEDEVNIKLTKRRRDGCLAAASRALDDLHLDLVHLSGGKIGDCHIYMFNTKIHPGSPVFASAVASKLIEVVDEY

SEQ ID NO: 1703 - protein, 235 aa, Capsicum annuum
MGSPQENCSFDMIRQHLDDISLMEYYCPENTLYSQSCESLDQTSVSFETSSNLDDISSFFSSSKTDFGCFEFETKPITSAATSISSNSPKKRSFNERKPSLNIAVPVKPVVVQKVEVVREKKHYRGVRQRPWGKFAAEIRDPNRKGTRVWLGTFDTAVDAAKAYDRAAFKLRGSKAILNFPLEVANFKQQNSTVEVPQQVNSSGSKRAREKEELAINEKKKKKKKNLAAPRPSPI

SEQ ID NO: 1704 - protein, 292 aa, Triticum aestivum
MMAEAWVDVLPPPAPYFAGQPCWAVQQERRGGGAWTLEENKVFEEALAAIDLDAPDRWEMVALMLPRKTVADVVNHYRALENDVGFIEAGLVPFPHYDSSSPSSGFTLDWDGGAAGAGGFRRGYCLKRGRADQERKKGVPWTEEEHRLFLKGLKKYGRGDWRNISRNYVTSRTPTQVASHAQKYFIRLTSGGKDNKRRSSIHDITTVNVPDDDDRGSPSGSPPSALTTVDTKPSPSYGGQRHAFMPPTLPAGTLGGGHPYGNVKLEHQSSFMDGAGLDLDDSLLLQIQCGQL

SEQ ID NO: 1705 - protein, 416 aa, Arabidopsis thaliana
MKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 1706 - protein, 236 aa, Brassica napus
  misc_feature (196)..(196): Xaa can be any naturally occurring amino acid
MASLTSDNEQPPTNSNSSSTDHVRKKKSLFASSPSSSRGNAASVPTRDGDSHPRWRSEKQQRIYSAKLIQALRQVRLSSSSSATTSSPTAQKRGKAVREAADRALAVSARGRTLWSRAILANRIKLKFRKQKRPRQTVIPAVTTVVTTGATSSRGRKRRVSVVGLNKKSLPTVNRKVRSLGRLVPGCKKESVPVIXEEATDYIQALEMQVRAMNSLVELLSGYSTPGSDSAPPPIR

SEQ ID NO: 1707 - protein, 256 aa, Arabidopsis thaliana
MTEGGEYSPAMMSAEPFLTMKKMKKSNHNKNNQRRFSDEQIKSLEMMFESETRLEPRKKVQLARELGLQPRQVAIWFQNKRARWKSKQLETEYNILRQNYDNLASQFESLKKEKQALVSERLKEATQKKTQEEERQCSGDQAVVALSSTHHESENEENRRRKPEEVRPEMEMKDDKGHHGVMCDHHDYEDDDNGYSNNIKREYFGGFEEEPDHLMNIVEPADSCLTSSDDWRGFKSDTTTLLDQSSNNYPWRDFWS

SEQ ID NO: 1708 - protein, 170 aa, Physcomitrella patens subsp. patens
QLICSGCRTLLVYPQGASNVRCALCSSVTQVPPHGTEMAQLVCGGCRTLLMYMRGATSVQCSCCHTVNLAMEAPQVAHINCGGCGMTLMYAYGAQSVKCALCQFVTSITMLNVRVPLPSQQPRPPQAAGGPAPAPTSSHTQTVVVENPMTMDESGKLVSNMAVGVSTDRR

SEQ ID NO: 1709 - protein, 444 aa, Oryza sativa Japonica Group
MAPSKQQQMLLKKVMAKKPKTKRLSGFGLKPSAAFSRPHVPSAAASLQPSRRVRVVFEDPDATDSDSDDDEDAGAASKKRYFELFIGKPASSTKQASPASTVAAYANIGKVGSTCYRGVRLRKWGKWAAEIRNPFTGHREWLGTFDTADAASAAYQSASRNFAEEKRRRGVASSASPASSATPTPTASSSSSTSAAPFAHPSPSSVLEATKPAPKPESPPLPEQAATPLLVEATNETAELPDDPEFYKDILRGLQLPDIDPMDFRAGLDALDISDVPAYMNGEQDVLFTEDMLLGDFAEEDDLDLDDIGDDFCEDFPEIPSGYDFGRGDMFRQDSHASAHLGRGTAQLEATLRRWSEIRIYTNPARVLTGSMLRVADQEYTTATIPLAIAAYGEDKTSKSQTCPYTTTAGDKSVLLREDPKLPRLTDQLPVDMVSSAPDFSTFS

SEQ ID NO: 1710 - protein, 225 aa, Brassica napus
RENLDNLGFTLEPGSSENPVLSLPTDSTNLSERSSASPELNSRIPLSLLHADHMINSGTCVESKQELVPYQSDITADEQQQPSPDSRAIVPVPPLEPEALAIVPLNEKPKRTELSQRRTRRPFSVSEVEALVHAVEELGTGRWRDVKLRSFDDASHRTYVDLKDKWKTLVHTASISPQQRRGQPVPQELLDRVLAAHRYWSQHQVKQNGKHQAAAMMVVESGLSM

SEQ ID NO: 1711 - protein, 307 aa, Zea mays
MEDLYSIHPGISRAGGAATAASEVSGVAGGPGSPPPPPSQPPPPPPADLTELVKAQIAGHPRYPSLLSAYIECRKVGAPPEVATLLEEIGRERCAAASAGGEVGLDPELDEFMEAYCRVLERYKEELSRPFDEAASFLSSVRTQLSSLCGAAASLSDEMVGSSEEDEACSGGDTEATEPGQQEHSSRLADRELKEMLLKKYSGCLSRLRSEFLKKRKKGKLPKDARSALMDWWNTHYRWPYPTEEDKVRLAAATGLDPKQINNWFINQRKRHWKPSEDMRFALMEGVTGGGPSSGTTLYFDTGTIGP

SEQ ID NO: 1712 - protein, 467 aa, Oryza sativa Indica Group
MSTQSVIAVKQFSGPDKIAQAYTVPQPSAHVLSNANYDYDLCGSTNSTSLSCAIQSSNIKTESISSSSLPKILPFSTDSNGESSLSRMSQAEFSDPILSSSSTFCTSLYTSSPMNSGSCRKTGYLPFLPQPPKCEQQQNSVGQSSSSLMLLDADLRNSGHADDEHTDDLKDFLNLSSDCSFHGKCSAMAYNEQMEFQFLSEQLGIAISNNEESPRLDDIYDRPPQLMSLPVSSCSDQEDLQDARSPAKVQLSSSRSSSGTASCNKPRLRWTPELHERFVDAVNKLEGPEKATPKGVLKLMKVEGLTIYHIKSHLQKYRLAKYLPETKEDKKQEEKKTKSVANGNDHAKKKSAQMAEALRMQMEVQKQLHEQLEVQRQLQLRIEEHARYLQKILEEQQKARESISSMTSTTEGESPEFAPMEKTEDKAETSSAPLSKCRITDTDAECHSKVDNKKTKPQADLEMVHDE

SEQ ID NO: 1713 - protein, 191 aa, Salpiglossis sinuata
IIFSATGKLFEYASTSMNEILGKYKLHSGNLEKDDQPSLDLQLENGLNMRLNKEVAYKTRELRRMKGEELEGLSLEELQHIEKRLEAGLSRVLEIKGTRITDELTNLQRKSVELMEENKRLKQKMANMSEGKLPLLTEMECMVMEEGQSSDQSITTNVCSCNSGPPPEDDCSNTSLKLGCKNGSPVEDDCS

SEQ ID NO: 1714 - protein, 859 aa, Arabidopsis thaliana
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPALNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 1715 - protein, 1030 aa, Arabidopsis thaliana
MKREMKAPTTPLESLQGDLKGKQGWIAFGTKFCIQLDILRRTSGPARRSTKGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSNGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDNGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCDLVPSNSDLRQEYSPFGIRQLMISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNDQETSGSFFELRLCSPGMTRARPDNKVNASAKDLSNQHKISLGDFPTEEMSSEPLCTVDSIPLSAIDKTNTAETSFDIENFNIFDGTPFRKLLDTPSPWKSPLLFGSFLQSPKLPPEITFELKRLLMDVSSLLFIIFSSQDIGCFMSPGERSYDAIGLMKHLSEHSATAYADALEVLGNDTPESILKKRQLNKSIQGKENQHQPHDQLGNRSQVECRALDFSDCGTPGKAKVPSASPGGYSSPSSYLLKSCR

SEQ ID NO: 1716 - protein, 168 aa, Hyoscyamus niger
IVFSATGKFFEFASSSMDDIVGKYKLHSASLEQPSLNLQLEDSSNKRLSKEVSDKTRELRQMRGEELEGLSLEELQQIEKRLEAGLKRVVEIKGTRFVNEITELQRKRAELMEENKQLKQKLSLQTDMDCMVMEEGQSSESIITTNNICSSNSGPSPEDASLKLGQPL

SEQ ID NO: 1717 - protein, 472 aa, Oryza sativa Japonica Group
MQFTHTAPPPPPLHPNGHGLGLGLYLDVGATRGGGGARPWSSSSSTTTLGGSGYFPSSAAASKISLGNLNSTGCMEQLLVHCANAIEANDATLTQQILWVLNNIAPADGDSNQRLTAAFLCALVSRASRTGACKAVTAAVADAVESAALHVHRFTAVELASFIDLTPWHRFGYTAANAAIVEAVEGFPVVHIVDLSTTHCMQIPTLIDMLAGRAEGPPILRLTVADVAPSAPPPALDMPYEELGAKLVNFARSRNMSMDFRVVPTSPADALTSLVDQLRVQQLVSDGGEALVVNCHMLLHTVPDETAGSVSLTTAQPPVSLRTMLLKSLRALDPTLVVVVDEDADFTAGDVVGRLRAAFNFLWIPYDAVDTFLPKGSEQRRWYEAEVGWKVENVLAQEGVERVERQEDRTRWGQRMRAAGFRAAAFGEEAAGEVKAMLNDHAAGWGMKREDDDLVLTWKGHNVVFASAWAPS

SEQ ID NO: 1718 - protein, 407 aa, Petroselinum crispum
MGSSEMEKSSKETKEPKTPTSQEQVSPVVAGPAGPVTPDWSGFQAYSPMPPHGYMASSPQAPHPYMWGVQHMMPPYGTPPHPYVMYPHGGIYAHPSMPPGSYPFSPFAMPSPNGVAAEASGNTPGSMEADGGKVSEGKEKLPIKRSKGSLGSLNMITGKTNEASKPSGAATNGGYSKSGESASEGSSEEGSDANSQNDSQIKSGSRQDSLEAGASHNGNAHGLQNGQYANNSMVNQPISVVPLSTAGPTAVLPGPATNLNIGMDYWGGATSSAIPAMRGQVSPPITGGTVSAGARDNVQSQLWLQDERELKRQKRKQSNRESARRSRLRKQAECDELAQRAEALKEENASLRAELSRFRTEYEKIVAQNEVLKEKIREVPGQEDQWPGRNDQHNGNGSRETGHTEPA

SEQ ID NO: 1719 - protein, 446 aa, Zea mays
DADDDSAAAAAEAVVTRQFFPAPAAVGAAPGPGSSSARAGWLRLAAAAPPPAAGGSNGVAQTGGPAAAAAAAGKKSRRGPRSRSSQYRGVTFYRRTGRWESHIWDCGKQVYLGGFDTAHAAARAYDRAAIKFRGVEADINFSLEDYQDDMKQMGHLSKEEFVHVLRRQSTGFPRGSSKYRGVTLHKCGRWEARMGQCHCRYVYLGLFDTEEEAARAYDRAAIKCNGKDAVTNFDPSIYAEELEPAASTGGGGDDHNLDLSLGSSAGNKRGSLDDGVGGGGEDETSDQRVPMAFDVDWQTAAPRSTKAKLDASSKQPQTQMLPPPPPAVLRVAHQLPLPFGPRHPQSQFLSNGDPGTSGGLSLAIGGAGGGHWPPQLQHLQQQRLHGAWANGGGTSWPPPPHPHPHPPPPSTAAAASSRFPPYVVTTTQGPAGWAQKNGFHSLARPT

SEQ ID NO: 1720 - protein, 260 aa, Solanum lycopersicum
MALEALNSPTGTTSNPQTFQFESKGQQQLRYLENWTKGKRSKRSRSMDRQPTEEEYLALCLIMLARSDGSVNHVRSLPPPVPVMKIHETAEKMLYRCSVCGKGFGSYQALGGHKASHRKLIAGGDDQSTTSTTTNANGTTSSGNGNGNGSGTGRTHECSICHKCFPTGQALGGHKRCHYDGGNSNGNGNANANSSISASVGVTSSEGVGSTISHRDFDLNIPALPEFWPGFGSGEDEVESPHPAKKSRLSLPPKFELFQH

SEQ ID NO: 1721 - protein, 211 aa, Brassica napus
  misc_feature (24)..(24): Xaa can be any naturally occurring amino acid
CAQRKEEVESSGAMNNIGNYQSDXFFHQLISPNHHQDPSQSESFGGPSNNVGSGSTIFSQDSVSPIWPTFGRVGFDPFPPPSPASFYGSFFHRSRAHHQGLQFGYEGFGGATPATHHHHEQLRILSEALGPVVQAGSGPFGLQAELGKMTAQEIMDAKALAASKSHSEAERRRRERINNHLAKLRSILPNTTKVSRNFFVTSNFLIDYTFM

SEQ ID NO: 1722 - protein, 420 aa, Petroselinum crispum
MGSSGMDKSPKDIKEAKEPKIPTSQEQPSPAAAAAAAAAAAAAAGPVTPDWSGFQAYSPMPPHGYMASSPQAPHPYMWGVQHMMPPYGTPPHPYVMYPHGGIYAHPSMPPGSYPFSPFAIPSPNGVAEAFGNTPGSTEADGKVSEGKEKLPIKRSKGSLGSLNMITGKNNEASKTLGAAANGGYSKSGDSASDGSSEEGSDANSQNDSQIKSGSRQDSLEGESQNGNAHGLQNGQNANHSMVNQQISIVPITAAGTAGAIPGPMTNLNIGMDYWGGVTSSAVPAMRGKVTSPPITGGIVTAGARDNVQSQLWLQDERELKRQRRKQSNRESARRSRLRKQAECDELAQRAEVLQEENASLRAELGRARSEYEKALAQNAILKEKVGDVAGQEDQWPGRNDQHTGDEGQETGHIEPGQSGH

SEQ ID NO: 1723 - protein, 219 aa, Vitis vinifera
METFHSCLFFAFSRKNQQKRVVQHVTAEGLSSDVWAWRKYGQKPIKGSPYPRSYYRCSSLKGCLARKQVERSRTDPEIFIVTYTAEHSHSHPTRRNSLAGITRNKFSTPKKPSKAEPPSTPTTVANDSSSSPISTSDFSATTPLMSAMEDELQPYVSQQEIRGEEDQKLNERNNTNEVHISDEILNNDFFLGLEDMDFSVQFPSSFLQPWFAATAAGGC

SEQ ID NO: 1724 - protein, 193 aa, Triticum aestivum
MAVAGQPMKRHGVAALPAQPAAKLYRGVRQRHWGKWVAEIRLPRNRTRLWLGTFDTADEAALAYDAAAFRLRGESARLNFPELRRGGEHHGPPLDAAIDAKLRSICHGEDLPQSQSNATPAPTPTLTPSSFPDVKSEPGCSVSESSSSADGEVSSCSDVVPEMQLLDFSEAPWDESLLRKYPSLEIDWDAILS

SEQ ID NO: 1725 - protein, 152 aa, Cestrum elegans
VGWPPIKSLRKSTLASSSKTNEEVDGKPGSTVLLIKVSMDGAPYLRKVDLRNYFAYQELSSALENMFSCFTIGECGSHGAPGKESLSESKLKDLFRGSEYVLTYEDKDGDWMLVGDVPWELFINTCKRLRIMKSSDAIGLAPRAMEKCRARN

SEQ ID NO: 1726 - protein, 265 aa, Fagopyrum cymosum
MRNPAVSSGAKTTPCCSKVGLKRGPWTPEEDERLANYINKDGEGRWRTLPKRAGLLRCGKSCRLRWMNYLRPNVKRGQIAPDEEDLILRLHRLLGNRWSLIAGRIPGRTDNEIKNYWNTHLSKKLISQGIDPRTHKPLSSAPNPNHGVVQTPKIADTPSTQKSFTFDPIRNPNANAFVLPSTTSPLDSFHGNSNTSHDPASVEDDQDTDPNYCTDDVFSSFLNSLINEDLYTTQTQQQYHFGAAGWDAPLMSASDPLRQTPPHQD

SEQ ID NO: 1727 - protein, 153 aa, Cestrum elegans
VVGWPPVRSFRKNTLATTSKNNEEVNGKAGSPALFIKVSMDGAPYLRKVDLRNYSAYRELSSALEKMFSCFTIGQYGSHGAPGKEMLSESKLKDLLHGSEYVLTYEDKDGDWMLVGDVPWEMFIDTCKRLRIMKGSDAIGLAPRAMEKCRSRN

SEQ ID NO: 1728 - protein, 337 aa, Arabidopsis thaliana
MRLDDEPENALVVSSSPKTVVASGNVKYKGVVQQQNGHWGAQIYADHKRIWLGTFKSADEAATAYDSASIKLRSFDANSHRNFPWSTITLNEPDFQNCYTTETVLNMIRDGSYQHKFRDFLRIRSQIVASINIGGPKQARGEVNQESDKCFSCTQLFQKELTPSDVGKLNRLVIPKKYAVKYMPFISADQSEKEEGEIVGSVEDVEVVFYDRAMRQWKFRYCYWKSSQSFVFTRGWNSFVKEKNLKEKDVIAFYTCDVPNNVKTLEGQRKNFLMIDVHCFSDNGSVVAEEVSMTVHDSSVQVKKTENLVSSMLEDKETKSEENKGGFMLFGVRIECP

SEQ ID NO: 1729 - protein, 279 aa, Glycine max
  misc_feature (84)..(84): Xaa can be any naturally occurring amino acid
  misc_feature (200)..(200): Xaa can be any naturally occurring amino acid
  misc_feature (228)..(228): Xaa can be any naturally occurring amino acid
  misc_feature (246)..(246): Xaa can be any naturally occurring amino acid
MVQQEVRKGPWTEQEDFKLVSFVGLFGDRRWDFIAKVSGLNRTGKSCRLRWVNYLHPGLKRGKMTPQEERLVLELHSKWGNRWXSRFARKLPGRTDNEIKNYWRTLMRKKAQDKKRGEAASSSSSSVDSSISSNNHAVDPHASKKAGEESFYDTGGHGVTASTQDQGQKGEQGLFSMDDIWKDIDNMSEENNTTLQPVSXYEGHSEEGCNFSCPPQVPSPSSWEYSSXDPLWVMDEESLFCPLSEXPYFSCYAQGTVFFNRLILLFFFKSIFVHSISCV

SEQ ID NO: 1730 - protein, 426 aa, Oryza sativa
  misc_feature (155)..(155): Xaa can be any naturally occurring amino acid
MDMEHELRGGGVGAAAHGHGSICFSGGPVLVDGRRIQQLLLHCAAALESNDVTLAQQAMWVLNNIASSQGDPSQRLTSWLLRALVARACRLCAAAPAGAAVEFLERGRAPPWGRAMSVTELADYVDLTPWHRFGFTASNAAILRAVAGASAVHVXVDLSVTHCMQWPTLIDVLSKRPGGAPAIRITVPSVRPAVPPLLAVSSSELGARLAIFAKSKGVQLEFNVVESATTTSPKKTSTTLCQELASVLSDPPSLGLRDGEAVVVNCQSWLRHVAPDTRDLFLDTVRALNPCLLTVTDEDADLGSPSLASRMAGCFDFHWILLDALDMSAPKDSPRRLEQEAAVGRKIESVIGEEDGAERSEPGARLAERMSRKGFAGVVFDEEAAAEVRRLLSEHATGWGVKREDDMLVLTWKGHAAVFTGAWTPN

SEQ ID NO: 1731 - protein, 1224 aa, Arabidopsis thaliana
MDLSAKDEFSAEKRNPDNYDSVNNPSGDWRVDSYPSENLISAGPASCSPSQMMDSFGQTLWYDPTSVQAVGYAGFNGGNASSSSFRGSIDRSLEMGWNLPNLLPPKGNGLFLPNASSFLPPSMAQFPADSGFIERAARFSLFSGGNFSDMVNQPLGNSEAIGLFLQGGGTMQGQCQSNELNVGEPHNDVSVAVKESTVRSSEQAKPNVPGSGNVSEDTQSSGGNGQKGRETSSNTKKRKRNGQKNSEAAQSHRSQQSEEEPDNNGDEKRNDEQSPNSPGKKSNSGKQQGKQSSDPPKDGYIHVRARRGQATNSHSLAERVRREKISERMKFLQDLVPGCNKVTGKAVMLDEIINYVQSLQRQVEFLSMKLATVNPQMDFNLEGLLAKDALQLRAGSSSTTPFPPNMSMAYPPLPHGFMQQTLSSIGRTITSPLSPMNGGFKRQETNGWEGDLQNVIHINYGAGDVTPDPQAAATVLFVILRMASNYYSVQIKQCIGLGARNQSRYVKMIHGNIIRALPYPETFLYNNIVHAYALMKSSTYARRVFDRIPQPNLFSWNNLLLAYSKAGLISEMESTFEKLPDRDGVTWNVLIEGYSLSGLVGAAVKAYNTMMRDFSANLTRVTLMTMLKLSSSNGHVSLGKQIHGQVIKLGFESYLLVGSPLLYMYANVGCISDAKKVFYGLDDRNTVMYNSLMGGLLACGMIEDALQLFRGMEKDSVSWAAMIKGLAQNGLAKEAIECFREMKVQGLKMDQYPFGSVLPACGGLGAINEGKQIHACIIRTNFQDHIYVGSALIDMYCKCKCLHYAKTVFDRMKQKNVVSWTAMVVGYGQTGRAEEAVKIFLDMQRSGIDPDHYTLGQAISACANVSSLEEGSQFHGKAITSGLIHYVTVSNSLVTLYGKCGDIDDSTRLFNEMNVRDAVSWTAMVSAYAQFGRAVETIQLFDKMVQHGLKPDGVTLTGVISACSRAGLVEKGQRYFKLMTSEYGIVPSIGHYSCMIDLFSRSGRLEEAMRFINGMPFPPDAIGWTTLLSACRNKGNLEIGKWAAESLIELDPHHPAGYTLLSSIYASKGKWDSVAQLRRGMREKNVKKEPGQSWIKWKGKLHSFSADDESSPYLDQIYAKLEELNNKIIDNGYKPDTSFVHHDVEEAVKVKMLNYHSERLAIAFGLIFVPSGQPIRVGKNLRVCVDCHNATKHISSVTGREILVRDAVRFHRFKDGTCSCGDFW

SEQ ID NO: 1732 - protein, 304 aa, Oryza sativa Indica Group
MSGGGGREQMKGGEDVAAADCPGSPVSPSPAAAQRSAAGAAASPSGRSRRSAQKRVVTVPLADVTGPRPKGVGEGNTPTDSWAWRKYGQKPIKGSPFPRAYYRCSSSKGCPARKQVERSRNDPDTVIVTYSFEHNHSATVPRAQNRQAAPQKPKAQACSPPEPVVEVEPEETHQYGVTAGPATGGGGGAAAIEVRDEFRWLYDVVSVPASSTSPSDIDAADEMQLYDQPMFFGGAVVGTAALLPDEFGDVGGLGGEGLGEEEALFEGLGELPECAMVFRRRAGDGLAMGGGVKIEQPAESTAMT

SEQ ID NO: 1733 - protein, 511 aa, Vitis vinifera
MWDLNDSPDQRRDDESEGCSSQKTSVDSIDDKGKRVGSVSNENSSSSAVVIEDGSDEEDGERGQRKRSSKIFGFSVTHEDEGEPPVTRQFFPMEESEMGTTSCGGAAAFPRAHWVGVKFCQSEPLNTAGVATAKSLEASQPLKKSRRGPRSRSSQYRGVTFYRRTGRWESHIWDCGKQVYLGGFDTAHAAARAYDRAAIKFRGVEADINFSLEDYEEDLKQMGNLTKEEFVHVLRRQSTGFPRGSSKYRGVTLHKCGRWEARMGQFLGKKYVYLGLFDTEIEAARAYDKAAIKCNGKEAVTNFDPSIYENELNSSGNAADHNLDLSLGGSASKQNNLELGDDSQVVTMDQHSVGMSFEADWRSRGFRPKFNLQQEACKSDGDALRRNGYNEMETMQLLSHTHLQSPAALKPGEMYRYGQFRRAGETQMLHILPPQLSSPNYQIQFPSSSNGGRIAVNGGDLSLATNHQQWQSGPPQLFATAAASSGFPPQMIRPNQQWPQKNGFHSLIRPS

SEQ ID NO: 1734 - protein, 157 aa, Brassica napus
  misc_feature (147)..(147): Xaa can be any naturally occurring amino acid
MMDGVTGGDSKSGEATTAPPLRNPHPATLLGANALPPPFLSKTYDMVEDPASDAIVSWSPANNSFVVWDPPEFSRSLLPRYFKHNNFSSFVRQLNTYGFRKVDPDRWEFANEGFLRGQKHLLKTISRRKSTHGHGTSSSNTQSHQGXHMASLSSCVE

SEQ ID NO: 1735 - protein, 320 aa, Triticum aestivum
MSEPGANGARRRQRRRWRLYWCYVCRRALRTVSSPTSDVFCPRCLGRFLHEIELPVPREPVHAPTERLFQPPPLFPYEGAPRHWVIYRGEDDDDAADTPGPRLRRVPSPPPAPGTHGGLGGADAGPPATGIDPAGFFTGPNLNALIDGLTQNDRPGPPPAPASAIDSLPTVHVSPEHMADGSQCPVCKDEFELGETARELPCKHAYHSDCIVPWLRLHNSCPVCRQELPMPAGDESPDGAGAGDGGEETVPPWQLLAGWGPLAWLLTLGEPDVGGWDNGSRQRGTEADADDTGGNVSRGATILQSFVLVAACFFFVSFLV

SEQ ID NO: 1736 - protein, 347 aa, Zea mays
  misc_feature (39)..(40): Xaa can be any naturally occurring amino acid
  misc_feature (58)..(58): Xaa can be any naturally occurring amino acid
  misc_feature (190)..(190): Xaa can be any naturally occurring amino acid
LGTSRPAGTGPCLSAHLFVLAPMEATPISMKPPAPARPXXVTLEPIELSTHAVGLTEXERSSMNQLAIAPDPKRQRVEEAADGNGCKHCACKKSRCLKLYCPCFAGGGYCSDKCGCQPCFNKEAFSETVQTTRKVLLSRQKRMSMKINRRPEANAEPMEDAHHSSSSTPPRRGCNCKKSSCLKKYCDCYXFCRCDDCQNPFGKNDGIMADDSKRYLYTGADLDHSEGEHDFVVERSPRLQSPMSKESSFHQTPPHLRASSRDAHVFPHAISQWQALPRSWHCSNKRNSSDRAMDDSANYKNSNHDYWQVEKSVAPDVFLQPGNREIFVSLSGDVRAMWLKRKIQHLA

SEQ ID NO: 1737 - protein, 313 aa, Oryza sativa Indica Group
MEKTSAGKEEGSESKTAAANNDGSSTSSTTEEEESGESQRRTSSSSSVRPYIRSKNPRLRWTPELHLSFVRAVDRLGGQDRATPKLVLQLMNVRGLSIGHVKSHLQMYRSKKIDESGQVIGGGSWRSSDEQQYHHLQMQGGGDGGQAYNLGHLSLPAALHHRHITAGSGTILQSRVANAWSPWRCHGSYWLRAGHHLLVGSKPYYHPPPAEARANTSSNHPDFVQGSSSSPDDHTMNHQRPVVLKEMIYNEGSNHQGGPLNLDLSLDICPRGEKRKREFSWRKHEEDHDHTTIAIGGDQEAESCATGLSLSLF

SEQ ID NO: 1738 - protein, 405 aa, Oryza sativa Japonica Group
MDQSFGNLGGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGAHGGGAGSARLLLADGKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLDGWFELKSKLLVKLLDLDVLLPRAVNFIVSGFGNQACLVKHLEIMYTFPDDN

SEQ ID NO: 1739 - protein, 402 aa, Arabidopsis thaliana
  misc_feature (222)..(222): Xaa can be any naturally occurring amino acid
  misc_feature (280)..(280): Xaa can be any naturally occurring amino acid
MMIPHNHDRLSFSSFVHDQEHITPNPYPNSQPAASTKTPKKKRNLPGNPGMYPNAEVISLSPKSLMATNRFFCEICNKGFQREQNLQLHKRGHNLPWKLKQKTNKNQVKKKVYICPEKSCVHHDPARALGDLTGIKKHFSRKHGEKKWKCDKCSKKYAVISDWKAHNKICGSREFRCDCGTLFSRKDSFISHRSFCDVLAEESSKFFSVPSPLAANSTIATXTADLNVNNNHTTLFGQKFTNSNPTQQQPNALALSSPPSPRSTSDSVHNLWKLQEEECXSNPTDGNIASLFSYNQEAVNMASFSATTLLQKVAQTGTPSSSETSTTMFGQMTSSIFNNTMLNSYCLTAKNNEEELTRDFLGVGSSEDQQRLHRHRFPSSVPLTANHDIPKLAATIVGRKQP

SEQ ID NO: 1740 - protein, 240 aa, Liquidambar formosana
EFPNQSSEGSSSQKKMGRGEIEIKRIENTTNRQVTFCKRRNGLLKKAYELSVLCDAEIALIVFSSRGRLYEYANNSVKSTIERYKKASDTSIPGSVSETNAQFYLQESSKLRRQIRDIQNLNRHIMGEALSSLTFRELKNLEGRLEKGISRIRSKKNELLFAEIEYMQKREIELQNANMYLRAKIAENERNQQQTELMPGPVYETMPSSQPYDRSFLAANLLEPPNHHYCRQDQTPLQLV

SEQ ID NO: 1741 - protein, 388 aa, Oryza sativa
MEPATETTATSPAAAAAAQPEAEAEAEAESAATPVAVAAAAAATYQPPAPVVPVAVAGAAAGRGNGKRKRGRPRKYGPDGSLLRPLKATPISASVPDDSGGGQYTPAAAVGAVMKRGRGRPVGFVSRASPVSVAGTAATSTAAVVVSSPATHTQTPLGPLGELVACASGANFTPHIINVAAGEDVNMKVISFSQQGPRAICILSANGVISNVTLRQQDTLGGTVTYEGRFELLSLSGSFTPTDSGGTRSRSGGMSVSLAATDGRVIGGGVAGLLVAASPVQVVVGSFLPSYQLDQNATKKPVIEITTVPPPPPAIGFTISSGDPMEDSYSGSHGQHRSGAAAATTTTAKANSTSAFRVENWTPPAPPAAEAARTKTPSSEAKVPVPGA

SEQ ID NO: 1742 - protein, 216 aa, Oryza sativa Japonica Group
MAKTKQGKRDVDSYTISGTNKVVRVGDCVLMRPVDSDNQPYVARVEKMELDGRGSVRVRVRWYYRPEESKGGRRQFHGAKELFLSDHFDMQSANTIEGKCVVHSFKNYTKLDNVGPEDFFCRFEYKAATGAFTPDRVAVYCKCEMPYNPDDLMVQCDDCKDWFHPSCMSMTIEQAKKLDHFVCSDCVKENGAKRPSHAYAGSTKYEPKAESKRQRR

SEQ ID NO: 1743 - protein, 357 aa, Triticum aestivum
  misc_feature (183)..(183): Xaa can be any naturally occurring amino acid
MDRDAGCYYLGGGGGNDWDLNAVVRFACRGRVLPPPPSEDPFSSFFPPPAPVVEDHGMPDAAALLPDPPVDGGSAAVDELSIAFFAPSAALPSSPQPPPPPQQQQQPAAPTNQEMVPMQQDEAVPPPMLLTAGGQGPVGEGSRSKRKKKVVKKVVKRVAADGTSADPWAWRKYGQKPIKGVAXYPRGYYRCSTDKACEARKMVERCRDDPNSFILTYTGGEHSHPAPAHRNSLAGTTRNRQQAPEPAAGQSAPAAKAKEESSSAAAEPSPAQSTSGGMSPTTPLRTPSMEEYNQDSEFDEAAGGASQPPMDVEKDREDELLKILEGCVHGGDSSIVVEETFVVTPWVTAPGGAAGWS

SEQ ID NO: 1744 - protein, 216 aa, Oryza sativa Japonica Group
VLAVVGRPRGPLGCGEGQPSAADGASPSGCIAAVCAPLRRRRSRKSQTKKVVCIPAGASGGGGGEVVPSDLWAWRKYGQKPIKGSPYPRGYYRCSSSKGCSARKQVERSRADPTMLVVTYTSDHNHPWPTHRNALAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 1745 - protein, 122 aa, Cestrum elegans
VVGWPPVRSYRKNMLQIKKQESDYSCGMYVKVSMDGAAYLRKIDLKVYKNYPELLMALENMFKCTIGVYSEREGYNGSDYVPTYQDKDGDWMLAGDVPWDMFINSCTRLRIMKSTEAKGLAH

SEQ ID NO: 1746 - protein, 63 aa, Physcomitrella patens subsp. patens
DEREVKRQRRKQSNRESARRSRLRKQAECEELGTRVDALTVENIALRTELSRVTEECKRLQAE

SEQ ID NO: 1747 - protein, 153 aa, Cestrum elegans
VVGWPPVRSFRKNVMAQKSNTDQENEKNSITTAAAAFVKVCMDGAPYLRKVDLKMYKSYKQLSDALAKMFSSFTMGNYGAQGMIDFMNESKLMDLLNTSEYVPSYEDKDGDWMLVGDVPWEMFVDSCKRLRIMKGSEAIGLAPRAMEKCKSRI

SEQ ID NO: 1748 - protein, 361 aa, Oryza sativa Japonica Group
MEEISHHFGVVGASGVHGGHQHQHHHHPWGSSLSAIVAPPPPPQLQQQQTQAGGMAHTPLTLNTAAAAVGNPVLQLANGSLLDACGKAKEASASASYAADVEAIKAKIISHPHYSSLLAAYLDCQKVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 1749 - protein, 1801 aa, Oryza sativa
MEGVPAAGANASRSPQHRGRRHSLSPTPRRGRGRGAAVREVVVQRTVREVGGAAAFPTLTRTNYTEWSLLMKVMLQARGLWDAVEHGECDEQEDRMAMEAILRAVPSEMISLLATKDSAKDAWDAIKVMRVGVDRVRKAKAQQLHREYESISFHDGESIDDFALRLTSLVSQLGTLGERIEEQNVIEKFLRVVPERFSQIAVSIETLLDLSTLTIEDVTGRLKEQWLARQKERQKGERSSKQSQGGARQRPRSHRKKRGFGGGVGGEKGNTNRDTAPNRCHNCGRLGHWAKDCRQPKKEAAHLAQGDDDDDVLLLSRACELEDDDATLLMAHACELNDGPIIAPSPVSLVEPRVQVSLGATDAEDKEAWYLDTGATNHMTGRGDVFAELDRSVTGTVKFGDSSIVDIKGAGNVIFTGKNGEHKVLSGVYYIPRLKSSIISIGQLDESGTRVLVEDGIMRIWDRRRRLLAKIKRGRSRLYVLRLEVARPICLATRHDDVAWRWHERFGHIHFGSLEKMGRQELVRGLPRLEHVEQLCDTCVITKHRRAAFPKAAKYRAQEPLDLVHGDICGPITPATPGGRRYFLLLVDDATRYMWVALLAAKSNAPDAIKRIQMAAKTHCGRKLCVFRTDNGGEFTSLEFATYCTDEGIQRHFFAPYAPQQNGVVERRNQTVVSMARALLKQKGMPAEFWGEAVSTAVFLLNHAPTKSLTGKTPYEAWHGKKPMVSFLRTFGCLAYVKELNDVRKLDDRSTPGVFIGYEEGVKAYRVLDPRTRRVRLARDVIFDESRGWDWTAASSTDARPSSDFAIEYHVEKTTGHPIPSVGGGVVTPSASPTPLQETSPATPATPAPSPSVAPTEFVSPPSHDEERIDAAHSNTPVRYRTVDNLIGENAPAPGIAQRELEEASLLLAGPGEPCSFAEAEGDDAWRAAMREEMDAVNRNGIWELVDLPHGHRPIGLKWVYKLKKNEAGKVVKHKARLVARGFVQQPGIDFDEVFAPVARMESIRLLLAVAAQKGWHVHHMDVKSAFLNGDLAEEVYVKQPPGFVVAGEEDKVLRLRKALYGLRQAPRAWNAKLDCTLKELGFDQSKHEHAMYRRNNGGSALLVGVYVDDLVITGPSTRAIEQFKEEMKAKFQMSDLGLLSFYLGIEVKQGDDGISLNQGRYAQRIVESAGLKDCNPCATPMEERLKLSRDSTAPPVDATKYRRLVGSLRYLVHTRPDLAFAVGFVSRFMERPTEEHMVAVKRILRYVAGTMEYGLHYKREKEEQRLIGYSDSDLAGDIDTRRSTSGMLFFLGSSLVSWQSIKQRVVALSSCEAEYVAATNAATQGIWLARLLGELLGKQPKAIELKVDSKSALALAKNPVFHERSKHIDLRYHFIRSCLEEGSISASFITTMDQLADILTKALGRVRFHELVARIGVILNRQVVKSDSATIKIPELDFEIPPEAQRGSLSTVEGIIMRAVDELQALQDERKKVDPQKAEAIDKFLAKLRSLGLGEAAFTFVLDDPAGNSFIENQNAPSSDPLLSVRFYERMREQQAALGFLVEPSTEEPGDQPVNHASTVEGNSEVLQEPHGSVGAVAGRRAIAQGNPDEVAAALCRYSAPEECLVFDLWLEIPYFREVIVMATTCDMCGYRNSELKPGGEIPAKGKKITLRVQNGKDLTRDVIKSDSAGVKVPELELELASGTLGGIVTTVEGLIVKICEALQRVHGFHLGDSTLEWKKKKWEDFNDRLSKLLSLQEPWTLIIDDGLAASFVAPATDSLEDDNQLTIEEYVRSWEQNEELGLNDMDTSSADAAYNTTNP

SEQ ID NO: 1750 - protein, 303 aa, Oryza sativa Japonica Group
MLIHGEGSSSSAAAAGGKIKGSWSPEEDEQLRGAVARHGPRNWTAISEEVPGRSGKSCRLRWCNQLSPGVHRRPFTPDEDALIVAAHAKYGNKWATIARLLDGRTDNSVKNHWNSSLRRNRRAAAAAAAAAASVSYQSMDLTEEADNDDEGTSDDSVAIPAQSSPAAVVAGVPVLPPPPPPAKRLCVAPPTGVEHRAPPPDPPTSLSLSPPGAAAAAISASTVVGGSSAARAEEEAVAREKARMEQDPWLMAMMRQMITEEVQRQVSVVYSLVASSAAMAAQTGNAGGVGRKGPDGRPSNGQD

SEQ ID NO: 1751 - protein, 116 aa, Cryptococcus neoformans var. neoformans JEC21
MPKVSTKDSKKSTASDAKKRTKKDPNKPKRALSAYMFFVQDYRERIKTENPEATFGDVGKLLGIKWREMNENEKKPYEAKAKADKERADRENADYKAEGKASKKAAKADEESDDDE

SEQ ID NO: 1752 - protein, 228 aa, Triticum aestivum
MARERREIKRIESAAARQVTFSKRRRGLFKKAEELSVLCDADVALIVFSSTGKLSQFASSSMNEIIDKYSTHSKNLGKTDQPALDLNLEHSKYANLNDQLAEASLRLRQMRGEELEGLSVDELQLLEKNLETGLHRVLQTKDQQFLEQINELHRKSSQLAEENMKLRNQVGQIPTAGKLVVADTENVVAEDGQSSESVMTALHSGSSQDNDDGSDVSLKLGLPCLPWK

SEQ ID NO: 1753 - protein, 608 aa, Physcomitrella patens subsp. patens
MGCNNSKIDNEEGVARCKQRKRVMRDVVASRHNFAASHVMFIKSLGDVGVAFRVFAEGETTKEHIMYSEVSTPRTPTLSLGPPPATLHPPPPFSPGFSPSPPPHSPPSPHVKLSALQNNPPPPPPVTRSSWQDLFMDPFRPSPPSQEIEEQKLSTRTVTETSSGTITETSTRTEPPPKAGKAAKTPGKPPKPEFSIAKTNKDLAVSKAEKGGRDLLEVLKEVDECFVKAAESGEIVSTLLDTKKAHYHSNFSDRSSSFRTTSNLSSLSNTSVLNDESPSIMSIRRSISNLSSARFAEECGPPTHASTLDKLFAWEKKLYLEVKEAEALRVELERKFYLYRSQDAKNEDPAIIDKTRSSIKTLQTRMAVAVHAVESAAQQVQRLRDVELYPQLVDLLDGLGTMWKNMSQAHQAQLRAVETMRRLDNSAACEPTTSFHRQATLNLEQALNKSSSSEGMIGSSIYDLCQRWEEALALLPHQVVLEGIGSFSSVVREMLRLQWEELRIKKRVENYQKDLERRELALHTVASKDPGFSERSEVAEKRLKFEAARRKYEAELEAERKAYTDTRAFTLSSLQSGLPQLFQAVTTFANSEADIYDQLSTAHSLLNK

SEQ ID NO: 1754 - protein, 234 aa, Solanum tuberosum
MAREKIKIKKIDNITARQVTFSKRRRGLFKKAEELSVLCDADVALIIFSSTGKLFDFASTSMKDILGKYKLQSASLEKVDEPSLDLQLENSLNMRLSKQVADKTRELRQMRGEELEGLSLEELQQIEKRLEAGFNRVLEIKGTRIMDEITNLQRKGAELMEENKQLKHKMEIMKGKLPLLTDMVMEEGQSSESIITTNNPDQDDSSNASLKLGGTTAVEDDCSITSLKLGLPFS

SEQ ID NO: 1755 - protein, 504 aa, Oryza sativa Japonica Group
MASNATRNTDPDQQGVRFSSMDQPPCFARPGQSFPAFPPLFGVQSSSLYLPDDIEAKIGNQFESNPSPNNPTMDWDPQAMLSNLSFLEQKIKQVKDIVQSMSNRESQVAGGSSEAQAKQQLVTADLTCIIIQLISTAGSLLPSMKNPISSNPALRHLSNTLCAPMILGTNCNLRPSANDEATIPDISKTHDYEELMNSLNTTQAESDEMMNCQNPCGGEGSEPIPMEDHDVKESDDGGERENLPPGSYVVLQLEKEEILAPHTHFCLICGKGFKRDANLRMHMRGHGDEYKTAAALAKPSKDSSLESAPVTRYSCPYVGCKRNKEHKKFQPLKTILCVKNHYKRSHCDKSYTCSRCNTKKFSVIADLKTHEKHCGRDKWLCSCGTTFSRKDKLFGHVALFQGHTPALPMDDIKVTGASEQPQGSEAMNTMVGSAGYNFPGSSSDDIPNLDMKMADDPRYFSPLSFDPCFGGLDDFTRPGFDISENPFSFLPSGSCSFGQQNGDS

SEQ ID NO: 1756 - protein, 275 aa, Arabidopsis thaliana
MSGEGNLGKDHEEENEAPLPGFRFHPTDEELLGYYLRRKVENKTIKLELIKQIDIYKYDPWDLPRVSSVGEKEWYFFCMRGRKYRNSVRPNRVTGSGFWKATGIDKPVYSNLDCVGLKKSLVYYLGSAGKGTKTDWMMHEFRLPSTTKTDSPAQQAEVWTLCRIFKRVTSQRNPTILPPNRKPVITLTDTCSKTSSLDSDHTSHRTVDSMSHEPPLPQPQNPYWNQHIVGFNQPTYTGNDNNLLMSFWNGNGGDFIGDSASWDELRSVIDGNTKP

SEQ ID NO: 1757 - protein, 399 aa, Vitis vinifera
  misc_feature (45)..(78): Xaa can be any naturally occurring amino acid
MRQRSRKQKTNKDKGDKAQGVYLPFSFPLFSALFSPFSVQIVSEXXXXXXXXXXXXXXXXXXXXXXXXXXXXXXXXXXLKRKVEGQKFELEVIPVIDLYKFDPWELPDKSFLPKRDMEWFFFCPRDRKYPNGSRTNRATRAGYWKATGKDRKVVACQSTVIGYRKTLVFYRGRAPLGDRTDWVMHEYRLCDDPSQGSGFQGAFALCRVVKKNDPTQKSSDFHGEAKGKQVGSSSSNGDFTSAAISNEILSISDNIPSQASHAYNESNYSSPMASPYEAARPVDFELSSKGTNPTDFWVSPDLILDSSKDYQQGQETVSEFVPQYDFANSMSSWNPYSEISPCSSYSNFPGEVEFADDFSRIGCMSPYSGDPNYMGFYGNEDVPYEGYDQNNSLRNPKQF

SEQ ID NO: 1758 - protein, 435 aa, Zea mays
MSISVNGQSVVPPGFRFHPTEEELLTYYLKKKVASERIDLDVIRDVDLNKLEPWDIQEKCRIGSGPQNDWYFFSHKDKKYPTGTRTNRATAAGFWKATGRDKAIYASPGARRIGMRKTLVFYKGRAPHGQKSDWIMHEYRLEAPVDAGAGAAHHLLLPAAEHPPYYTSPPQAPSSTTTATIRGAAGDQAAQEQEGWVICRVFKKKNLVHHGQSSGVKQQAAGDDHAASHTAAAAAHMDESSPSQCSSVTVISDHVHANVNDKQQQAQASLLMMHTHHSASSDDDALDHILQQYMGGGRQAPAPDTKPALLEQLDHLHHHLAAAPTTRAAAGFYYGKFMKLPPLEHAGLPPSPPPPGAREYGAAAAAGWDDDDDALDRLAAYDHLNGLSNDASKNMAAFFDVEPSAAAAAAVDGDLWSLARSVSALHADLTMNNNV

SEQ ID NO: 1759 - protein, 317 aa, Physcomitrella patens subsp. patens
MARGCSHCGHNGHNSRTCPDRGVRLFGVRLTDGVMRKSVSMGNLSHYASPNNPSSPPSHSESGAGGDGYVSDGLVQTSNNTRERKKGVPWTEEEHRLFLLGLQKLGKGDWRGISRNFVQTRTPTQVASHAQKYFIRQSNINKRKRRSSLFDIVSETGPTPILEEPTTKAVPDMSAPLHQLSLGPNSTYPGIPETSAVNFNGDAARAMRPMGIPVSGPSGAMGIPYPFPMFSMLPRGYNRPVNSADSKVLRPTAKLSTEPLNVGVDETKDMSQLNLGLSTPEPSQLTLKLLDQPSRSSSAFHVSTSSINSSSNAIGVV

SEQ ID NO: 1760 - protein, 221 aa, Solanum tuberosum
MVRQKIQIKKIDNLTARQVTFSKRRRGLFKKAQELSTLCDADIGLIVFSATGKLFEYSSSSMMQLIEKHKMQSERDSMDNPEQLHSSNLLSEKKTHAMLSRDFVEKNRELRQLHGEELQGLGLDDLMKLEKLVEGGISRVLRIKGDKFMKEISSLKKKEAQLQEENSQLKQQSQARLNEEGQNVIEQGHSADSITNNRSLVNSHQDYNDSDTSLKLCLAFP

SEQ ID NO: 1761 - protein, 665 aa, Beta vulgaris
MTYINSFIWDCLFSQDSPVFNYISNLSPIQPVKAGPVSQGFPELASPPLVFTSPRITSLHSFGNSVYLFASEKFSQDHDNCQRNERDLGHSMKVVPEFRSPLVPSDQKTCNTEKLVSVAHCSPSGCFDDYLGDPGQSANFTHKMQSDNAPPSAKGGCLKKIGVVDGRDMGPFCSASQKGRDSAQPRSRISVKLVKNESRHMTSLSECSGALPRLLTDHISQSGDSFSEGFCLEHSKRRDSDKGEGIEEMLCLFRGMRIRGGIGIKASQLERGTLRRCLFDESQRKNSADQFGFSNPIVNAQIQESANMSYGKSGNRHMINLSKPAIDASVSPGNYPVVISKSLGIGLHLNSVVYSGSTDSAIGSQQSSMVSVEGNSSPQITNNQSDGKINASNIVGISSASREEIDQHQAHLVPAYDTTIAPDLDEQFNTAIDAKLDPCSTITNDKRKSSPDLDENDSSLGSPKKTRQASNCLTKKASTSTDDDTTKRCNCKKTKCLKLYCDCFAAGFYCGESCACQGCFNRPEYEDTVLETRQQIESRNPLAFAPKVMQTVTASPTTGKVVEKLSTPSSARHKRGCNCKKSMCLKKYCECYQANVGCSEGCRCEGCKNIYGVREGAYTYISKSETCTFSTNYMHIQFKSWKTTLDNLSFRNWSTVGCSRPGGVY

SEQ ID NO: 1762 - protein, 368 aa, Glycine max
MDTFSHVPPGFRFHPTDEELVGYYLRKKVASKRIDLDVIKDVDLYKIEPWDLQELCKIGTDEQSDWYFFSHKDKKYPTGTRTNRATKAGFWKATGRDKAIYSKHCLIGMRKTLVFYKGRAPNGQKSDWIMHEYRLETNENGTSQEEGWVVCRVFKKRMTTTQKVGEYDQSPCWYDEQVSFMQDLESPRRNISQTYASYHHHQQQHHHHPCKPELMELQYNNIPHDAFLQLPQLESPKVTQSSCSVVPYGYESNNNNNNNNNGSTLQFSSLTQEEQLQYCNNQQSHHSLYGSNDHAVDQVTDWRVLDKFVASQLSHNNQDVSKETSYSNAPIFHVAEQISVAANGSKKEQVSQEYASTSTSSYQIDLWK

SEQ ID NO: 1763 - protein, 105 aa, Physcomitrella patens subsp. patens
MRIQCDVCQKNLASVMCCADEAALCAQCDARMHTANKFANKHVRVAFNAAPEPPKCDICQENRGFFFCLEDRALLCRDCDVSIHTANTLSCNHQRFLVPGTKVAL

SEQ ID NO: 1764 - protein, 226 aa, Triticum aestivum
MELEAATRRFQLWLRGLRSLRRDLRTARWADDPAQLAKLVAGYVSHFADYCAARAELDPVWTLAAPWASPVERGAAHWLAGWRPTTLVHLLYTESGRRFEAQLPDLLLGVRSGNLGDLSPAQLAQIDELQRRTVAQEDELSREMARVQEGHGAVGAGGELVDVGGLVGRVGAVLAGADALRLRTMKRAVEILEPAQAAELLVAAADMEIGFREFGLKYDGVGAGGS

SEQ ID NO: 1765 - protein, 355 aa, Triticum aestivum
MCGGAILSDIIPPPRRATGGNVWRADKKRRARPDAAAGRPRRVPEEEFQEEEGDAEFEADFEGFVEAEEESDGEAKPFPVRRTGFSGDGLKATAAGDDDCASGSAKRKRKSQFRGIRRRPWGKWAAEIRDPRKGVRVWLGTYNSAEEAARAYDVEARRIRGKKAKVNFPEEAPMDPQQRCATSVKVPEFNTEQKPVLNTMGNTDVYSCPAVDYTLNQQFVQPQNMSFVPTVNAVEAPFMNFSSDQGSNSFSCSDFSWENDIKTPDITSVLASIPTSTEVNESAFLQNNGINSTVPPVMGDANVDLADLEPYMKFLMDDGSDESIDSILSCDVPQDVVGNMGLWTFDDMPLSAGFY

SEQ ID NO: 1766 - protein, 329 aa, Arabidopsis thaliana
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKKQVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 1767 - protein, 211 aa, Capsicum annuum
MALKSKVSSNGSENAKVNGVKEVHYRGVRKRPWGRYAAEIRDPGKKSRVWLGTFDTAEEAAKAYDAAARDFRGPKAKTNFPSPFPLETLNQSPSNSSTLESSSGETGVHAPMEVDLTRRLGAVAPVFHQQPTVAVLPNGQPVLLFDSLWRPGVVVDKAQLSYQVAPMAIEFTGAAGGVSSVSDSSSVVEENQYVGKKGLDLDLNLAPPMEI

SEQ ID NO: 1768 - protein, 159 aa, Glycine max
MIVKALEALNEPNGSNKSAISKYIETTYGELPDATVLGSHLNKMKDSGELSFKQNNYMKADPNAPPKRGRGRPPKPKAPLPPGTVVSPPRPRGRPPKDPNAPPKSPKAKATPGSGRPRGRPKKVPRSPAVAAPTAVSSGRPRGRPPKVKPQLTEVSVES

SEQ ID NO: 1769 - protein, 303 aa, Arabidopsis thaliana
  misc_feature (286)..(286): Xaa can be any naturally occurring amino acid
MPTLYKKAGCQFQLTTMDYEASRIVEMVEDEEHIDLPPGFRFHPTDEELITHYLKPKVFNTFFSATAIGEADLNKIEPWDLPWKAKMGEKEWYFFCVRDRKYPTGLRTNQATEAGYWKATGKDKEIFKGKSLVGMKKTLVFYKGRAPKGVKTNWVMHEYRLEGKYSIENLPQTAKNEWVICRVFQRRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFRXDGRDSSGTEELDCVWNF

SEQ ID NO: 1770 - protein, 421 aa, Arabidopsis thaliana
MENFQGDLTDVVRGIGGHVLSPETPPSNIWPLPLSHPTPSPSDLNINPFGDPFVSMDDPLLQELNSITNSGYFSTVGDNNNNIHNNNGFLVPKVFEEDHIKSQCSIFPRIRISHSNIIHDSSPCNSPAMSAHVVAAAAAASPRGIINVDTNSPRNCLLVDGTTFSSQIQISSPRNLGLKRRKSQAKKVVCIPAPAAMNSRSSGEVVPSDLWAWRKYGQKPIKGSPFPRGYYRCSSSKGCSARKQVERSRTDPNMLVITYTSEHNHPWPIQRNALAGSTRSSTSSSSNPNPSKPSTANVNSSSIGSQNTIYLPSSTTPPPTLSSSAIKDERGDDMELENVDDDDDNQIAPYRPELHDHQHQPDDFFADLEELEGDSLSMLLSHGCGGDGKDKTTASDGISNFFGWSGDNNYNNYDDQDSRSL

SEQ ID NO: 1771 - protein, 275 aa, Oryza sativa Japonica Group
MKRKRPAALRGGEEAAAAALKRGPWTPEEDEVLARFVAREGCDRWRTLPRRAGLLRCGKSCRLRWMNYLRPDIKRCPIADDEEDLILRLHRLLGNRWSLIAGRLPGRTDNEIKNYWNSHLSKKLIAQGIDPRTHKPLTAAADHSNAAAAVAATSYKKAVPAKPPRTASSPAAGIECSDDRARPADGGGDFAAMVSAADAEGFEGGFGDQFCAEDAVHGGFDMGSASAMVGDDDFSSFLDSLINDEQLGDLFVVEGNDHEHGNGEIGHGDVMESKQ

SEQ ID NO: 1772 - protein, 276 aa, Capsicum annuum
MDTSSLDLIRQHLLDDDVVFMENYCTSSETTSTLYSQSSSSSESLESFVSELKTESNFSFYPESSNLEFCSFFNNNSKMEFNPSEFQVKPQKKKSFNERKPLLNISIPSVKKTDESKTGENSEKKRYRGVRQRPWGKFAAEIRDPNRKGTRVWLGTFDTAVDAAMAYDRAAFKLRGSKAILNFPLEVSNFRQENNEIEKKVNLNSCGKRAREEIENEDQVVMKKEVKREQMVATPLTPSSWAPIWDCGNAKGIFEVPPLSPLSPHPSFGFSQLLVS

SEQ ID NO: 1773 - protein, 348 aa, Brassica rapa subsp. pekinensis
MTRRCSHCNHYGHNSRTCPSRGVMLFGVRLTGGSIRKSASMGNLLSHGHGSGSPGDVPDHVAGDGYTSEGFVAGSSSSRERKKGAIWTEEEHRMYLLGLEKLGKGDWRGISRKYVRTRTPTQVASHAQKHFMRLSDVSRRKRRSSLFDMIPHEVGVTPMDQQEPEAENTPVETLMRSSDSVHQTVASSSRKAPSILEIDECESMDSTNSTTGEPTSIAAAASSSSSILEETTQPQLQSFPILYPAYFSPYYPFPYPIWPAGYVPEPTKKEETHEILRPTAVHSKAPINVDELLGMSKLSLGESKKKNGESDQSLSLKLGGGSETRQSPFHPNLSPPDSSDIANVIHAA

SEQ ID NO: 1774 - protein, 115 aa, Brassica napus
MGRGRVQLKRIENKINRQVTFSKRRAGLFKKAHEISVLCDAEVALVVFSHKGKLFEYSTDSCMEKILERYERYSYAERQLIAPESDANTNWSMEYNRLKAKIELLERNQRHYLGE

SEQ ID NO: 1775 - protein, 355 aa, Arabidopsis thaliana
MAFPGSHSQYYLQRGAFTNLAPSQVASGLHAPPPHTGLRPMSNPNIHHPQANNPGPPFSDFGHTIHMGVVSSASDADVQPPPPPPPPEEPMVKRKRGRPRKYGEPMVSNKSRDSSPMSDPNEPKRARGRPPGTGRKQRLANLGEWMNTSAGLAFAPHVISIGAGEDIAAKVLSFSQQRPRALCIMSGTGTISSVTLCKPGSTDRHLTYEGPFEIISFGGSYLVNEEGGSRSRTGGLSVSLSRPDGSIIAGGVDMLIAANLVQVVACSFVYGARAKTHNNNNKTIRQEKEPNEEDNNSEMETTPGSAAEPAASAGQQTPQNFSSQGIRGWPGSGSGSGRSLDICRNPLTDFDLTRG

SEQ ID NO: 1776 - protein, 333 aa, Zea mays
  misc_feature (142)..(142): Xaa can be any naturally occurring amino acid
MFGQSFAEDLDCGNFFDNMDDLLDFPGGDIDVGFGIGDSDSFPNIWTTHQDTWPAASDPLFASNTNSDSSPELYVPFEDIVKVERPKCFVEESLVEKKEDSFFTNTDSSSSHSQFRSSSPVSVLESSSSSSHTTNTTSLVLXKKHGRPRTKRPRPQVQEKDKVNDNVFGADSRLIIRIPKQFLSDHSKMITKKKKKKAKVVSSSSWSEIDLETNGNNNVDSCSSEQNPVRKCMHCEVTKTPQWRLGPMGPKTLCNACDVRYKSGRLFPEYRPAASPTFTPALHSNSHKKVAEMRNKRCSNGSYTNEENDLHDLVLNNAYIGIGVGKSQRVEKF

SEQ ID NO: 1777 - protein, 441 aa, Oryza sativa Indica Group
MAAAGNSFLNQELVKVADGVSDWHLPSSSHGGTCHTNTRGAPITVGVPDLGCPVSSIGMATSSSLMPKEGLTTASYNSVVAFPVGATMVPQQQQTQAAGSNDNPGLVKGGWTGEEDEVLRQMVRHHGDRKWAEIAKSLPGRVGKQCRERWTNHLHPDIKKDIWTEEEDRMLIEAHQTYGNSWSAIAKRLPGRSENTVKNHWNATKRSLNSKRRLRKKNSEQTVPGQPSLLENYIRSCQHMLPSETVPPPPAPPAPFDISRYGNSGVIGASPTLPIVQEPGTSTPPGLVMFLDLLNQAIPHPPQPETMDLFNMTPEVSHLNTSGYCLQLDAGGNLYYGRLPAPAPVQPHGISTQELQDTPHLSLYYPLSSFAGSHTDGTVEFDHQLSNPNGGHYGEEAGPSSVAAGGSANGMDDNDVVQMASNQFMMPCEDEGILDLARWIN

SEQ ID NO: 1778 - protein, 402 aa, Avena fatua
QQQPWGYQQQPGAMDAGANAASFSAPAVQATSSEMAPSGGVYRQTHSQRRSSDDGYNWRKYGQKQVKGSENPRSYYKCTFPNCPTKKKVETSIEGQITEIVYKGTHNHAKPLSTRRGSGGGGGGAAQVLQSGGGGDASEHSFGAMSGAPVSTPENSSASFGDDEIGASSPRAGNVGGDDLDDDEPDSKKWRKDGDGEGSNSMAGNRTVREPRVVVQTMSDIDILDDGYRWRKYGQKVVKGNPNPRSYYKCTTVGCPVRKHVERASHDLRAVITTYEGKHNHDVPAARGSAALYRPAPRAAADSAMSTSQQYTANQQQPSAMTYQTSAAAGTQQYAPRPDGFGSQNQGSFGFNGSFGFSAGFDNPTGSYMSQHQQQQRQNDAMQASGAKEEPREDMFFQHSQF

SEQ ID NO: 1779 - protein, 210 aa, Eucalyptus occidentalis
MVRGKIQLRRIENTTSRQVTFSKRRNGLLKKAYELSVLCDAEVAVIIFSQKGRPYEFSSNSEIQKTIDRYRRSTYDMDTYKTNLDQCILHLKQETTDMERKIELLEVSLRKLSGECLGSCSIDEIQMIGDQLERSLSSIRARKAQLFDDQIQHLQAKERSLKEENAKLLAKCLANPGQSTAHPRAAALHSRSSRSTDVETRLFIGLPELN

SEQ ID NO: 1780 - protein, 349 aa, Avena fatua
MDPWIGSQPSLSLDLHVGLPPMGHHHHRYQAAAPMVAMAKPKILVEESFMPPKKDPEVAVLESELQRVSEENRRLGEMLREVAAKYEALQGQFTDLVTAQQANAGGSNNNNHPSSASEGGSVSPSRKRKSEDSLGTPPSHAHQHHHAFPAPADQAECTSGEPCKRIREECKPVVSKRYVHADPSDLSLVVKDGYQWRKYGQKVTKDNPCPRAYFRCSFAPGCPVKKKVQRSAEDKTILVATYEGEHNHSAPPPAHPQQQDAKNAAAKPPQAPVPVPAPHHPPPQQQQPKQETVVVVSEETAAAAASEMMRRNLAEQMAMTLTRDPSFKAALVTALSGRILELSPSRDVN

SEQ ID NO: 1781 - protein, 227 aa, Eucalyptus occidentalis
MAREKIQIKKITNATARQVTFSKRRRGLFKKAEELSVLCDADVALIVFSSSGKLFEYCSSSMKEILERHHSHSENLGKLDQPSLKLQLVENGDYSRLSKEVAEKGHQLRQMRGEELQGLNIDELQQLEKSLEAGLNRVIEKKGEKIMKEITDLQQKGAKLMEENKRLKQQVTEISGRKTTATDSETIINEEGLSSESITNVCSSSSGPPQEDDSSDISLKLGLPYNG

SEQ ID NO: 1782 - protein, 192 aa, Vitis vinifera
  misc_feature (2)..(2): Xaa can be any naturally occurring amino acid
  misc_feature (129)..(129): Xaa can be any naturally occurring amino acid
MXTSENIATSIRKIRKRKFSEEQIRSLEFLFESEARPEAQLKQKVASELGLHPRQVAIWFQNKRARSKSKQIEQDYAVLKASYDNLALQFESLEKENQNLAIQLQRLRDGLEKPRGKEDEESEIGYTNXETKERYNPVLQGRIEYFAEDTHTPKMEEQTNSSLTSSADLGIFKSSCFQDQSNCSSQWWELWS

SEQ ID NO: 1783 - protein, 394 aa, Oryza sativa Japonica Group
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 1784 - protein, 389 aa, Brassica napus
MMFNEMGMCGNMDFFSPASLGEVDFCPAPTHPEPDSVVDDDYTDDEIDVDELERRMWRDKMRLKRLKEQDKSGSKEGVDAAKQRLSQEQARRKKMSRAQDGFLKYMLKMMEVCKAQGFVYGIIPENGKPVTGASDNLREWWKDKVRFDRNGPAAISKYQAENSVQGVCEGGSSLIGPTPHSLQELQDTTLGSLLSALMQHCDPPQRRFPLEKGVPPPWWPNGEEEWWCQLGLPKGQGPAPYKKPHDLKKAWKVGVLTAVIKHMFPDVAKIRKLVRQSKCLQDKMTAKESATWLSIVNQEESLARELYPESCPPSLSGGSCSLLMNDCSQYDVEGVEKESLYKVEELKPVKEEVPTEFIRKRKPSRDLNTIMVDRAAFTCENPGCVHSDI

SEQ ID NO: 1785 - protein, 262 aa, Nicotiana tabacum
  misc_feature (218)..(218): Xaa can be any naturally occurring amino acid
MDTSHWPQGIGLVKAVEPSKPVPTERKPRPQKEQAINCPRCNSTNTKFCYYNNYSLSQPRYFCKTCRRYWTEGGSLRNVPVGGGSRKNKRSSSSSNNSSSSTSSSYKKIPDLTIPTSSQNPKIINEPHDLNLAFNPSATSNFSNISEFMALPLMNPNSTTSFMSSIMPQLSDSNNIMYSSSSTGLPNLHDLKPTLNFSLDGFDNNNGYGSLQGETAGXKLFFPLDDLKNVSTPNDDHEFDEQNRGQAAESHGFWNGMLGGGS

SEQ ID NO: 1786 - protein, 305 aa, Glycine max
MIAVARKDMDRIKGPWSPEEDEALHKLVERHGPRNWSLISRSIPGRSGKSCMLRWCNQLSPQVEHRAFTPEEDETIIRAHARFGNKWATIARLLSGRTDNAIKNHWNSTLKRKCASFMMAGDEAVAVSPRPLKRSFSAGAAVPPPGSPSGSDFSESTAPGVVSVSVSVSPSQVFRPVPVRPVVEYGVVARRRRCRRRGCWTYYLAVAVSSRGGVIGNLYRTSTVPVMPVHTVAAAAPVPLPAPEVGLGALNLNAEFMAVMHEMIRKEVRSYMEQQNGMMCFQGMEMMEGFRNVSVKRIGISRVDS

SEQ ID NO: 1787 - protein, 234 aa, Thermococcus kodakarensis KOD1
MGENGEKRQKVEVREDLGEVQVISLGDCPICGGKGTLKAIQHIHEIPYFGKVMESTIICEKCGYRNADVMILEDRPPKLYTVKVEGEKDLFTRVVRSKSGTIELDEIGVKIEPGPASEGFITNVEGVLERVRETLLMAREFRRQEGDEEAVKKADEILQYIEDVKEGKKPITVRIMDPLGNSALIGEKVKSRLLTEEEINKLSLGPYVLVPEVEEEDALEEEKKDTGEGNSDGS

SEQ ID NO: 1788 - protein, 359 aa, Glycine max
MTRRCSHCSNNGHNSRTCPSRGGGGVKLFGVRLTDGSIIIIYASMGNLNLSSAAAHHQFHSSPSSSNLAAAPSSPNPSSPCSDPPQGYLSDDPAHVSTFANRRGDRKKGVPWTEEEHRLFLIGLQKLGKGDWRGIARNFVVSRTPTQVASHAQKYFIRQSHATRRKRRSSLFDMVPDMSSDQPSVPEEQVLLPPSQNSQPCNGKSQPSLNLSLKSEFEPMETTSQENAQQTNETMMGSIGLTPMAPHGFFPAYLPVPFPMWPSTVAPPFEEVKGGETSHHQIHKPIPVIPKEPVNVDELVGMSHLSIGEAKVRDREPSPLSLKLLGEPSRQSAFHANAPVGTSDFKQWQGQRNSSCLSL

SEQ ID NO: 1789 - protein, 275 aa, Zea mays
MALLEGACQQLLTSGSQEYQTSSPDVPVASTSGGADDDAEKDESWMQFISDDAWCSSTADGAEESTSRFHPTDEELVNYYLKRKVHGLSIELDIIPEVDLYKCEPWELAEKSFLPGRDSEWYFFGPRDRKYPNGCRTNRATQAGYWKSTGKDRRISYQNRSIGMKKTLVYYKGRAPQGLRTSWVMHEYRGRDRACENTMGIQDSYALCRVFKKNVALGELQKQKQGECSSSQSKENQEQFTSIRDAGQSSGSNEHGKDNTWMQFIADDLWCNQTK

SEQ ID NO: 1790 - protein, 396 aa, Physcomitrella patens subsp. patens
MTPEQLLVICATAIKQNDSSVVEKAVSALKKVSSIQGEPSERATAYFLKALLLRRSSMPDVSNFTSSSETTNSDERRYSLTELTRLVDLTPYFRFGYTASNGALLEAFEGVEQIHILDFSTTHGMQWPTFIEALSDREHGPPSSFRLTLLSSSVPFPPRLQTTYEEVGQRLSKYARLRNIPFDFDVLSQPLANLSSSDLRLREEEVLGVNLSLRIHHLSEESTDESSPRESQQYGAPQSLCPGDKFLYLIRCLNPTVVTLYEEDCDTSSSCFVKRVEQSYAYEWMPFDFLATIWPSENSERQEHEKNVGKKIENIVACEGLNRLNRLESKKQWLRRMNKLRFRIQPVREDVKSQLQDVVDHHNTGWGMKNDEETNTQSLLWKGNPLTFSSSWVPAP

SEQ ID NO: 1791 - protein, 198 aa, Oryza sativa
VCGMSLTHSLNNFFFFFFFFFFFFFFFFFFFFFFILSWTTKNIMGFPVGGYSGVPRLLLHLLFLLTHLRRLSSCLLRLAGADIDDSPTAVDAEYDGSYSYSSQSSQLLELDDHSPALRFDALSSSLQPPLHVATCAVCLRDFHKSAQVRRAHRCRHVFHRACLDAWAHHGHRTCPLCRSPLLPSSAPPVLLPLPLPAS

SEQ ID NO: 1792 - protein, 503 aa, Vitis vinifera
MNHHSVLSAKQTESTKGFTQSYCAAVSPIHNLLNVELEGQNSFKSDCSSSHSRFTQTELPGPANFMQASVVQPQKLCSKSGPYSSVSSDTDAQYPKCTFSRSSVFCTSLYLSSSSSTETHRPLGNLPFLPHPSMSYQSISAVHSTKTPFLSGDSSGLYDEGNSEDMMKGFLNLSSDASDESFHVMNCASDNITFSEQLELQFLSDELDIAIADNGENPRLDEIYEMPQDSSTPAMALGLTVNQNHQSVAPSADASSGQPSPGAAAAHKPRMRWTPELHERFLEAVNKLEGAESLPILLWNVEATPKGVLKLMNIEGLTIYHVKSHLQKYRLAKYMPERKEDKKASGSEEKKAASSNNESDGRRKGNIQITEALRLQMEVQKQLHEQLEVQRTLQLRIEEHARYLHKILEEQQKAGSALISPPSLSSPTNPHPDSERQPSSPSATTTLPQPAECKADSSSPPPSKHKAATETTDSEQQACSKRSRLESNPESVSDEAVVENPSQ

SEQ ID NO: 1793 - protein, 272 aa, Capsicum annuum
MGSPQENCSFDMIRQHLDDISLMEYYCPENTLYSQSCESLDQTSVSFETSSNLDDISSFFSSSKTDFGCFEFETKPITSAATSISSNSPKKRSFNERKPSLNIAVPVKPVVVQKVEVVREKKHYRGVRQRPWGKFAAEIRDPNRKGTRVWLGTFDTAVDAAKAYDRAAFKLRGSKAILNFPLEVANFKQQNSTVEVPQQVNSSGSKRAREKEELAINKEMKIEEEERVAQTAPLTPSNWSTIWDSGNGKGIFEVPPLSPLSPHMSYSQLVMI

SEQ ID NO: 1794 - protein, 572 aa, Coffea arabica
MDKGWGVTVDNSDKIGFFGNKPVFGFNLSPRLNPSKGSLSMFPAAEFLANQNRREDSHAAASSDGEKRVVVGEVDFFSDKKKANDILIKKEDCHGEDKMKTNMDVVNTGLQLVIANTGSDQSTVDDGVSSDIEDKRAKLELAQLQVELEGMNAENRRLREMLSQVSNNYTALQMHLMTLTHQQQQNAKPQTTQDHEIGERKSEENKPENGGVVVPRQFLDLGPSGTAEMDEPTNSSSEERTLSGSPHNNMELSRNKGVGREESPESQGWAPNKVAKLNASSKTVDHAQAEATMRKARVSVRARSEAPMITDGCQWRKYGQKMAKGNPCPRAYYRCTMAVGCPVRKQVQRCAEDRTVLITTYEGTHNHPLPPAAMAMASTTSAAANMLLSGSMSSADGLMNPNFLARTILPCSSNMATISASAPFPTVTLDLTQTPNPLQFQRQPSTPFQLPFGTPPQNFPPVANPQMHQVFGQALYNQSKFSGLQVSQDIEAAGAAAQMQNQGQHPQVQQGQHHPSFADTLSAATAAITADPNFTAALAAAISSIIGGSHPSSSNNSNPTTSTPPTANFPGN

SEQ ID NO: 1795 - protein, 573 aa, Coffea arabica
MDKGWGVTVDNPDKIGFFGNKPVFGFNLSPRLNPSKGSLSMFPATEFLANQNRREDSHAAASSDGEKRVVVGEVDFFSDKKKANDILIKKEDCHGEDKMKTNMDVVNTGLQLVIANTGSDQSTVDDGVSSDIEDKRAKLELAQLQVELERMNAENRRLREMLSQVSNNYTALQMHLMTLMHQQQQNAKPQTTQDHEIGERKSEENKPENGGVVVPRQFLDLGPSGTAEMDEPTNSSSEERTLSGSPRNNMELSRNKGVGREESPESQGWAPNKVAKLNAPSKTVDHAQAEATMRKARVSVRARSEAPMITDGCQWRKYGQKMAKGNPCPRAYYRCTMAVGCPVRKQVQRCAEDRTVLITTYEGTHNHPLPPAAMAMASTTSAAANMLLSGSMSSADGLMNPNFLARTILPCSSNMATISASAPFPTVTLDLTQTPNPLQFQRQPSTPFQLPFGTPPQNFPPVANPQMHQVFGQALYNQSKFSGLQVSQDIEAAAAAAAQMQNQGQHPQVQQGQHQPSFADTLSAATAAITADPNFTAALAAAISSIIGGSHPSSSNNSNPTTSTPPTANFPGN

SEQ ID NO: 1796 - protein, 386 aa, Triticum aestivum
  misc_feature (142)..(142): Xaa can be any naturally occurring amino acid
  misc_feature (210)..(210): Xaa can be any naturally occurring amino acid
  misc_feature (330)..(330): Xaa can be any naturally occurring amino acid
MGVQILSSMVEDSSQYSSGASTATTESGTTGRALTALSLPVAIADESVTSAQSASSRFKGVVPQPNGRWGSQIYERHARVWLGTFPDQDLAARAYDVAALRYRGRHAAFNFPCATVEAELAFLAAHSKAEILDMLRKQTYAXDELRQGLRRGRGMGARAQPTPSWAREPLFEKAVTPSDVGKLNRLVVPKHHAEKHFPLKRTPHTTTTTXQGVLLNFEDGQGKVWRFRYSYWNSSQSYVLTKGWSRFVREKGLGAGDSILFSCSLYEQEKQFFIDCKKNTSMNGGKSASPLPVGVTTKGEQVRVVRLFGVDISGVREGGERRRQRRSKAXQELFKRQCVGTRPALSCPRCLRLIASAHTPPYFSRSFCRPSSSSCLLNCRSGRGIE

SEQ ID NO: 1797 - protein, 280 aa, Prunus armeniaca
EKSAKRKRKNQYRGIRQRPWGKWAAEIRDPRKGVRVWLGTFNTAEEAARAYDSEARRIRGKKAKVNFPDETPRSSAKRSVKANPQKMQPKTNMNAIQPNLNQNINFVNDPNQDYYNAMGFLDEKPPTNNFGFMSTFPANDVALKSSTPSDAVPLYFGSDQGSNSFDCSDFGWGEQGSKTPEISSVLSSVMEESDDSLFLEDASPTKKLRSNPEDLVPVQDNAGKTLTDELSAFEMKYFQTPYLDGSWDASVDAFLSGDATQDGGNSVDLWCFDDLVGGGF

SEQ ID NO: 1798 - protein, 167 aa, Brassica napus
  misc_feature (157)..(157): Xaa can be any naturally occurring amino acid
MPKQKAQKKQLKSYKLKHINRTIQEGDAVLMRSSEPGKPSYVARVEAIEATDARGSNARVRVRWYYRPEESMGGRRQFHGAKEVFLSDHFDLQSADTIEGKCKVHSFSSYTKLSSVGNDDFFCRFEYNSATGAFIPDRVAVFCKCEMPYNPDDLMVXQCEECSEWFS

SEQ ID NO: 1799 - protein, 405 aa, Arabidopsis thaliana
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 1800 - protein, 323 aa, Arabidopsis thaliana
MESRLSLFIMKQTILYLISIPYSDVNNFVGVLRYQTSFKSVKLSCGEGGCGACVVLLSNQHSRFVTSPDENSDVVYSFSGYSHASEIVDCYLNGKSPPKTTINPESSKFWWEDPNLYGDCDDLSELRIIEDRLMRTKKHLMDCLEKKEKSYSVSKSDQNPKNNGGSSSSSSSSSSQIASDFGQNPSTSSPFFDHHSYSSLEPSSQVTTCFDQNPIFSVGSESSSDQFRYLVNEDAGFVDCLFETEEEKNRMIVPQETQTQPMFSEEDQSFWENLDVDDVFGLFNDDTNLEVPLQDHSSTNEEDEFMIDISEYLSEEAMEWPMF

SEQ ID NO: 1801 - protein, 244 aa, Solenostemon scutellarioides
MMGRSPCCEKAHTNKGAWTKEEDDRLISYIRAHGEGCWRSLPKAAGLLRCGKSCRLRWINYLRPDLKRGNFTEDEDELIIKLHSLLGNKWSLIAGRLPGRTDNEIKNYWNTHIRRKLVSQGIDPTTHRPINEPAAAAAAPQEEAVSKTISFSQSERIDKCPDLNLDLRISPPSSSQQQNQEPLKTGTSSGSSSTLCFACSIGIQNSKDCSCRDGIMISVSGSSSGYDFLGLKAGVLDYRSLEMK

SEQ ID NO: 1802 - protein, 346 aa, Glycine max
KHPSLFACFVCFLPKTIFFSEAKVLNFSYGLLLSFCFYCFEKNWIFFQGIGVVKQPTMEGGSKPPPPPMLERRARPQKDQALNCPRCNSTNTKFCYYNNYSLSQPRYFCKTCRRYWTEGGSLRNVPVGGGSRKNKRSTPSAPPPSSASAQAKKLPDLTTPNFPQSASQDPKIHQGQDLNLAYPPAEDYNTVSMSKLIEVPYNTELDKGGLHQNPTSSSTPTSASSHHQLSAMELLKTGIAAASSRGLNSFMPMYNSTHHGFPLQDFKPPHHGLNFSLEGFDNGTYGGLHQGIQEDPTTGGARILFPTVEDLKQQVPSTNEFDHQQNRSQEGSAHGYWNGMLGGGSW

SEQ ID NO: 1803 - protein, 269 aa, Triticum aestivum
  misc_feature (111)..(111): Xaa can be any naturally occurring amino acid
  misc_feature (136)..(136): Xaa can be any naturally occurring amino acid
  misc_feature (157)..(157): Xaa can be any naturally occurring amino acid
  misc_feature (170)..(170): Xaa can be any naturally occurring amino acid
  misc_feature (180)..(180): Xaa can be any naturally occurring amino acid
  misc_feature (192)..(192): Xaa can be any naturally occurring amino acid
  misc_feature (206)..(206): Xaa can be any naturally occurring amino acid
MELEAATRRFQLWLRGLRSLRRDLRTARWADDPAQLAKLVAGYVSHFADYCAARAELDPVWTLAAPWASPVKRGPAHCLAGWRPTTLVHLLYTESGRRFEAPVPDLLLGVXPGNLGDLSRAQLAQIDEPERPTVAXEDHLPPEMARVQKAHGPVAPXAGNLLNLAGLVGXRVGAVLARAXDRLRLPTNKRAXGILEPGPGGELVLXAPGDLEIGSREFGAKLNRGCALAACNRPVGVNGRHWAPRRVPAGVCPRGVLGWPRHRAASPAW

SEQ ID NO: 1804 - protein, 248 aa, Solenostemon scutellarioides
MGRSACCSKVGLRRGPWSAKEDSLLSSFIHQHGEGQWRSLPKKAGLLRCGKSCRLRWMNYLRPGIKRGNIGEDEEDLIVRLHALLGNRWSLIAGRLPGRTDNEIKNYWNTHLHKKLQTQKLSTTASAAADNKKKSKKKNLKPPKNLKADALSPVAEGRNIIDNGEETKPTKIYSPKPLRISSIFPRTDSFDSGTSSSGGGGGGGVRIAASCGGVRAGGPGGALPLLRRVRHVGESVRRVYAAALIKHD

SEQ ID NO: 1805 - protein, 312 aa, Vitis vinifera
MAATRKDVDRIKGPWSPEEDDALQKLVQKHGPRNWSLISKSIPGRSGKSCRLRWCNQLSPQVEHRAFTSEEDDTIMRAHARFGNKWATIARLLSGRTDNAIKNHWNSTLKRKCSAITEDGSFGGDYPPHPLKRSVSAGAAAPVSGLYLSPSSPCGSDVSDSSLPVVSSSHVYRPVARTGGIIPPETTSSSNDPPTSLSLSLPGVDSCEVSNRAPEPNHAPPANPIQMIPTMAPLQQIPMHQHNQPATVPATVLSQGEKPFIPFSAELLAVMQEMIRKEVRNYMAGLEQNGVCLQADGIRNAAVKRIGISKIE

SEQ ID NO: 1806 - protein, 107 aa, Brassica napus
  misc_feature (40)..(40): Xaa can be any naturally occurring amino acid
  misc_feature (84)..(84): Xaa can be any naturally occurring amino acid
  misc_feature (90)..(90): Xaa can be any naturally occurring amino acid
MENGVDLQQTPTDDHPPQLQELPFSLPPYPQMIMDAIEAXNGCNKTAIVKHIDSTQITLPPSHLTLLNYHLNWMKQSGQIVIVXNNYMKXNPNAPPNRGRGRPPKPK

SEQ ID NO: 1807 - protein, 178 aa, Glycine max
MMAVARKEMDRIKGPWSPEEDEALQKLVERHGPRNWSLISRSIPGRSGKSCRLRWCNQLSPQVEHRAFTPEEDETIIRAHARFGNKWATIARLLSGRTDNAIKNHWNSTLKRKCASFMTADEAAAGGFSPRPLKRSFSAGTAVPPPGSPSGSDVSESSAAPGVVSVSVSSRGGVIGNL

SEQ ID NO: 1808 - protein, 220 aa, Zea mays
MNDKEMMCQEQCDELSETEISSQEASNSSGPVSLDLSLSVAAAAESSTTDNSNGNNSNSGGAQADAAREPSRVFTCNYCQRKFFSSQALGGHQNAHRRERTLARRALRLDAAGPYYGYGYGYYADVASLPLYGSCLYPIGIQAHASAAALPEHEDARAGADELRRPARGLLSPMPFLVADDEEMLFGWPGSFRPDAAAPADSAGGVAVHAREEPDLTLRL

SEQ ID NO: 1809 - protein, 189 aa, Triticum aestivum
  misc_feature (73)..(73): Xaa can be any naturally occurring amino acid
  misc_feature (86)..(86): Xaa can be any naturally occurring amino acid
  misc_feature (125)..(125): Xaa can be any naturally occurring amino acid
  misc_feature (134)..(134): Xaa can be any naturally occurring amino acid
  misc_feature (151)..(151): Xaa can be any naturally occurring amino acid
  misc_feature (158)..(158): Xaa can be any naturally occurring amino acid
  misc_feature (166)..(166): Xaa can be any naturally occurring amino acid
MSKTPGKTPRTPRRILESYTIKGSDGVIRPGDSVLMKAPDTSNSPYVAMIEEILAVGPRGAHVQVKVRWCYRXPEESIGGRTPFHXEKEVFLSDHQDVQSADIVHWNCFVYSFRDYTKPFGVCPXDYFGRFVFXSITGRFVPCLVAVFWSXELACNPXDLFIPLCXKCPSWFPLSCFGLTIQEARTFSI

SEQ ID NO: 1810 - protein, 405 aa, Triticum turgidum subsp. durum
MGSSDSSSGSAQKAARHQHEPPPPRQRGSAPELPPGFRFHPTDEELVVHYLKKKAAKVPLPVTIIAEVDLYKFDPWELPEKATFGEQEWYFFSPRDRKYPNGARPNRAATSGYWKATGTDKPILASGTGCGLVREKLGVKKALVFYRGKPPKGLKTNWIMHEYRLTDVSGSTTTSRPPPPVTGGSRAAASLRLDDWVLCRIYKKINKAAAGDQQRSTECEDSVEDAVTAYPLYATAGMAGAGAHGSNYASPSLLHHQDSHFLEGLFTADDAGLSAGATSLSHLAAAARASPAPTKQFLAPSSSTPFNWLDASPAGILPQARNFPGFNRSRNVGNMSLSSTADMAGAAGNAVNAMSAFMNPLPVQDGTYHQHHVILGAPLAPEATTGGATSGFQHPVQVSGVNWNP

SEQ ID NO: 1811 - protein, 557 aa, Coccidioides immitis RS
MSRVLEPPSRNPFTRPVEMSTEPRTIPVLSASISPSDPSPGDPMDVSPPASAAMGPPSQSSPEIEQAPTNHTNGNTAESNASQNNASGQPTGAAAAAQQPKVVQTAFIHKLYSMLQDPSIQHLISWSSSNESFVMSPSSDFSKVLSQYFKHTNISSFVRQLNMYGFHKVSDVFHTGSPDSPMWEFRHGNGSFRKGDLSGLREIKRRASRHALIHRDSFSAHKNNNASQPGTPAETVPEVPDRVVNLEHSLYEVHSRLTRMEDQHSLLSSRCQALTESLIRCHQWINLMSRFITSLVPDADNPIHREAANMQREVARQLELARAPESPNDMLMPGRQPYFQNLTVDTGPPLSPRQVAQDSRRTSLARPPIPPHISISPHRYGSIGGASNSASYTRPQVSPHPSGPHPLSVSSPPGANMGRRHTSADIRQHGWPTPGPSPFSAGATSFQWPSSPQRAPNAADQQVRDVLAKYEMGKPRQQPGTPRHATPPLSLDPAQPSEGGWPTGGSKFLRPTESLPATRRSSMASNVHSLLNPAETRERAEEEDAATCEDRKRQRLQ

SEQ ID NO: 1812 - protein, 294 aa, Zea mays
MGRAPCCEKMGLKKGPWTPEEDKVLVAHIQSFGHSNWRALPKQAGLLRCGKSCRLRWINYLRPDIKRGNFSKEEEDAIISLHEQLGNRWSAIAARLPGRTDNEIKNVWHTHLKKRLDPTKQEQQQQHGTTPAAGAGKKHRPAAAAKRGGGGARKATANADAVVVPAPAPATAAPASPERSAASSSVTESSMTEQEQEHGNTGSSPAFPKEESLTTSSSDAEEFQFDDSFWSETLSMPLDSLDDVVPMEPSDDDAFGDVDVAAASSSSVGADGDLDYWLRVFMESGDAHPELPQI

SEQ ID NO: 1813 - protein, 193 aa, Physalis crassifolia
IIFSSTGKLFDFASSSMKDIIEKYKLQSANLDKVDQPSLDLQLENSLNVRLRKQVADKTRELRQMKGEELEGLSLEELQQIEKRLEAGFNRVLEIKGTRIMDEIANLQRKGAELMEENKKLKQKMEMMKLGKLPLITDMECMVMEEGQSSDSIITTNNVCSSNSGPPPEDDSSNASLKLGCNNGLAAVDDDCS

SEQ ID NO: 1814 - protein, 214 aa, Thlaspi arvense
MNSFSAFAEMFGSEYESPDTIGADYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTTTDHGLDMEETIVEAIVNEEQSGGFYMDEEAMFGMPRLLANMAEGMLLPPPSVQWGQNYDCDGDADVSLWSY

SEQ ID NO: 1815 - protein, 193 aa, Physalis alkekengi
IIFSSTGKVFDFASSSMMDILGKYKLQSANLEKVDQPSLDLQLENSLNVRLSKQVADKTRELRQMKGEELEGLSLEELQQIEKRLEAGFNRVLDIKGTRIMDEIAKLQRKGAELMEENKQLKQKMEMMKAGKLPLLIDMDCMVMEEGQSSDSIITTNNVCSSNSGPPPEDDCSNAYLKLGCNNGPAAVEDDFL

SEQ ID NO: 1816 - protein, 408 aa, Aegilops tauschii
MGSSDSSSGSAQKAARHQHEPPPPRQRGSAPELPPGFRFHPTDEELVVHYLKKKAAKVPLPVTIIAEVDLYKFDPWELPEKATFGEQEWYFFSPRDRKYPNGARPNRAATSGYWKATGTDKPILASGTGCGLVREKLGVKKALVFYRGKPPKGLKTNWIMHEYRLTDASGSTTTSRPPPPPPVTGGSRAAASLRLDDWVLCRIYKKINKAAAGDQQRSMECEDSVEDAVTAYPLYATAGMAGAGAHGSNYASSSLLHHQDSHFLDGLFTADDAGLSAGATSLSHLAPAARASPAPTKQFLAPSSSTPFNWLEASAAGILPQARNFPGFNRSRNVGNMSLSSTADMAGAAGNAVNAMSAFMNPLPVQDGTYHQHHVILGAPLAPEATAGAATSGFQHHAVQISGVNWNP

SEQ ID NO: 1817 - protein, 107 aa, Brassica napus
  misc_feature (99)..(99): Xaa can be any naturally occurring amino acid
MDNTNRRRRSKQHKVTLEDSEEVSSIEWKFINMTEQEEDIILRMYRLVGDRWDLIAGRVPGRQPEEIERFWIMRNSDSFAEKRLQLHHSSSHKNNKLHXRPRPSIYP

SEQ ID NO: 1818 - protein, 355 aa, Physcomitrella patens subsp. patens
MPLANVLIAQLNQEVSIHGDPMQRLAAYMVEGLVARVAASGKSIYTSLKCKEPPTRDLLSAMQILYEVCPYFKFGYMAANGAIAEAFQNESRVHIIDFQIAQGTQWTTLIRALAARPGGPPHVRITGIDDPMPGPTPNVGVEMVGKRLANLAEAVGVPFVFHPVAKKGTEIEAWMLERQQGEALAVNFALQLHHMPDESVCTSNPRDRMLHMIKGLNPKVMTLVEQESNTNTAPFFPRFLEALSYYSAIFESLDITLARESKERVNVEQQCLARDIVNIIACEGIDRVERHEMMGKWRARLTMAGFRPYPLSQTVNNTIKTLLESYSDKYRLKEEGGALFLGWKNRPLIVSSAWH

SEQ ID NO: 1819 - protein, 396 aa, Triticum turgidum subsp. durum
MGSSDSSSGSAPPRHQPPPPQQGSAPELPPGFRFHPTDEELVVHYLKKKAAKVPLPVTIITEVDLYKFDPWELPEKATFGEQEWYFFSPRDRKYPNGARPNRAATSGYWKATGTDKPILASGCGREKVGVKKALVFYRGKPPKGLKTNWIMHEYRLTDASSSATTSRPPPVTGGSRSASLRLDDWVLCRIYKKINKAAAGDQQRSMECEDSVEDAVTAYPLYATAGMTGAGAHGSNYDSLLHHQDSHEDNFLDGLLTAEDAGLSAGPTSLSHLAAAARASPAPTKQFLAPSSSTPFNWLDASTVGILPQARNFPGFNRSRNVGNMSLSSTADMAVDNGGGNAINTMPPFMNHLPMQDGTYHQQHVILGAPLAPEATAAATSAFQHPVQISGVNWNP

SEQ ID NO: 1820 - protein, 278 aa, Glycine max
MKIQCDVCNKHEASVFCTADEAALCDGCDHRVHHANKLASKHQRFSLLRPSPKQHPLCDICQERRAFTFCQQDRAILCKECDVSIHSANEHTLKHDRFLLTGVKLSASAMLRSSETTSDSNSNPSLLNFSHQTTLLPPSSTTTTTTSNNNNNKVAVEGTGSTSASSISEYLIETLPGWQVEDFLDSYSVPFGFCKNDEVLPRFDGEMEGHLSSFSTENMGIWVPQAPPTLMCSSQMDRVIVHGETNIKGSSRSRLKDDNFTVPQISPPSNSKRARFLW

SEQ ID NO: 1821 - protein, 221 aa, Withania somnifera
IVFSATGKLFEFASSSMKDILGKYKLQSANLEKVYQPSLDLQLENSLNVRLCKQVADKTRELRQMKGEELEGLSLEELQQLEKRLEAGFNRVVEIKDRRIMDEIANLQRKGAELMEENKQLKEKMEMTKVGKLPLLTDMVMEEGQSSDSIITTNNICSSNSGPPPEDDCSNVSLKLGYNNGPAAVDDDCSNVSLKLGYNNGPAAVDDDCSITSLKLGQPLS

SEQ ID NO: 1822 - protein, 383 aa, Aegilops tauschii
MGSSDSSSGSAPPRHQPPPPQQGSAPELPPGFRFHPTDEELVVHYLKKKAAKVPLPVTIIAEVDLYKFDPWELPEKATFGEQEWYFFSPRDRKYPNGARPNRAATSGYWKATGTDKPIMASGCGREKVGVKKALVFYRGKPPKGLKTNWIMHEYRLTDASSSATTSRPPPVTGGSRAASLRLDDWVLCRIYKKINKAAAGDQQRSMECEDSVEDAVTAYPPYATAGMTGAGAHGSNYDSLLHHQDSHEDNFLDGLLTAEDAGLSAGATSLSHLAAAARASPAPTKQFLAPSSSTPFNWLDASTVGILPQARNFPGFNRSRNVGNMSLSSTADMAVDNGGGNAINAMPPFMNHLPVQDGTYHQQHVILGAPLAPEATAAATSAF

SEQ ID NO: 1823 - protein, 204 aa, Withania somnifera
IIFSATGKLFEYASSSMRDILGKYKLQSANLEKVDQPSLDLQLENSLNMRLSKQVADKTRELRQMRGEELEGLSLEELQQIEKRLEAGFNRVLEIKGARIMDEITKLQRKGAELMEEKKQLNQKMEMLKEGKLPLVIDMDCMVMEEGQSSESIITTNNVCSSNSGPPPEDDCSNASLKLGCNIGPAAVEDDSSITSLKLGLSFS

SEQ ID NO: 1824 - protein, 203 aa, Triticum aestivum
VVCVQTDKASLLAEVLEHVKELKRQTSAMTMMAAAVGGGEDDDAAPVQMLPTEADELGVDAAEDGDGRLVVRASLCCEDRPDLIPDIIRALAALRLRAHRAEITTLGGRVRSVLLITAEEGECADEGGDGIDEECAASHRRHECIASVQEALRGVMDRRAACSNDTSSSGGGGVSIKRQRMNYGAHEQCSVYPLAVIIQDRKS

SEQ ID NO: 1825 - protein, 181 aa, Lupinus angustifolius
PYFPSSSSSYHPFAFFNPENASSNNTFSHDPFSFPYNMPNTHHYHAPNPETVANFADCGASAAMFKNDVSGSNFGFSNFMAKKPAPKKDRHSKIYTSQGLRDRRVRLSIEIARKFFDLQDMLGFDKASNTLEWLFNKSKKAMKELARSKNSSSGVVANSFSSSDSECEVVSMINQDSIDAT

SEQ ID NO: 1826 - protein, 341 aa, Arabidopsis thaliana
MESHNNNQSNNNTTGSAHLVPSMGPISGSVSLTTTAPNSTTTTVTAAKTPAKRPSKDRHIKVDGRGRRIRMPAICAARVFQLTRELQHKSDGETIEWLLQQAEPAIIAATGTGTIPANISTLNISLRSSGSTLSAPLSKSFHMGRAAQNAAVFGFQQQLYHPHHITTDSSSSSLPKTFREEDLFKDPNFLDQEPGSRSPKPGSEAPDQDPGSTRSRTQNMIPPMWALAPTPASTNGGSAFWMLPVGGGGGPANVQDPSQHMWAFNPGHYPGRIGSVQLGSMLVGGQQLGLGVAENNNLGLFSGGGGDGGRVGLGMSLEQKPQHQVSDHATRDQNPTIDGSP

SEQ ID NO: 1827 - protein, 345 aa, Oryza sativa
MGRSPCCEKEGLKKGPWTPEEDQKLLAYIEQHGHGCWRSLPSKAGLQRCGKSCRLRWTNYLRPDIKRGKFSLQEEQTIIQLHALLGNRWSAIATHLPKRTDNEIKNYWNTHLKKRLAKMGIDPVTHKPRSDVAGAGGGGGGAAGGAAGAQHAKAAAHLSHTAQWESARLEAEARLAREAKLRALAASATPGAPHLPAPPASAAAAAEAHGLDSPTSTLSFSESAVLATVLEAHGAAAAAAARAAMQPMQAYDEACKDQHWGDVDAADVGFPGAGAGFTGLLLEGSLNQIPRPAGRDAEADGEFQETEEEKNYWNSILNLVNSSSAPMSTAVVVPASHAYSPAPDF

SEQ ID NO: 1828 - protein, 378 aa, Triticum aestivum
MDAAHWPQGLGLVKPMEEMLMGAPSSNQQVQGSNPNPPAQAPSSAPGAGGPMRGGTPAMAVAASGVGAGSTERRPRPQKEKAINCPRCNSTNTKFCYYNNYSLQQPRYFCKTCRRYWTEGGSLRNVPVGGGSRKNKRSSSSSASASASAAASATASVANSSMLGAAPNKNPKLAHEGAAHDLNLAFPHHQGGMQAQADYMAFPSLESSSMCNPGGGGMAANGARAGGALSAMELLRSTGCYMPLQMPMQMPGEYGAAGFSLGEFRAPAPPQSQSLLGFSLDAHGSVGGASMAGYGSGAGMQGMQDRSGRLLFAFEDLKPTANSGAGGGESGGGSGAGVDGGDHQFEQGNKEQQGNGTPVGQPDTPGFWNGMIGGGGTW

SEQ ID NO: 1829 - protein, 341 aa, Arabidopsis thaliana
  misc_feature (52)..(52): Xaa can be any naturally occurring amino acid
MTKKLNPLEDPPTATSSDEDDVETSEAGEASDDSSSSEEDAPIKIRIKSPSXPNSGSGKTIALNAVNLKKKEDPTSSSATLALPAVKSGTKRPASEAAATTSTKRVKKDEETVKKPGGFQRLWSEEDEILVLQGMIDFKADTGKSPYVDTNAFYDFLKKSISFEVSKNQFMDKIRSLRKKYIGKEGRNEPSFVKAHDNKAFELSKFIWGPKGIALDSNVKSNGVSKKSVAKKKIDSVKQELVFVGGSSTNNGKKVEEDGGDDGCDWFDNSSLVRMIASLGVDEYYVKQQWSLVSVESKKIVEEKYKLLQAKELEFVLEKTKFLNEVASMFVEASKNKPLDT

SEQ ID NO: 1830 - protein, 136 aa, Rosa hybrid cultivar
MMEVCRAQGFVYGIIPEKGKPVSGASDNLREWWKDKVRFDRNGPAAISKYQADNSIPGLMEDCISVASTPHTLQELQDTTLGSLLSALMQHCDPPQRRFPLEKGVSPPWWPTGNEEWWPQLNLANQGPPPYKKPHG

SEQ ID NO: 1831 - protein, 233 aa, Eschscholzia californica subsp. californica
GTRVGAPPEVVAKLEEANATGEAMARTGSGTGCIGEDPALDQFMEAYCEMLTKYQQELTKPFEEAMMFLSRIECQFKALTVSDSVGGEAVNRNGSSDEDIDANDNYIDPQAEDRELKGQLLRKYSGYLGSLKQEFLKKRKKGKLPKEARQQLLDWWSRHYKWPYPSESQKIALAESTGLDQKQINNWFINQRKRHWKPSEEMQFVVMDSAHQHYYIENGMGNSRFPMDCTPML

SEQ ID NO: 1832 - protein, 207 aa, Triticum aestivum
MEGCDRIRGPWSPEEDSALRQLVERHGARNWTAIGRGVPGRSGKSCRLRWCNQLSPGVERRPFTAEEDAVIARAHARLGNRWAAIARLLRGRTDNAVKNHWNCSLKRRLGDLGADGVTEGDLDERPCKRASVTPESTSGSGSGSGSGSDRSDLSHGGAFGLGQVYRPVARVGGFEPADCAMSQRHEEEQEDPFTSLSLSLPGTDAMG

SEQ ID NO: 1833 - protein, 71 aa, Chlamydomonas reinhardtii
MPPSRPTSPQPLNQVLGCGLSLAGMKGYFLRHRVCEEHSKAPVLIIGGAPSRLCQQCSKFHHVNAFEGAKR

SEQ ID NO: 1834 - protein, 370 aa, Arabidopsis thaliana
MTRRCSHCSNNGHNSRTCPTRGGSGSSSAVKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 1835 - protein, 265 aa, Solanum lycopersicum
MGRAPCCEKMGLKKGPWTPQEDNILISYIQNNGHSNWRALPKLAGLLRCGKSCRLRWTNYLRPDIKRGNFTKEEEDTIIKLHENLGNRWSAIAARLPGRTDNEIKNIWHTNLKKKLKNYQPCQNSKRHSKTSHVSNKGPTTSESSNNSDLSTSTKQHIKIAPNSPQLSSSEMSSVTLVVDDNQMVIIKEEKIESSSSEYFPKIDESFWADELSTENNMIIGHDQEIQVREENVDIFTTSSKMEEDMDFWYNVFIKTGDLPELPEF

SEQ ID NO: 1836 - protein, 184 aa, Lilium hybrid division I
MDRKVGTNEDVEVRKGPWTMEEDLILINYIANHGDGVWNTLARSAGLKRTGKSCRLRWLNYLRPDVRRGNITPEEQLLIMELHDRWGNRWSKIAKELPGRTDNEIKNFWRTRVQKKSKNGESSEGQISMLSDETSAMQMEDVDVGVSQTSYDQGQTSNNLDAFEIPFEPGDNLLSVEELWAMQY

SEQ ID NO: 1837 - protein, 295 aa, Glycine max
MGAPKQKWTAEEEAALKAGVLKHGAGKWRTILTDPEFSAILHMRSNVDLKDKWRNINVTAIWGSRQKAKLALKRNLPAPKIDNNHMALSTVVRHDEVLDTKPLAVSGGPLQSTNLKEQISRLVDNHILEAIVYMKEQKGSDKAAIASFIEEKYRFPPNLSKLLPAKLKHMVASGKIIKEKHKYRIAPSSTVSEKRRCSSLVLLEDRPKDPSEAHKNDDVNILLKSQIDAEISKVKGLTAQEAAAAAAKAVAEAEAAIAQAEAAAREAEAAEAEAEAAQVFAKAAMKALKCKMLHI

SEQ ID NO: 1838 - protein, 281 aa, Glycine max
MGRAPCCSKVGLHRGPWTPREDALLTKYIQTHGEGQWRSLPKRAGLLRCGKSCRLRWMNYLRPDIKRGNITPEEDDLIVRMHSLLGNRWSLIAGRLPGRTDNEIKNYWNTHLSKKLRNQGTDPKTHDKLTEAPEKKKGKKKNKQKNENNKGSEKTLVYLPKPIRVKALSSCIPRTDSTLTLNSNSATASTSEEKVQSPEAEVKEVNMVWGVGDDADNGGIEIFFGEDHDLVNNTASYEECYSDVHTDDHGTLEKLYEEYLQLLNVEEKPDELDSFAQSLLV

SEQ ID NO: 1839 - protein, 247 aa, Gerbera hybrid cultivar
MGRGRVELKRIENKINRQVTFAKRRNGLLKKAYELSVLCDAEVALIIFSNRGKLFEFCSTSNMLKMLERYQNCTYGSMEVDRSTPNAEQSSYKEYMKLKAKYESLQQYQRQLFGEDLGPLSLKELEQLERQLDSTLRQIRSIRTQSMLDRLSELQVKERMWVEANKALQNKLEEVYAENQAGPSWAAGEHHSSYGQEHQHQHQSQGFFQPLDCNSNLQIGYNTVDSSHITASTNGQNLNGLIPGWML

SEQ ID NO: 1840 - protein, 342 aa, Zea mays
MAKVKQKVATEDILEGDDERTSSENNSVPPVILDLNEGFGEGNEEGEASDDGDDNQEEDGDDGGSTSEVAGGRNSSNNSSTNHTSMSNKDYDMNSSSNGEGREERELAVRQYNRSKLPRLRWTPDLHMAFVHAVERLGGQERATPKLVLQTMNVRGITIAHVKSHLQMYRSKKLDQESAGHERAATSSVFSPMDFHMMRTGDHHRYHDMFLHRPAAGSAISSRLLHGGEFFGSRNAAVSPEARRLYELLLRRQPTMQTFDFKGYSSGSGLRDQEWRFSQHAAATARAVSINDHGPTKGLIHDMGLRKNSRSMSHLFDVRDRDAIASNRTSSDATGAASHGVT

SEQ ID NO: 1841 - protein, 242 aa, Brassica napus
MDGGYDQSGHSRYFHNLFRPELQHQLQPQPQPQPQPQPQPQPQSDDESDSNNKYPGQPDSDQVTSGSTSGKRPRGRPPGSKNKPKPPVIVTRDSPNVLRSHVLEVSSGADIIESVNNYARRRGRGVSILSGNGTVANLTLRQPVTTHGNNGGTEAGAGGVVTLRGRFEILSITGTVLPPPAPPGCGGLSIFVAGEQGRMIGGRVVAPLVASGPVILMAASFSNATFERLPLEDEGGEGGGDV

SEQ ID NO: 1842 - protein, 751 aa, Saccharomyces cerevisiae
MAGAPAPPPPPPPPALGGSAPKPAKSVMQGRDALLGDIRKGMKLKKAETNDRSAPIVGGGVVSSASGSSGTVSSKGPSMSAPPIPGMGAPQLGDILAGGIPKLKHINNNASTKPSPSASAPPIPGAVPSVAAPPIPNAPLSPAPAVPSIPSSSAPPIPDIPSSAAPPIPIVPSSPAPPLPLSGASAPKVPQNRPHMPSVRPAHRSHQRKSSNISLPSVSAPPLPSASLPTHVSNPPQAPPPPPTPTIGLDSKNIKPTDNAVSPPSSEVPAGGLPFLAEINARRSERGAVEGVSSTKIQTENHKSPSQRPLPSSAPPIPTSHAPPLPPTAPPPPSLPNVTSAPKKATSAPRPPPPPLPAAMSSASTNSVKATPVPPTLAPPLPNTTSVPPNKASSMPAPPPPPPPPPGAFSTSSALSASSIPLAPLPPPPPPSVATSVPSAPPPPPTLTTNKPSASSKQSKISSSSSSSAVTPGGPLPFLAEIQKKRDDRFVVGGDTGYTTQDKQEDVIGSSKDDNVRPSPISPSINPPKQSSQNGMSFLDEIESKLHKQTSSNAFNAPPPHTDAMAPPLPPSAPPPPITSLPTPTASGDDHTNDKSETVLGMKKAKAPALPGHVPPPPVPPVLSDDSKNNVPAASLLHDVLPSSNLEKPPSPPVAAAPPLPTFSAPSLPQQSVSTSIPSPPPVAPTLSERTETESISKNPTKSPPPPPSHLRWIPVPLIAPVKTLNNGYFLQVDRRCNTSIIRIQINQMLM

SEQ ID NO: 1843 - protein, 406 aa, Hordeum vulgare subsp. vulgare
MGSPDSSSGSAQKPPRHQHQHQPPPPRRQGSAPELPPGFRFHPTDEELVVHYLKKKAAKAPLPVTIIAEVDLYKFDPWELPEKATFGEHEWYFFSPRDRKYANGARPNRAATSGYWKATGTDKPILASATGCGREKVGVKKALVFYRGKPPRGLKTNWIMHEYRLTGASAGSTTTSRPPPVTGGSRAPASLRLDDWVLCRIYKKTSKAAAAVGDEQRSMECEDSVEDAVTAYPPYATAGMAGAGAHGSNYVQLLHHHDSHEDNFQLDGLLTEHDVGLSAGAASLGHLAAAARATKQFLAPSSSTPFNWLEASTGGSILPQARNFPGFNRSRNVGSMSLSSTADDMAGAVDVSDGGNAVNAMYLPVQDGTYHQHVILGAPLAPEAIAGAATSGFQHHVQISGVNWNP

SEQ ID NO: 1844 - protein, 92 aa, Physcomitrella patens subsp. patens
MARILCRNRPRKKLGVKRVREPRYAIKTRTDTDVMDDGYKWRKYGQKAVKKSPHPRNYYRCTTLNCPVRKRVERCFDDPGVMVTTYEGTHTH

SEQ ID NO: 1845 - protein, 264 aa, Glycine max
MSTSKSVSSSSEDDNELRRGPWTLEEDNLLSQYIFNHGEGRWNLLAKRSGLKRTGKSCRLRWLNYLKPDVKRGNLTPQEQLIILELHSKWGNRWSKIAQHLPGRTDNEIKNYWRTRIQKQARHLKIYTDSREFQELVRRFWMPRLLQKAKESSSSNMSIQNQAIPMPFDYVSQHLTVGTIPPWQGPCMNEAGPTYMDQHEQNSDSEHNNGSCISLSESANIPKVPQHFGHTTITQFHALNTNDFGTFTYEGYNVNNNVYEMDNF

SEQ ID NO: 1846 - protein, 402 aa, Hordeum vulgare subsp. vulgare
  misc_feature (132)..(132): Xaa can be any naturally occurring amino acid
MGSSDSSSGSAPPRHQPPPPQQGSAPELPPGFRFHPTDEELVVHYLKKKAAKVPLPVTIIAEVDLYKFDPWELPEKATFGEQEWYFFSPRDRKYPNGARPNRAATSGYWKATGTDKPILASGCGREKVGVKXALVFYRGKPPKGLKTNWIMHEYRLTDASSSAATSRPPPVTGGSRAASLRLDDWVLCRIYKKINKAAAADQQRSMECEDSVEDAVTAYPPYATACMTGEGAHGSNYASLLHHQDSHEDNFLDGLLTAEDAGLSAGATSLSHLAAAARGSPAPTKQFLAPSSSTQFNWLDASTVGILPHARNFPGFNRSRNVGNMSLSSTADMAGAGTCAVDNGGGNAMNVMPPFMNHLPVQDGTYHQQHVILGAPLAPEATGAAASAFQHPVQISGVNWNP

SEQ ID NO: 1847 - protein, 473 aa, Zea mays
MIAGGGYFDGSHDHILMEGSMIHDSSQSSIYDNTDVEQQNFRFAPFIIEDHSNPANLTSEAARVIDQIQHQLGIDIEQDHSDHMMQEVPPAETENLVPAVYGVQDHILSHQIEGPHNITVEQQVLGYDPASYRNGTYAAAHDLLNSLHIQRCSLIPEFPSTEHIFSDPAQNMVNRLDITNDLPGVANHESGMMFSDSTVPLGYHATQSHMLKDLYHSLPQNYGLFTSDDERDGMVGVPGVSGNIFQEIDGRQFDSPILGSRKQKGGFGKGKGKANFATERERREQFNVKYGALRSLFPNPTKNDRASIVGDAIEYINELNRTVKELKILLEKKRNSADRRKILKLDEEAADDGESSSMQPVSDDQNNQMNGTIRSSWVQRRSKECDVDVRIVDDEINIKFTEKKRANSLLCAAKVLEEFHLELIHVVGGIIGDHHIFMFNTKIPKGSSVYACAVAKKLLEAVEIKKQAYNIFN

SEQ ID NO: 1848 - protein, 191 aa, Tubocapsicum anomalum
IVFSATGKLFEFASSGMKDILGKYKLQSANLEKVYQPSLDLQLENSLNVRLCKQVADKTRELRQMKGEELEGLSLEELQQLEKRLEAGFNRVVEIKDRRIMDEIANLQRKGAELMEENKQLKEKMEMTKVGKLPLLTDMVMEEGQSSDSIITTTNNICSSNSGPPPEDDCSNVSLKLGYNNGPAAVDDDCS

SEQ ID NO: 1849 - protein, 218 aa, Lupinus angustifolius
PYPCYPSASNSYPFFPFLNPENASSSNNNNNHTLLHDPLVHVPYNLPTHHHIHNTPIIQETLTNLAVSDVAATMPKQDPIMSGGGGAHHHYGLSSLLTKKPAKKDRHSKIYTSQGLRDRRVRLSIEIARKFFDLQDMLGFDKASNTLEWLFNKSKRAIKELARSKKNNGSEGDANSFSSSSDREDCNEVVSGINNEQQGITIADNDSNALKDMKKLKR

SEQ ID NO: 1850 - protein, 193 aa, Tubocapsicum anomalum
IIFSATGKLFEFASSSMRDILGKYKLQSANLEKVDQPSLDLQLENSLNVRLSKQVADKTRELRQMRGEELEGLSLEELQQIEKRLEAGFNRVLEIKGARIMDEIAKLQRKGAELIEENKQLKQKMEMLKEGKLPLVTDMDCMVMEEGQSSESIITTNNVCSNNSGPLPEDDCSNASLKLGCNNGPAALEDDSS

SEQ ID NO: 1851 - protein, 216 aa, Withania coagulans
DADVALIVFSATGKLFEFASSSMKDILGKYKLQSANLEKVYQPSLDLQLENSLNVRLCKQVADKTRELRQMKGEELEGLSLEELQQLEKRLEAGFNRVVEIKDRRIMDEIANLQRKGAELMEENKQLKEKMEMTKVGKLPLLTDMVMEEGQSSDSIITTTNNICSSNSGPPPEDDCSNVSLKLGYNNGPAAVDDDCSITSLTLGQGYHSASKGRLY

SEQ ID NO: 1852 - protein, 316 aa, Oryza sativa Japonica Group
MAAGEEVMDRSTSAEDGYCSAGTDSPRAESVDEQGAAEESSPRGGQKRELPSPSASPSSPLPPAAKRSRRSVEKRVVSVPIAECGDRPKGAGEGPPPSDSWAWRKYGQKPIKGSPYPRGYYRCSSSKGCPARKQVERSRADPTVLLVTYSFEHNHPWPQPKSSSCHASKSSPRSTAPKPEPVADGQHPEPAENESSASAELEVPEPEPEQESEPVVKQEEEQKEEQKAVVEPAAVTTTVAPAPAVEEEDENFDFGWIDQYHPTWHRSYAPLLPPEEWERELQGDDALFAGLGELPECAVVFGRRRELGLAATGPCS

SEQ ID NO: 1853 - protein, 389 aa, Prunus persica
MEEYNQMDHESSGGRGNFLYASPNLGGNYGRASHDHQMGINAFHLQSSGGGDFHSPGGAHPINVKTEASTSHHGHHKFQYNNNNNNNNNNPLLSSRGHQPVVQQQHNLDRQNDDHTLSSNEVEAIKAKIIAHPQYSNLLEAYMDCQRVGAPSEVVARLTAARQEFEARQRSSVASREASKDPELDQFMEAYYDMLVKYREELTRPIQEAMDFMRRIETQLNMLGNNNAPPLRIFSPSEDKCEGLGSSEEEQENSGGETEVPEIDPRAEDRELKNHLLKKYSGYLSSLKQELSKKKKKGKLPKDARQKLLSWWELHYKWPYPSESEKVALAESTGLDQKQINNWFINQRKRHWKPSEDMQFMVMDGLHPQNAALYMDGHYIGDGHYRLGP

SEQ ID NO: 1854 - protein, 150 aa, Calpurnia aurea
NNTFSHDPLSVPYIPSTHHGPIPETLTNLAVADCAAAAAMFKNDVSGVHYGFSNFLTKKPPAKKDRHSKIHTSQGLRDRRVRLSIEIARKFFDLQDMLGFDKASNTLEWLFNKSKKAMKDLARSKQSSSGAANSFSSSSECEVVSVINQD

SEQ ID NO: 1855 - protein, 401 aa, Zea mays
  misc_feature (285)..(285): Xaa can be any naturally occurring amino acid
  misc_feature (301)..(301): Xaa can be any naturally occurring amino acid
  misc_feature (312)..(312): Xaa can be any naturally occurring amino acid
  misc_feature (322)..(322): Xaa can be any naturally occurring amino acid
  misc_feature (365)..(365): Xaa can be any naturally occurring amino acid
MDSTSCLVDDASSGASTGKKPAPAPAAATGKPLQRVGSGTSAVMDAAEPGAEADSGGAGRAPGGVSGKLPSSKYKGVVPQPNGRWGAQIYERHQRVWLGTFTGEAEAARAYDVAAQRFRGRDAVTNFRPLAESEPEAAVELRFLASRSKAEVVDMLRKHTYGEELAHNRRAFAAASPAASPPPENNRRPPAASSSSSPAAAREHLFDKTVTPSDVGELNRLVIPKQHAEKHFPLQLPAAAAAGVGSGGECKGVLPHFEDAAGKAWRVRYSYWNSSQSYVLTKGWXRFVKEKGLQAGDVVGXYRSAAGADSKXFIDCKLRPNXVDTAASTTSRVGSSPPPAPVAKAVRLFGVDLLTAPADAMARCXRARDLASPPQAAIKKQLVELALASVDQCYGAGRSFS

SEQ ID NO: 1856 - protein, 182 aa, Glycine max
SDNKKKKYKGVRMRSWGSWVSEIRAPNQKTRIWLGSYSTAEAAARAYDAALLCLKGSSANLNFPSSSSSSQHYIIPQDTAMMSPKSIQRVAAAAANNFLDNNAIAINNATTPPSPISPHSPPLASTSSSFVSSPSMSSSSPLDQIDDDYVDQMLSGAFFDIDSTQLLDDLYEESDIRLWSFC

SEQ ID NO: 1857 - protein, 262 aa, Gentiana triflora
MGRGRVQLRRIENKISRQVTFSKRRNGLLKKAHEISVLCDAEVALIVFSSKGKLFEYSTDSSMESILERYERYSYDEKRINGTESQAKDNWSMEYPKLVSRIELLQKNIRHYEGEDLNPLNMRELQSLEQQLDTALKKIRTRKSQLMHDSVSELQKKEKALQEQNNLLAKKLKENEKNITQQRMQSADQHRLVDVSNHPPPPSPPPLFPQSLSIQPPLQQPGIHFQTSETIGSDGGDGNQNGTEAAAGTNTHMPPWMVRHLN

SEQ ID NO: 1858 - protein, 222 aa, Solanum macrocarpon
MVRQKIQIKKIDNLTARQVTFSKRRRGLFKKAQELSTLCDADIGLIVFSATGKLFEYSSSSMMQLIEKHKTQSERDNMNGSEQLKSSNLQSEKKTYAMLSRELVEKNRELRQLHGEELQGLGLDELMKLEKLVEGGISRVLKIKSDKFTREISSLKKKEAQLQEENSQLKHQSQARLNEEGQNAIEQGHSADSITNNRSLVSSHQDYDDSDTSLKLGLGFPY

SEQ ID NO: 1859 - protein, 80 aa, Brassica oleracea var. oleracea
NQLMYDSINELQRKEKAIQEQNSMLSKQIKERENVLRAQQEQWDEQNHGHNMPPPPPPQQHQIQHPYMLSHQPSPFLNMG

SEQ ID NO: 1860 - protein, 337 aa, Arabidopsis thaliana
MRLDDEPENALVVSSSPKTVVASGNVKYKGVVQQQNGHWGAQIYADHKRIWLGTFKSADEAATAYDSASIKLRSFDANSHRNFPWSTITLNEPDFQNCYTTETVLNMIRDGSYQHKFRDFLRIRSQIVASINIGGPKQARGEVNQESDKCFSCTQLFQKELTPSDVGKLNRLVIPKKYAVKYMPFISADQSEKEEGEIVGSVEDVEVVFYDRAMRQWKFRYCYWKSSQSFVFTRGWNGFVKEKNLKEKDVIAFYTCDVPNNVKTLEGQRKNFLMIDVHCFSDNGSVVAEEVSMTVHDSSVQVKKTENLVSSMLEDKETKSEENKGGFMLFGVRIECP

SEQ ID NO: 1861 - protein, 117 aa, Brassica insularis
RNQRHYLGEDLQAVSSKELQNLEQQLDTALKHIRSRKNQLMYDSINELQRKEKAIQEQNGMLSKEIKEREKILRAQQEQWDQQNHGHNMPPPSPPQQHQIQHPYMLSHQPSPFLDMG

SEQ ID NO: 1862 - protein, 304 aa, Glycine max
MQAGHQAMVSGLLLYPPSLKLLETMCREQVLRKEKGKSEMLEPAVTSSSGGSGSSLGKTCSLSTRNQGQKRKGIDVEESEEQSEDTELKSALGNKSSQRTGSARRNRAAEVHNLSERRRRDRINEKMKALQQLIPHSSKTDKASMLEEAIEYLKSLQLQLQLMWMGSGMAPIMFPGIQHYMSQMGMGMARPPFPPPIHNPMQLPRLPLDQSVSASQTPNQTLMSQNPILGAFNYHNQMQNPALSEQYARYMGYHLMQNASQPMNVFRYGPQGVRHSQTMITPSNSSGNMSGAANIDEAVSGKMG

SEQ ID NO: 1863 - protein, 244 aa, Glycine max
MEYSQYTTYSAEGVEAETYTSSCTTPSRSKKRNNNNTRRFSDEQIKSLETMFESETRLEPRKKLQLARELGLQPRQVAIWFQNKRARWKSKQLERDYGILQSNYNSLASRFEALKKENQTLLIQLQKLNHLMQKPMEPGQRCTQVEAANSMDSESENGGTMKCEAEGKPSPSMEISEHLLGVLSDDDTSIKVEDFGLEDEHGLLNFAKHVDGSLTSPEDWNAFESNDLLGQSTTDDYQWWDFWS

SEQ ID NO: 1864 - protein, 299 aa, Triticum aestivum
  misc_feature (143)..(143): Xaa can be any naturally occurring amino acid
  misc_feature (229)..(229): Xaa can be any naturally occurring amino acid
MAACRAGGGGGGKDVDRIKGPWSPEEDDALQRLVGRHGARNWSLISKSIPGRSGKSCRLRWCNQLSPQVEHRPFTPDEDDTILRAHARFGNKWATIARLLSGRTDNAIKNHWNSTLKRKYSSSSSTSASASASPADDAMANDXRTAGPLKRTSSDGYPGLCFSPGSPSGSDLSDSSHQEPPLRSWPSAASQQPHVYRPVARAGGVVVLPTATPQPSPPCPSPPAPPPPXATSLSLSLSLPGLDAPEPAPVAQPMSCQPPLLLLLYSPPQRSECRAATMPSCSAAPEPSTAGGLSRGVLS

SEQ ID NO: 1865 - protein, 215 aa, Populus trichocarpa
MARKKIQIKKIDNTSARQVSFSKRRRGLFKKAFELSILCDAEIALMVFSATGKFFEYSNSSIGQVIERRNLHPKNLDTFSQPSVELQLDSAVHAMLNKEIAEKTRELRRTRGEDLQGLNMEELEKLEKLIEKSLCRVIETKGEKILKEVDALKSKEHQLIEENQRLKQRLMSLSKGQGHLLEQGQSSDSMVNNISSNSANPRQDYDNYSSFLTLG

SEQ ID NO: 1866 - protein, 684 aa, Botryotinia fuckeliana
MMEKGGDMAGPSANNSSDFVSIHTQHTCTFSRRDGANIEISSLTDVSFTGPKIIQVRKYLVRMLEDPTYESIVRWGEAGESFVVLENEKFTKQILPKHFKHSNFASFVRQLNKYDFHKVRQNNEDNTQSPYGQNAWEFKHPEFQANKKDSLDNIRRKAPAPRKVAQSNEETYPAHAQQQMDLLGNQLAATQQQLQGLSRSYQDLAQLNIMLLQQVVDAQKFIKNHEGVMHGLVGHLFSQDAQRRNGRAPGLSNGAGPNMLGRPTEDGHPSTPLLQARSLLGQLSAENFPSKELEQMSHDYHLRQDYSTPPNDPGGLVSMPPISESVTAPSAGYSMDKSELDNLVYPVGAIVGIDPIDQQHVNNIPYALPPQGLMPRDSMPPAELMPQPPRAPGPRKKGMVSIWGERKPRILLVEDDQVCARIGTKFLESFECGVDIARDGLEAVSKINLGAENHFDLILMDIIMPHLDGVSATVCIREIRANIPIIAMTSNIRTDDIEMYFRYGMNDVLPKPFTKEGMMKALEKHLAHFRKDAPSIGFSSPGPMSHPGGFVTPTQSQSHPPLGLNMGQLTATQSIVDDTASGKSPQTATSWQSPIQLPGGSPVVTSAPGSYMQPTNGMRDPSYSVTPTHPHSQSGFAPPLSGLGNQRPPHRRGISDISGASTPDGNSDQKRQRMYAPPGNYQQG

SEQ ID NO: 1867 - protein, 117 aa, Zea mays
FGSSDDIRKKHYRGVRQRPWGKWAAEIRDPKKAARVWLGTFDTAEAAAMAYDAAALRFKGNKAKLNFPERVVMPIQPQTNNNNSTSSSAPTTHALLLFHHHNKYIIIVLFQQKGFQI

SEQ ID NO: 1868 - protein, 258 aa, Triticum aestivum
MAAPCQSPQGGNELMAYDACYPTVSGGPALLPRQASSAPPAGPPELSTTSSSTTGSGRTATEARALKVHSEAERRRRVRINAHLTALRRMIPDTKQMDKAALLARVVDQVKHLKRRAGEAAQQTPAVPPETDEVSIEFCAGDNDSRLYMKASVSCDDRPDLVAGLIQALHGLRLRTVRAEVTSLGGRVQHVFTLCKEEDEEGSAAAGLAGLTSLKEAARLALARVASPELVCGGTGSPFQFQSRGTRILESHYSIMSI

SEQ ID NO: 1869 - protein, 428 aa, Physcomitrella patens subsp. patens
MGDALSSLITSHNVYFECSQPNYLDNTSSSSSQANAYTNFFNTTGCFPSDHNPVAVTQMSYVTTEIHDEGRYLSLPPRIATNGNFSTGTCSRVNVQSEGSINRDMELFRREIAFKCPKSSDLLLAITTSADAAVREHGSGSAGSAHSSDSEEVPDGLESEQVPELRAAIIDHPFYPEMVLAHVRVFKIGAPRRLINKLDDLTRKFQQYQNCDTLKIGTDPALDHFMRSYVDMLTKFAEDLEEPFNKFMQFKDSTTKALEGICGHYVETTPDEDDNNGFDIGPMEYGAQASDDLYLPADENLMYPLDIDESVVVDPMASDEEIKKALRKKYGRHIGELKAEFNRVRKKGKLPSSARSILKDWFNRHSYWPYPSEMEKQYLQKLCGLNLKQINNWFINERKRHWSCEGKCMHPNTKFYSNANGQCNGHLE

SEQ ID NO: 1870 - protein, 221 aa, Arabidopsis thaliana
MASLISDIEPPTSTTSDLVRRKKRSSASSAASSRSSASSVSGEIHARWRSEKQQRIYSAKLFQALQQVRLNSSASTSSSPTAQKRGKAVREAADRALAVSARGRTLWSRAILANRIKLKFRKQRRPRATVAVPAMTTVVSSSSNRSRKRRVSVLRLNKKSIPDVNRKVRVLGRLVPGCGKQSVPVILEEATDYIQALEMQVRAMNSLVQLLSSYGSAPPPI

SEQ ID NO: 1871 - protein, 194 aa, Calpurnia aurea
FFNPENASSSNTLLHDPLAVPYIPTHHNTPIPETLTNLVVSDNCGAAAMPKQDPSGAHYGLSCLLTKKPAKKDRHSKIYTSQGLRDRRVRLSIDIARKFFDLQDMLGFDKASNTLEWLFNKSKKAIKDLARSKHSISEGAKSFASSSDCEDCEVVSGINETDTLNLQQGLDSNDNKSLMGNGGSDAVKERKLKR

SEQ ID NO: 1872 - protein, 301 aa, Oryza sativa Japonica Group
MDASRRPAAASSQSQRRSKRPRSSPTQHSPEQHKRPPRVWNPQDEVTILRALISYRAKNGALPGSSQDTGKLHNMIRGQLSVKASTTQLSDKVRRLKHKYNLILTRVTKSGRDPDLPTEHDREVYELSKKVWGTKSGGAGAGSGGGGGGGGGRVYENAEVVQSDEEQGSRDDSDEDMESGWDDRDHRNRRLKAIVVANGNGNAVTGGRSVHGNGSGKGDVADKGKDMYPYLWEAVEELSKEHPSGTAFRKAFGVLDGSRARAMEEKLNRFRLSEIRQQLRRMDLMKETIKMVLDALEGSDL

SEQ ID NO: 1873 - protein, 393 aa, Arabidopsis thaliana
MYYQNQHQGKNILSSSRMHITSERHPFLRGNSPGDSGLILSTDAKPRLKWTPDLHERFIEAVNQLGGADTTPKTIMKVMGIPGLTLYHLKSHLQKYRLSKNLNGQANNSFNKIGIMTMMEEKTPDADEIQSENLSIGPQPNKNSPIGEALQMQIEVQRRLHEQLEVQRHLQLRIEAQGKYLQSVLEKAQETLGRQNLGAAGIEAAKVQLSELVSKVSAEYPNSSFLEPKELQNLCSQQMQTNYPPDCSLESCLTSSEGTQKNSKMLENNRLGLRTYIGDSTSEQKEIMEEPLFQRMELTWTEGLRGNPYLSTMVSEAEQRISYSERSPGRLSIGVGLHGHKSQHQQGNNEDHKLETRNRKGMDSTTELDLNTHVENYCTTRTKQFDLNGFSWN

SEQ ID NO: 1874 - protein, 227 aa, Brassica oleracea
MELFPSQPDLYLKINRRREEQEEEDYKEQEEVQRRLLFGSKASDSDRKASDHLIHTLQFTSNNEPTKIDHNQEHMESLDQDLRSNFMVRPIRGIPLHQNQILDHYYYSPTPPFFFSEVNGQHTNPSYSYNLHHRHHRQAQPQAQRLTAKRGVRAPRMRWTTTLHAHFVHAVQLLGGATPKSVLELMDVQDLTLAHVKSHLQGVLSYVALLLRDVEEKVKYKEGIIRQ

SEQ ID NO: 1875 - protein, 212 aa, Oryza sativa Indica Group
MGFPVGYSELLLPRLLLQVLLLLGHLHRFLLWAFHAVGLGDLIDNPPGLAATEQDMMLQGRGGGMAEGWASSSALQHRRPEFRAIPPMAIEEALPVVRFDELVASAPAAVCGGGDCAVCLSGICGRDEVRRLSNCRHVFHRGCLDRWMAHEQRTCPLCRAPLIPDELLPAASGLPDPSDYDLSYYPSPLPLAPTPTLLRPHELLLNGLGGFQ

SEQ ID NO: 1876 - protein, 222 aa, Physalis peruviana
MVRQKIQIKKIDNLTARQVTFSKRRRGLFKKAQELSTLCDADIGLIVFSATGKLFEYSSSSMMQLIEKHKMQSERDNMDSVEQLQSSNLQSEKKTHAMLSREFVDKNRELRQLHGEELQGLGLEELMKLEKLVEGGISRVLKIKGDKYMREISSLKKKEAQLQEENSQLIHQSQARLNEGGQNVIEQGHSADSIANNLSLVNSHQDYDDSDTSLKLGLAYPY

SEQ ID NO: 1877 - protein, 197 aa, Arabidopsis thaliana
  misc_feature (165)..(165): Xaa can be any naturally occurring amino acid
MEKEGLGLEITELRLGLPGRDVAEKMMKKRAFTEMNMTSSGSNSDQCESGVVSSGGDAEKVNDSPAAKSQVVGWPPVCSYRKKNSCKEASTTKVGLGYVKVSMDGVPYLRKMDLGSSQGYDDLAFSLDKLFGFRGIGVALKDGDNCEYVTIYEDKDGDWMLAGDXPWGMFLESCKRLRIMKRSDATGFGLQPRGVDE

SEQ ID NO: 1878 - protein, 164 aa, Physcomitrella patens subsp. patens
SPGSFDLVEMDATEILAEHTHFCEICGKGFKRDANLRMHMRGHGDVYKTAAALARPDRGTQIPTSNASRRYSCPYVGCKRNKKHRKFQPLKTLLCVKNHYRRSHCPKVLNCQKCSTKKFSVVADLKTHEKHCGREKWLCSCGTTFSRKDKLVGHIGLFVGHAPA

SEQ ID NO: 1879 - protein, 222 aa, Physalis peruviana
MVRQKIQIKKIDNLTARQVTFSKRRRGLFKKAQELSTLCDADIGLIVFSATGKLFEYSSSSMMQLIEKHKMQSERANMDSLEQLQSSNLQSEKKTHAMLSREFVDKNRELRQLHGEELQGLGLEELMKLEKLVEGGISRVLKIKGDKYMREISSLKKKEAQLQEENSQLIQQSQARLNEEGQNVIEQGHSADSIANNLSLVNSHQDYNDSDTSLKLGLAYPY

SEQ ID NO: 1880 - protein, 319 aa, Arabidopsis thaliana
MSYRLLSVDKDELVTSPCLKERNYLGLSDCSSVDSSTIPNVVGKSNLNFKATELRLGLPESQSPERETDFGLLSPRTPDEKLLFPLLPSKDNGSATTGHKNVVSGNKRGFADTWDEFSGVKGSVRPGGGINMMLSPKVKDVSKSIQEERSHAKGGLNNAPAAKAQVVGWPPIRSYRKNTMASSTSKNTDEVDGKPGLGVLFVKVSMDGAPYLRKVDLRTYTSYQQLSSALEKMFSCFTLGQCGLHGAQGRERMSEIKLKDLLHGSEFVLTYEDKDGDWMLVGDVPWEIFTETCQKLKIMKGSDSIGLGAVEKSKNKERV

SEQ ID NO: 1881 - protein, 239 aa, Solanum macrocarpon
MAREKIKIKKIDNITARQVTFSKRRRGLFKKAEELSVLCDADVALIIFSATGKLFDFASTSMKDILGKYKLQSASLEKVEQPSLDLQLENSLNMRLNKEIADKTRELRQMRGEELEGLSLEELQQIEKKLEAGFNRVLEIKSTRIMGEITNLQRKGAELMEENKQLKQKMEIMKKGKLPLVTEMVMEDGQSSESIITSNNVCSSNSGPPPDQDDSSKIGGNAVEDDCSITSLKLGLPFS

SEQ ID NO: 1882 - protein, 117 aa, Brassica oleracea var. acephala
RNQRHYLGDDLQAMSPKELQNLEQQLDTALKHIRSRKNQLMYDSINELQRKEKAIQEQNSMLSKQIKERENVLRAQQEQWDEQNHGHNMPPPPPPQQHQIQHPYMLSHQPSPFLNMG

SEQ ID NO: 1883 - protein, 349 aa, Hordeum vulgare
MDRSSFGNLAAGGGGSSSSKSSPSFLQLQPLSTTTVAAGPGPMGGTYYGTPLALHQGAAAAGSSQSPYQFHHHKSSVGEISQAEAEAIKTKIMAHPQYTALLVAYLDCQKVGAPPDVLERLTAMAAKLDAHTPGRLHEARDPELDQFMEAYCNMLAKYREELTRPIEEAMEFLKRVEAQLDSITGGGHGSAPLSLAAGKYEGVGSSEDDMDASGRENEPPEIDPRAEDKDLKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGQFMADGMYRLGS

SEQ ID NO: 1884 - protein, 159 aa, Hordeum vulgare
SYEGGGSSEDEQETGDVGGLPEITSHCAEDKELKSHLLNKYSGYLSSLWKDLSKKKKKGKLPRDARQKLLHWWQLHYRWPYPSKAALAESTGLDAKQINNWFINQRKRHWKPTPPAMEYMPQQQNHHHPYGGASSSSPAPFRTTEGHYFAGGSVYPRGP

SEQ ID NO: 1885 - protein, 136 aa, Hordeum vulgare
GAGSSEDDLDASCVEEIDPSAEDKELKHQLLRKYGGYVGSLRQEFCKRRKKGKLPKEARQKLLHWWELHSKWPYPSETEKIALAESTGLDQKQINNWFINQRKRHWKPAPEDMTLLRDGRWRGRELPLCPAGPGDV

SEQ ID NO: 1886 - protein, 714 aa, Candida albicans SC5314
  misc_feature (695)..(695): Xaa can be any naturally occurring amino acid
MSKKNPGDPRVKKNAFVHKLYTMLHDPALSHLIWWTNRNGEQNTFALCPGKEFADCLTQYFKHGNVASFVRQLHMYGFHKVSDPLPITYPPNGNNNNNNNNKEVPPVWEFKHSSGRFKRGDETSLVYIKRRSSSNHTSGSTIYAEPIYNPLLTNPYNQPQFMYQDYSMGPPVEVQQFYNYQNQPLMYYQQPPGQVPPPPPPSLPPHQQPEMALQYHQYNNYQQPPPAPPAPPPQPGNVLFGYQQVAPPQQPGSTVQQIPANAPPTLDQTQPLSYTPQLEYQQQQYPQPPLPPPPPQLQLQTSPGIPKVNDNLSRPSPNEQHLQFRKIWPDENNEANSKPRNPSLMFDPLLRVNSEGSPKTQPNHSVSLLNNEVRSESSTSSSSTTVTSTALPPPSAIDRSVSLVGGSPFDLSSRMNNQQSFNRTPSISTPPTQNGRLPKISSPLIPSNTESQSPTMVTGTDNDVGVTSKGSTSIISVSKKPSVFSNSLQERLRPSMFEYHPIGNNLSKDVLTIPKISTNSNSGSRTTSQSSMSSASALSSKKSSLSSISSTHGNLSILNSTNYRSTSVGGSGSGPFSTSTSTSTTSPTLSSLLHHPQHEPQNSTIANGTSIRSSISSSQSISSPPLTTTTTTTTTDQRQLSNSPISRQQQQQPNNNTNKKVSVTSLLLPSHSQSQGYAQPLYKSSVIAEEENSTXSSGGGYRSKSDDDTDNMNK

SEQ ID NO: 1887 - protein, 364 aa, Zea mays
MVVKEFGREVVMSMDKVKRGGEALTAAGAGDEEKDDAVLPGFRFHPTDEELVTFYLRRKVARKPLSMEIIKEMDIYKHDPWDLPKASTAAGGEKEWYFFCLRGRKYRNSIRPNRVTGSGFWKATGIDRHIYPATANPVESVSVGLKKSLVYYRGSAGKGTKTDWMMHEFRLPPAAAASPTPTSMQEAEVWTICRIFKRNIAYKRQPQLPAWRQQQSSSNTGSFESDGGGGGDEYMNRCLPVPATATATAHQIGGMLNGGGVVSATRSSSSSFFRDRESVHGGQQFHFHEQWLSRFPAAPAVEQKPQLLDPSAMAIAFHQNDDQSVATATAAAASECCKDGYYWDEIARFMEVNDPTVLHDCRYA

SEQ ID NO: 1888 - protein, 433 aa, Physcomitrella patens subsp. patens
MPGPCFSWAKSISFKAKSISFKSDSGSDISHESRFGSFSSTPLRGDHPKSPSRSNGCSQGCTPSIANLKEMLQGNSTLLGSRSVSHPSTCESLPKDEVVVHKTKNADSLHRAPLKTKPTRSFLKQYSISNVQEATRTSKELVNTVAKSKDNLCFVKGCSECSMHCNSGEGGIVIRDTHHHDALSPKCVYPKCGEAFSKPEALEMHQVVRHAGMLPDNPCPETPVKVSELGRGNPSLNVIEIIFKTSWSVEAPCVRIERILKIDNTDRHISEFQSYRDAVKKSASDEGMQHERCLADGNELLRFYGSSFVCSLGTNGSTALCSMASCNVCSIIRWGFAVRNERGIFTTATSGKAHEIITAREKENWRGKHAMLVCRVIAGRICKTLDKASRFIDASCLPDGYDSVSPGMATNLDELTVFNPKAVLPCFLVVYSF

SEQ ID NO: 1889 - protein, 95 aa, Pisum sativum
MEGLHETGPPPFLTKTFDVVEDPSTDGIVSWSRARNSFVVWDLSKFSTAILPRYFKHSNFSSFVRQLNTYGFRKVDPDRWEFANEGFLAGQRILL

SEQ ID NO: 1890 - protein, 252 aa, Triticum aestivum
  misc_feature (17)..(17): Xaa can be any naturally occurring amino acid
  misc_feature (153)..(153): Xaa can be any naturally occurring amino acid
MKPSEPTSSTWFFLLIXPTGESGDPSQNASTVEANSVELPKVPHGSVGAVAGRRAIAQGNPDEIAAALCRYTAPEEVDTLPSTCGACGAACVTRFFATKIPYFREVIVMAASCDLCGYRNSELKPGGEIPAKGKKIMLHVQNVKDLSRDVIKXLERVHGFQLGDSTNEWKKKKWDDFQQRLSKLLSLQEPWTLIIDDALAASFVAPATDLIEDDSQLLIEDYERSWEQNEELGLNDMDTSSADIAYNMTSAE

SEQ ID NO: 1891 - protein, 602 aa, Rickettsia montanensis
MTKEIDINKLLAQENNALNTILSQVNELCEQNKQLQGLIEIQNETKALEKEYNRSLPWFKRFVNTVSNVKYIFIKSEEQLTNEAIKYNNKILKDIDNKIYNIAEKSVSLKQELQEEIEKNFKDLTKKDLSKDQRERLSEVFFSYKSKPERFSALHMTNPLQFINAEELEKQYNSLNATKQNIQNLISENSNVKELKEIQKQVAEIREEVPYTFFEKLNNIWQNVKNVFVNNSEQVLAKNKESNTRTIRKIDEQLYKTKHKFEELIENKERNINDIIAKLPDNEELQKIVSNLTNHMASTKEPILTNSSLAKPLENNITPPPPLPGNNIPSPPPPPPPLPGNNIPSPPPPPPPLPGNNIPSPPPPPPPLPGNNIPSPPPPPPPLSGNNIPSPPPPPPPLSGNNIPSPPPPPPPLPGNNIPSPPPPPPPLSQNNIPPPPPPPMAPVSAQTEKLSKPVEATTVKKPENQPRPSIDTSDLMREIAGPKKLRKVEETDVKVQDSRDLLLQSIRGEHKLKKVEFDPNTGKPVAHSHSKPVQNVNKLSGVASILARRVVMEMSDSSGSESDSGNWSDVGVNRNTKTLKTKRERRKILNNRNSQKPSFVK

SEQ ID NO: 1892 - protein, 93 aa, Saccharomyces cerevisiae
  misc_feature (1)..(1): Xaa can be any naturally occurring amino acid
XVTPREPKKRTTRKKKDPNAPKRALSAYMFFANENRDIVRSENPDITFGQVGKKLGEKWKALTPEEKQPYEAKAQADKKRYESEKELYNATLA

SEQ ID NO: 1893 - protein, 198 aa, Zea mays
MGHEGSCRCELCGAPAAVHCAADEAFLCAACDAKVHGANFLASRHRRTRLRLAAAGAPPPHDEAGYGSAASSCVSTADSAPRPRRGARAPAGSVRPEAVLEAWAKRMGLGAGGRRRVPPRVAVAAALWGEAAGRGGVGGHAQALRRLEAGAHVPARLVLAVAASLARARALLRRAAPDPVEGWDECAWAGPKSSPSRS

SEQ ID NO: 1894 - protein, 237 aa, Populus trichocarpa
MASILTSPRTVEEIFKDYSARRSALVRALTIEADEVYIQCDPEKENLCLYGHPTESWEVTLPAEEVPPELPEPALGINFARDGMSRKDWLSLVAVHSDCWLLSMAFYFGARLNRNDRKRLFSMINDLPTLFEIVTGRKPVEDKPSAESGSKSRNNTKRSIDGQARSNSKLSYVEDEDEHGDTICGSCAGNYNADEFWIGCDICERWYHGKCVKITPAKAESIKQYKCPSCSTKKSRH

SEQ ID NO: 1895 - protein, 242 aa, Picea sitchensis
MGRAPCCANGDRNKGVWTKEEDDRLIQYIQAHGEGCWRSLPKAAGLLRCGKSCRLRWINYLRPDLKRGSFSEDEDDLILKLHALLGNKWSLIAGRLPGRTDNEIKNYWNSHLKRKLISMGVDPLTHRPFQRNSRRDLSLPGNVSEPEIASSREIAEDFFHSPSGLCGDSEQVSDAASGSLARDEPSNLNLNLELSITWPSIHAAAKEEPILKSKPGEGDLIDEKGYLCRYEECPLGTRLLLR

SEQ ID NO: 1896 - protein, 199 aa, Theobroma cacao
QVKGSENPRSHYKCTYPNCPTKKKVERSLDGQITEIVYKGSHNHPKPQSTRRSSSHAACTNSEISDQSGGTLGNEQTDSFLVQEDTSGSIGEDEFDQASSLSNPGGDDNENEPDAKRWKGENENEGIIGSGSRTVREPRIVVQTTSDIDILDDGYRWRKYGQKVVKGNPNPRSYYKCTTIGCPVRKHVERASHDLRAVI

SEQ ID NO: 1897 - protein, 457 aa, Vitis vinifera
MEGREGASGAGGGAVTVVGSDAPSEYHVAARTENPSPVAGSSPAVTPAVAVPQPAPAPAPAPVPAAAVAMMPAKKKRGRPRKYGPDGTVTMALSPKPISSSAPGPPVIDFSVEKRGKIRPVGSASKSKMELENLGEWVACSVGANFTPHIITVNSGEDVTMKIISFSQQGPRAICILSANGVISSVTLRQPDSSGGTLTYEGRFEILSLSGSFMPSDSGGTRSRSGGMSVSLASPDGRVVGGGVAGLLVAASPVQVVVGSFLTGNQHEQKPKKQKIEPISAARPTAAVPISSLEMEEPFGGHGQRPSATPKPNLSSSTSFRGDNWSPLPSDSRNKATDINVSLPGVFVFLILNLIIAAILIESPSACLAFLAGVKEAKVEEKDIHGDVEDGASSDVDRENHNHGEDGHKEEDENGNKLEEDSDLERRIEEFIAKVNRRWREELLMEKLIMAMEYQPS

SEQ ID NO: 1898 - protein, 274 aa, Brassica napus
  misc_feature (23)..(23): Xaa can be any naturally occurring amino acid
  misc_feature (163)..(163): Xaa can be any naturally occurring amino acid
MATMLENSYGYDDGGTGERIQLXMVEGQGKAVPAPFLTKTYHLVEDPATDHVVSWGDDHTTFIVWRPPEFARDLLPNYFKHNNFSSFVRQLNTYGFRKIVPDRWEFANEFFRRGEKHLLCEIHRRKTSQMIPNQHSPFITHHPPPQIPFSGGASFFPLPPPQXDDHYWCESPSPRPRLVPTTLDPQVAVLTEDNERLRRTNTVLMSELAHMKKLYNDIIYFVQNHVKPVAPSNSFLQKQQQPPPLIDYYNSATVPNHSPPTSQSSITLLEDDTN

SEQ ID NO: 1899 - protein, 85 aa, Pennisetum alopecuroides
ECQKVGAPPEVSARLTAMAQELEARQRTALGGLGAALEPELDQFMEAYHEMLVKFREELTRPLQEAMEFMRRVESQLNSLSISGR

SEQ ID NO: 1900 - protein, 249 aa, Physalis peruviana
MAREKIKIKKIDNITARQVTFSKRRRGLFKKAEELSILCDADVALIIFSSTGKLFDFSSSSMKDILGKYKLQSANLDKVDQPFLDLQLENSLNVRLRKQVADKTRELRQMKGEELEGLSLEELQQIEKRLEAGFNRVLEIKGTRIMDEIANLQRKGAELMEENKKLKQKMEMMKLGKLPLLTDMDCMVMEEGQSSDSIITTNNVCSSNTGPPPEDDSSNASLKLGCNNGLAPVDDDCSITSLKLGLPLS

SEQ ID NO: 1901 - protein, 242 aa, Glycine max
MSEMVSALAQVMGTTNRNPYMPQSTSFPFSTSVVKDQPQPYPSQPPPDQEVAKKPHYRGVRQRPWGKWAAEIRDPKKAARVWLGTFETAEDAALAYDKAALKFKGTKAKLNFPERVHQDVPFMQQHQQRSSNRNVFPIHATSTTSSATGSVSSVDAVAPPSLSTHDQHGHQVFPNLYQYAQILSSDDAQLPYFTSHLFNQQQQQQQQQPFNSQFSSTFSSTSSYFYNQQQQYDQQGHDHSNH

SEQ ID NO: 1902 - protein, 247 aa, Physalis peruviana
MAREKIKIKKIDNITARQVTFSKRRRGLFKKAEELSILCDADVALIIFSSTGKLFDFSSSSMKDILGKYKLQSANLDKVDQPFLDLQLENSLNVRLRKQVADKTRELRQMKGEELEGLSLEELQQIEKRLEAGFNRVLEIKGTRIMDEIANLQRKGAELMEENKKLKQKMEMMKLGKLPLITEMECMVMEEGQSSDSIITTNNVCSSNTGPPPEDDSSNASLKLSCNNGLAPVDDDCSITSLKLGLS

SEQ ID NO: 1903 - protein, 334 aa, Arabidopsis thaliana
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGFHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 1904 - protein, 85 aa, Pennisetum alopecuroides
ECQKVGAPPEVSARLTAMAQELEARQRTALGGLGAASEPELDQFMEAYHEMLVKFREELTRPLQEAMEFMRRVESQLNSLSISGR

SEQ ID NO: 1905 - protein, 177 aa, Glycine max
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNVSTNNGRLPIPVHRPNGTTNAGTLPTTSTSMPQSQSQTVVVENPMSVDSSGKLVSNVVVGVTTDKK

SEQ ID NO: 1906 - protein, 432 aa, Brassica oleracea
MDGVTGGDSKSGEATTAPPLRNPHPATLLGTNALPPPFLSKTYDMVEDPASDAIVSWSPANNSFVVWDPPEFSRSLLPRYFKHNNFSSFVRQLNTYGFRKVDPDRWEFANEGFLRGQKHLLKTISRRKSTQGHGSSSSSNPQSHQGHMASLSSCVEVGKFGLEEEVEQLKRDKNVLMQELVKLRQQQQSTDSKLQSMVKSLQTMEQRQQQIMSFLAKAVQNPTFLSQFIQKQTDSGNMHVTEASKKRRLTEDAAAASDGQIVKYQPIRSDSTMSMMWNMMNTDEKFPFSPNRDSGVTFQEVLLPTTSGQSQAYAPISSASTSLMPMIPPMPQESISDSPTENYMNAEKDVSEAFISPSPFLDGGSVPNQLEGLPQDLDIDELMSNCDIFEEYLAQSPVFGDETTLESSDANGGHVDKLIEELGHLTSETKQL

SEQ ID NO: 1907 - protein, 235 aa, Solanum tuberosum
MAREKIKIKKIDNITARQVTFSKRRRGLFKKAEELSVLCDADVALIIFSATGKLFDFASTSMKDILGKYKLQSASLEKVDEPSLDLQLENSLNMRLSKQVADKTRELRQMRGEELEGLSLEELQQIEKRLEAGFNRVLEIKGTRIMDEITNLQRKGAELMEENKQLKHKMEIMKKGKFPLLTDMVMEEGQSSESIITTNNPDQDDSSNASLKLGGTTAVEDECSITSLKLGLPFS

SEQ ID NO: 1908 - protein, 213 aa, Urochloa maxima
SKRRNGLLKKAYELSLLCDAEVALIIFSGRGRLFEFSSSSCMYRTLERYRSSNYTTQEVKTPLDGEINYQDYLKLKTRVEFLQTTQRNILGEDLGPLSMKELEQLENQIEVSLKHIRTRKNQMLLDQLFDLKSKEQELQDLNKDLRKKLQETNAENVLHVSWEEGGHSGTSGNAMEPYQGFLQHQENDPSLQIGYHQQAYIDQLNEDMADPNE

SEQ ID NO: 1909 - protein, 520 aa, Triticum aestivum
MRKSSEISMKASSSMASDASGNTDPGQQGARFSSMDQSCFARPGQSIPGYPPFFGPQSSNFYLPDDSVAKACDPFEPNPPQNNPVADWDPQAMLSNLTFLEQKIKQVKDIVQSMGNRGSQDVGGSCELAAKQQLVTADLTSIIIQLISTAGSMLPSMKTPLLSSNPAVRQLNTPGSPMGFGSIVNQRPSTVREEMVPDITKTPDYEDLMNTLNPAHDEKDDLIKCPNPCVGEGPEPVPMEDHDVKESDDGGEAEHLPPGSYVVLQLEKEEILAPHTHFCVICGKGFKRDANLRMHMRGHGDEYKTPAALAKPMRDSVSDPTPVTRYSCPYVGCKRNKEHRKFQPLKTILCVKNHYKRSHCDKRYTCSRCNTKKFSVIADLKTHEKHCGRDKWLCSCGTTFSRKDKLFGHVALFQGHTPALPMDDIKATGASEQPQGSEAMDDMVGSTGYNFPGSTSDGIPNLDMKVADDTRGYFSPLNFDPCFGALDDFARPGFDISENPFSFLPSGPGSCSFGQLSGDS

SEQ ID NO: 1910 - protein, 260 aa, Solanum lycopersicum
MCGGAILADIIPPRDRRLSSTDLWPTDFWPISTQNVPLNPKRARPSTGGEQMKKRQRKNLYRGIRQRPWGKWAAEIRDPRKGVRVWLGTFNTAEEAARAYDREARKIRGKKAKVNFPNEDDDHYCYSHPEPPPLNIACDTTVTYNQESNNCYPFYSIENVEPVMEFASYNGIEDGGEEMVKNLNNRVVEEEEKTEDEVQILSDELMAYESLMKFYEIPYVDGQSVAATVNPAAETAVGGGSMELWSFDDVSRLQPSYNVV

SEQ ID NO: 1911 - protein, 149 aa, Hordeum vulgare
PSATMSEDEDEGPLMIMEAAPLDMSSNGHDMMGFGPLVPTDTERSLMERVRQELKIELKQGFKSRIGDVREEILRKRRAGKLPGDTTTILKQWWQEHAKWPYPTEDDKAKLVEETGLQLKQINNWFINQRKRNWHNNSQTSTLKSKRKR

SEQ ID NO: 1912 - protein, 292 aa, Malus x domestica
MSTNTKTLSSNYSGEDDSELRRGQWILEEDSLLIQYIERHGEGQWNLLAKRSGLRRTGKSCRLRWLNYLKPDVKRGNLSPEEQLLILDLHSKMGNRWSKIARYLPGRTDNEIKNYWRTRVHKQARHLNIDTKSREFQNMIRCYWMPRLKQKIGRETSISSAVLNQNPTISQPRENNTFQHFTATISPPPQILVQEEINMSGTMYNLDVEKQNTEADYCRSSFIFPSEPMDMSKTAQFPECPPFYCGDNNGYDMESFNLQESVSADSAPNFPGNSAGDCYVAENNWFDSDFFM

SEQ ID NO: 1913 - protein, 340 aa, Hordeum vulgare
  misc_feature (309)..(309): Xaa can be any naturally occurring amino acid
  misc_feature (312)..(313): Xaa can be any naturally occurring amino acid
MAYQYHHHQDHALGMDAAAAAAAGGNPGGGGFAPGLSAGGAWEGEKAAVEAHPLYERLLEAHVACLRVATPVDQLPRIDAQIAARAPPPMPPASALSGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRYNSRLKTPFSXARXXSLSLSLSPGWISFPLHSQKQNKKEQCR

SEQ ID NO: 1914 - protein, 261 aa, Arabidopsis thaliana
MSSMPNKFNPHCDDNNRGFSSIQMNQNSQMVHSRFITSDHTNHAIVPTNTLDAVQYDAQRVKRAMNPKTNIWNPIFSPPNTFDKQCEFLNPKPLNVIFPSQNSAYPQHLDMFSLSSKHNHDQRVLQDGRSMKKILKPTIFFEATTDYIESQENEKSNNDHNDGRTHSLPYEKYGPYTCPKCNGVFNTSQKFAAHMSSHYKNETSEEREQRIRAKNKRKFCKLNREINGEPQKTKQEDVANNSEKSDDKTFQHLVVVKEELV

SEQ ID NO: 1915 - protein, 647 aa, Zea mays
MMGGGLMMDQSVVFPGVHNFVDLLQQNGDKNLGFASLMPQTSSGDQCVMGEGDLVDPPPDSFPDAVEDDSDDDVEDIEELERRMWRDRMKLKRLRELQQSRGKDPMASGGGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKMHPGARPPASTGGIASAISFNTTSSEYDVDIVDECKGDEAGNQKTAVTDPTSFNLGAAILSDKFLMPTPMKEETADVEFIQKRNAPAPAEPELMLNNRVYTCNNVQCPHSDYSYGFLDRNARNSHQYTCKYNDPITQSAENKPLPAPPQPQAFQPAFSQANQAANNLDFSLPMDGQRSIAELMNMYDTNFMTSKTMSSSDSVTIMERPNAMPQRIQMDEGFFGQGNGVFDDVNSMMQQQQQQAPPVVQQQQQQQFFIRDDTPFMSQMGDITSTAEFRFGSGFNMSSTAAAADYPGAAQKNDGTNWFY

SEQ ID NO: 1916 - protein, 327 aa, Nicotiana tabacum
MMDELSKLHSAIACSSNNNHVVGVLEHITGQQQEGPINNSSVDNNLEKASLEMSDLIKAQIANHPLYPNLLSAYLQCRKVGTPQEMASILEEISKENHLISSCHNTEIGTDPELDDFMESYCAVLLKYKEELSKPFDEATTFLNNIESQLSSLCKENLTTTTTTTTSFNSNNNYLSDEAGGTSDEDLGCREMEAVDSTQESPANREGDNELKETLMRKYSGYLSSLRKEFLKKRKKGKLPKDARTALLDWWNTHYRWPYPTEEEKNRLSEITGLDPKQINNWFINQRKRHWRPSEDMKYALMEGVSSGSIAGSMYFDGAGGTGSIGT

SEQ ID NO: 1917 - protein, 369 aa, Oryza sativa Indica Group
MWEAVGGGDGTALLPWPGSAAAATTSGAAAPLYMPPAAAAAAPFAAGEQLPVEQPFYFDGGGGVAGHNHHPHHHQYGMEAPPPLTMMQMGGGGSSSSRMVVSGLLGTLQAELGRMTAKEIMDAKALAASRSHSEAERRRRQRINGHLARLRSLLPNTTKFRKIHAFQSNNVHIFIMTDKASLLAEVIEHVKELKRQTSAMMEDGAAGGEAAAAPVVLLPTEDDELEVDAAADEGGRLVARASLCCEDRADLIPGIARALAALRLRARRAEIATLGGRVRSVLLIAAVEEEDPDEAGNDDDGEHGYGVAASHRRHELVASIHEALRGVMNRKAASSDTSSSGAGGGGGSIKRQRMISAHDQQGSFNSSGW

SEQ ID NO: 1918 - protein, 446 aa, Arabidopsis thaliana
  misc_feature (90)..(90): Xaa can be any naturally occurring amino acid
  misc_feature (379)..(379): Xaa can be any naturally occurring amino acid
GKQWYQRRVRGKQWYQRRVRGKQWYQRRVRGKQWYQRRVRGSLSGDANCMEQLLLHCANAIESNDATLAQQIIWVLNNLASPDGDSTQLXRLAASFLRALISRTASKSPAFAFLSLAATASISQKTLHRFSVIELAEFVDLTPWHRFGFIAANAAILDAVEGYSSVHIVDLSLTHCMQIPTLIDSMANKLHKKPPPLLKLTVIASDAEFHPPPLLGISYEELGSKLVNFATTRNVAMEFRIISSSYSDGLSSLIEQLRIDPFVFNEALVVNCHMMLHYIPDEILTSNLRSVFLKELRDLNPTIVTLIDEDSDFTSTNFISRLRSLYNYMWIPYDTAEMFLTRGSEQRQWYEADISWKIDNVVAKEGAERVERLEPKSRXLERMREAKFTGVGFGETAMTEVKTMLEEHATGWGMKKDVDDDNDVERFVLTWKGHSVMFASAWAPPN

SEQ ID NO: 1919 - protein, 777 aa, Oryza sativa
  misc_feature (29)..(29): Xaa can be any naturally occurring amino acid
MESLLDLRRLLKKEKSAMNQKGDDLSMGXTTGPTRRSTKGNWTPEEDAILSRAVQTYNGKNWKKIAECFPDRTDVQCLHRWQKVLNPELVKGPWSKEEDEIIVQMVNKLGPKKWSTIAQALPGRIGKQCRERWYNHLNPGINKEAWTQEEEITLIHAHRMYGNKWAELTKFLPGRTDNSIKNHWNSSVKKKVNSYMSSGLLTQVSCLPLNEYSANCNSSPAMTQQNSEDSGCFAVREVENSSGCSQSSLAKVSCSQVHDTTVPLGCDLQVNANFDKNEAHDSQSSMGPQACYTSAEAVASALPAVHCHVSSSNLDPDQHLQEDFAQGLNLDMTIDEMPTVPSFADNQTVCSIENHERSLEPYDVAMEVPLSMLSSDSGAEQKLHFMSEADFNSPNCLKSELWQDISLQGLLSGPDAVEADSISRSNHQSDVYSSEADTHFLAPPYMPQTSNSSSVMGLADDQSPQMSVPPSLICSNAMTDDAPFDNRPGRKEMPLSQAEVVTQSSSSSGDAEMFANPGCSNDRHVPSSTMESIPECGDQQVTNAEEPEASLEKEPSLTQSVTAPDEQDKGALFYEPPRFPSLDVPFVSCDLVTSGDLQEFSPLGIRQLMHSTMNVCTPMRLWGSPTHDESTGVLLKSAAKSFICTPSILKKRHRDLLSPIPDKRIEKKYGTEKDRGVSDTSSTGIQTSCINATKDDALITTVLRIERSASSKSLEKKLVFSDENKENLGYTTEQTKDGQSAGNDEHMDEQTTGERSSATNVATNDDLSGNLVSTSSF

SEQ ID NO: 1920 - protein, 352 aa, Glycine max
MDGREGMAFPGGSAPYYMQHRGGGVGGSVPGTGTQSGGFQPPSGFRALSNVSPGSAFKVESQPQHASFSHGINTGSSPDGGSGVPSSGEPVKKKRGRPRKYGPDGSVSLMLSPMSATANSTPGSGTSSEKRPRGRPPGSGRKQQLATLGEWMNNSAGLAFSPHVITVGVGEDIVAKLLSFARQRPRAVCILTGTGTISSVTLRQPASTSISVTYEGRFQILCLSGSYLVAEEGGPHNRTGGMSVSLSSPDGHIIGGGVTRLVAASPVQVVACSFVYGGSKPKTKEVTTTTTTTKDSSSEPQSSDKLASPASAPPPNQNYTSSSPFPGIWPASSRPVEVKSAHPHTGIDLTRG

SEQ ID NO: 1921 - protein, 364 aa, Oryza sativa
MVTSKEFARDQAAMDQKIKSDVGEVVLAGDEEEDGDVVLPGFRFHPTDEELVTFYLRRKVARKSLSIEIIKEMDIYKHDPWDLPNASSGAVGGEKEWYFFCLRGRKYRNSIRPNRVTGSGFWKATGIDRPIYSAAVNSNSGESIGLKKSLVYYRGSAGKGTKTDWMMHEFRLPPAIAAADASPCMQEAEVWTICRIFKRSITYRKQQQQQAWRPPATVTVKAPPPGDSSSNTGSFESDGGGDEFMNCGLTPAISQQQQHGGRHQMMSTMSCNGGYFFNDGIHHSHSHHKLHSQWGSLQMAPPEPKPEPEQKPLSSPAMTIAFHQNDHGFPAAAADFYKDGYLEEIARMMEVADPSPTGFYDCRY

SEQ ID NO: 1922 - protein, 806 aa, Vitis vinifera
MDTPEKYQIATPISKYEDSPVFNYINSLSPIKPVKSIPTDQTFSSLSFASPSSVFTSPHINPQRESRFLRRQQFTDPSKPEFSRRDNDENTSEGVLDAVHQLDYLDPGSSDTGITIDPSNKDPKSDAGLPQSLKYDCTSPEDNRIPHNDIETETMPEVAIRPASHVHFVQGVSKERRQSFEIETELRGICQIGESKEAAGCDWGKLISDDTDQLIFDSSISKEHSEVQDHKTVDPGTYSFIATVLQLPHDEIDDLQKSQSMGSVDSYEQCETEETVTKSRDVGEIKETDQTPAVPSSTLLDKLVVSDSRAEVDDKKGKKCMQSSCKLGSQQQLSIRRRCLLYEMTGAHKKKLIYNSDSGSSASSQSDGKVSSDEKQFMPFKPGNIHPSSMLAGIGLHLNALATTAEDGNKVVKHEPLASERKPISMSRSIPSSNSMSLGQTPLNKSLTPDLLERDLVRFDSEVQATEDASQTSEFGVSEEFNHGSPKRKRRRSEQAAENEACKRCNCKKSKCLKLYCECFAAGLYCVEPCSCQDCFNKPVHEDTVLQTRKQIESRNPLAFAPKVIRSSDYVPEFGDESNKTPASARHKRGCNCKKSSCLKKYCECFQGGVGCSISCRCEGCKNTFGRKDGTEEAELDEEETEETCDKNSLDTSSQYDVVLRGEEEHSDLVPPVTPSSEISRPLVQLPFTFGGGKPPQSSLLSVGSSSQMYTSQKFGPSGFICRLPKFEKHLEMIPEDETPEILQGTLAGGVKSTSPNSKRVSPPHHKIGSTRAWRSGRKLILRSIPSFPSLNPCQESSDRSPGKTQ

SEQ ID NO: 1923 - protein, 194 aa, Triticum aestivum
  misc_feature (157)..(157): Xaa can be any naturally occurring amino acid
  misc_feature (171)..(171): Xaa can be any naturally occurring amino acid
MGRSPCCEKEHTNKGAWTKEEDQRLIAYIRANGEGCWRSLPKAAGLLRCGKSCRLRWMNYLRPDLKRGNFTDEEDELIIRLHSLLGNKWSLIAGQLPGRTDNEIKNYWNTHIKRKLPSRGIDPLTHRAINSDHAASNITISFETAQRDDKGAVFRRXAEPTKVAAAAAAIXHWTTSHHVATQMDWGKGSIKCPD

SEQ ID NO: 1924 - protein, 383 aa, Glycine max
KLTGGASSPASSSSLAIPTANPKRSTKDRHTKVDGRGRRIRMPATCAARVFQLTRELGHKSDGETIEWLLQQAEPAIIAATGTGTIPANFSTLNVSLRSSGSTLSAPPSKSAPHTFHGALALAHHPYDEAFQHPALLGFHPHHHQQQLLSADQIAEALPSAGGGDSGGNYLRKRYREDLFKDDNINNTQSQNDSGDADGDADGDGSSPKLPKEAGSGLLRPTNLLPATAMWASGPPGSTIWMLPVTAAAASSSSSSSSASSAASSESQMWAFPQSVSGFMPRFNLPVPGALEFQGARAGSLQLGPSMLMPPPPLPPQQQQQPSQHLGLAMSDSNLGMLAALNAYARAGLNINSDHHHHHHHHHHHQHQSQPSESGEDAPNSSQ

SEQ ID NO: 1925 - protein, 444 aa, Vitis vinifera
MTKVPGCGLPRGPGHRVKETRRCWDGGVGGDCERVKAIKCVSRFPSLQQQEVFEERERGFMSSGFRLLTGAPRKLWISSESLLLCMQTCPLHQRKIQRSPVSSMRLRSKRQFLMDQDMMNKKPNTKKPSMLEVSQPMRRVRVTYCDPDATDSSSEDEEYNGKKKQLLRSKRTVKELFVHGIPYESSAETSPHISNNGGKLSTKFDSKIQKTPRSSSIYKGVRRRKWGKYAAEIRDPIRGVRMWLGTYNTAEEAAKAYQTKKLEFDTILGSKKLKNKHSSPSSSAVTCSSRQKPSSSEETNGLFSHPSPSSVLEISRSASIGSGNSVKEDDNAMRNDKEEQPISSLTGPASSITEDNAMEEDKVPAASLLEEPLFFPPFNQELNLGFDDNSLFGNNFDEFFDDLDMEGLPMCGFEDGATNGLPNFDFELDKELAWVDETLNIACL

SEQ ID NO: 1926 - protein, 268 aa, Oryza sativa Japonica Group
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICSYPPVMMGERNDAAAAAAVAAQGQVQLRIGGLPPWMLSHLNA

SEQ ID NO: 1927 - protein, 85 aa, Pennisetum flaccidum
ECQKVGAPPEVSARLTAMAQELEARQRTALGGLSAATEPELDQFMEAYHEMLVKFREELTRPLQEAMEFMRRVESQLNSLSISGR

SEQ ID NO: 1928 - protein, 120 aa, Theobroma cacao
NPEFSSTLASHDDDNDDRATQGSISLCDDAANDDESESKRRKTESCLTEMNATSGALREPRVVVQIESDVDILDDGYRWRKYGQKVVKGNPNPRSYYKCTTPGCPVRKHVERASHNLKCV

SEQ ID NO: 1929 - protein, 487 aa, Oryza sativa Japonica Group
MASSGEEGRVVVDLRSAAESAGGGGGDEEAHAAPLHEIESLCMRCGDNGTTRLLMTMIPHFREVVLMAFECPHCGERNNEVQFAGQLQPKGCCYRLEVPRGQNEILNRQVVKSDSATIKIPELDFEIPPEAQRGSLSTVEGIIMRAVDELQALQDERKKVDPQKAEAIDKFLAKLRSLGLGEAAFTFVLDDPAGNSFIENQNAPSSDPLLSVRFYERMREQQAALGFLVEPSTEEPGDQPVNHASTVEGNSEVLQEPHGSVGAVAGRRAIAQGNPDEVAAALCRYSAPEECLVFDLWLEIPYFREVIVMATTCDMCGYRNSELKPGGEIPAKGKKITLRVQNGKDLTRDVIKSDSAGVKVPELELELASGTLGGIVTTVEGLIVKICEALQRVHGFHLGDSTLEWKKKKWEDFNDRLSKLLSLQEPWTLIIDDGLAASFVAPATDSLEDDNQLTIEEYVRSWEQNEELGLNDMDTSSADAAYNTTNP

SEQ ID NO: 1930 - protein, 85 aa, Pennisetum flaccidum
ECQKVGAPPEVSARLTAMAQELEARQRTALGGLGAATEPELDQFMEAYHEMLEKFREELTRPLQEAMEFMRRVESQLNSLSISGR

SEQ ID NO: 1931 - protein, 200 aa, Theobroma cacao
QVKGSEFPRSYYKCTHPNCEVKKLFERSHDGQITEIIYKGTHDHPKPQPSRRYSSGNIMPGQEERSDKVSSFTGRDGKGSSIYGQMAYSIEPNSTADLSPVTANDDNIDEVDDDDPFSKRRKMDGGVDITPVVKPIREPRVVVQTLSEVDILDDGYRWRKYGQKVVRGNPNPRSYYKCTNAGCPVRKHVERASHDPKAVI

SEQ ID NO: 1932 - protein, 364 aa, Arabidopsis thaliana
MTKKLDPPTAPSSDEDDVETSEDDSSSSEEDEPIKSLPATTAAAPAKSTAVSAATPAKSTSVSAAAPSKSTAVSAAADSDSGSESETDSDSESTDPPKSGSGKTIASKKKDDPSSSTATLALPAVKSGAKRAASEAATTSTKRVKKDEESVKKPALFQRLWSDDDEISMLQGMIDYHADTGKSPSADTNAFYEFQKKSISFEVSKSQFSDKVRSLRKKYRAKEGKDEPRFVKAHDKKAFELSKFIWGPKGIALDSNAKSNGVSKKSASKTKEKLDSVKQDLAFVGVSSTNGDDWFEKSSLARMIAGSGIDEYYVRQKWSSFTLETKKIVEEKFQLMQAKELEAMLDKSVRLTDLTSYFVDASKN

SEQ ID NO: 1933 - protein, 234 aa, Theobroma cacao
QVKGSEYPRSYYKCTHPNCPVKKKVERSFDGQIAEIVYKGEHNHSKPQPPKRNSSGTQGLGFTSDGTGQDTNNSLWSNNPNERNEGSEGRVENQNEVGLSAPSSYQGKAVLSYEHVTTGAVNAGVTSENSIGLSGECEERSKEGEDDEPRSKRRKSENQSSEVGTSGEGIQEPRVVVQSCTDSEIMGDGFRWRKYGQKVVKGNPYPRSYYRCTSLKCNVRKHVERASDDPRAFI

SEQ ID NO: 1934 - protein, 338 aa, Brassica oleracea
MGRSPCCDQDKGVKKGPWVPEEDDKLTAYIEKNGYGNWRSLPKLAGLNRCGKSCRLRWMNYLRPDIRRGEFSDEEESTIVRLHALLGNKWSKIASHLPGRTDNEIKNYWNTHMRKKMLQMGIDPITHEPRTNDLSPILDVSQILAAAIGNGQFGNSNLINNNTALEDLLKLQLIHKMLQIITPKAIPNITSFTTNSLNPKLDSVVNSFTTNSVNPKPEQAAIQLNANEPHDFINQSANEDFMMPPFENIWDGFEDNQLPGLVTVSQKNLNSGTGMMPGYYGDQLSEIPSNGSISVSPETSGLNYPGTTQHLTGSDVLEDWEKFLDDETSHSCWKSFLE

SEQ ID NO: 1935 - protein, 248 aa, Brassica napus
  misc_feature (140)..(140): Xaa can be any naturally occurring amino acid
EQAGNPEVPLTPEDGGEVAVSNKSKDDQDEDDPYTKRRRLDGTMEITPLVKPIREPRVVVQTLSEVDILDDGYRWRKYGQKVVRGNPNPRSYYKCTAPGCPVRKHVERASHDPKAVITTYEGKHNHDVPTSKSSSNLHDXRPRSTHASADTVSLNLGVGISSDGPDHTSNERQHQNQQQLINQTHPNGVGFRFVHAAPVASYYASLNGGLNQYAPRETQNETQNGDISALNHSSYPYPHNIGRIQSGP

SEQ ID NO: 1936 - protein, 157 aa, Triticum aestivum
  misc_feature (40)..(40): Xaa can be any naturally occurring amino acid
  misc_feature (46)..(46): Xaa can be any naturally occurring amino acid
  misc_feature (52)..(52): Xaa can be any naturally occurring amino acid
STHYHFSADVGSEASPVGLPGRVFIGKLPEWSPDVRLFTXYEYPRXNMLRDXDVHGTMGLPVFEKGSYSCLGVMELIMTRQKLNFTSEINDICRALQAVNLRSTEVSSTPRATKFNSASYKDALPEILEVLRAACVTHNLPLAQTWVTCAQQGKGGS

SEQ ID NO: 1937 - protein, 220 aa, Aspergillus oryzae
MSPSTLPQLDEHRIMQPPAESADGNIPFNISRQRRRSDSEYVRHRDLGAGAIRRNGVVEPDNAPSPAGRSWLIYVVGTNLSENHPAFATPSLFTDNPTYEDMILLSSLLGPVKPPVATQEDLTSAGGVYRVVEYSGSLVAEALDGAGAIQIPNGDRCLICLGDYEAAEELRQLTKCAHVFHRDCIDQWLTTGRNSCPLCRGQGVAETSNADRTPENTSSA

SEQ ID NO: 1938 - protein, 647 aa, Gossypium hirsutum
MRKEAEKSLDPQLWHACAGSMVQIPPVNSKVFYFPQGHAEHSLYPVDFSSSPPIPALLLCRVASVKFLADAETDEVYAKIMLVPLPNTEPDLENDAVFGGGSDNVEKPASFAKTLTQSDANNGGGFSVPRYCAETIFPRLDYTADPPVQTVIARDVHGEIWKFRHIYRGTPRRHLLTTGWSSFVNHKKLVAGDSIVFLRAENGELCVGIRRAKRGNDTGAESGLGNGNDVSPYGGFSGFLKEDESKITRKRSPRGKGKVRAEAVVEAVALAANGQPFEIVYYPRASTPEFCVKASAVRAAMRVPWCSLMRFKMAFETEDCSRISWFMGTVSSVHIADPLRWPNSPWRLLQVTWDEPDLLQNVERVSPWLVELVPNMLPVHLSPFSTVTPRKKLRLPKHLDFPLVEQFPMPPFSGHPLRSSNPLRCLSDNAPAGIQGARHAQFRLSSSDPHLNKLKSGLFPSGFQLFDPQARVPNGISMTKHTDSNDDNLSCLLTVGNSSPKKKSENGKRHQFLLFGQPILTEQQLSRSCSTGVKTALENEDKRKDYSNGSESALENQLSPEKSFTTRLLWQQDYQAPEPGSATGHCKVFLESEDVGRTLDLTVLGSYEELYMRLANMFGRERSEMLGHVLYRDATGAVKQTGDEPFR

SEQ ID NO: 1939 - protein, 730 aa, Oryza sativa Japonica Group
MVFQKRSSLEMESGGGSHVAEMPRVPKSARGKRSIRKKESQGQVMCAFDLLATVAGKLLDEGEGSLGNASSGTPAVDASPKDVRVKQEQCDEEAKHFKNEVMDQDSCNESALVSHIAFQRPVNHHGRKGEDPEGSHAVIEDPKAKSEALDKESSMISCTKAELGCNFAAIADRWSPESVESGAFTGDAAAIAMPATTSGFHKNAPDMYNLLDPMDVDVKPPPLVSSDSTGEMPLYGNKIRRSTSFPRVPKGGAGFTVDRDEDDDDKSSGCTHPSTATNRGFRPNCTAGHSRVKKLLACKHRKVAPARMHKGDLSYSGEHCEIPFTFSFFEEHCIDGTHIQTCLLYSYLSSLILLDVDRKPSFRNKKMYYTRQRTQRSTFKRRKMFDRHSAQVSEEYAKANTKFAARDSHAVSLEANKGTNSTAFQKSQESSDCHVKLRIKSFKVPELLIEIPETATVGSLKKTVLEAVNAILGGGLRVGVLHHGKKVRDDNKTLMQAGISHDEVLDNLGFSLEPNCAPHPSQLSPPEDNEFMETVDTTEPLARIAPADSSSKHGEVDASQELALAPLSANYQGSDHDFVHSPGGMSSPDKASTNSRAIVPVTPADSNAGAIVPANKAKRSPEQGQRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPPLAEALLLT

SEQ ID NO: 1940 - protein, 437 aa, Vitis vinifera
MNHPLLPDWNIEGDVPVTNQKKPMGQEHELVELLWRNGQVVLHSQTQRKSGLAPNESKQVQKHDQTMLRNGGSCGNWSNLIQDEESISWIQYPLDDSLDKEFCSNLFMELPPNDPVQPEKPVRHSEQEKSVPSSQQPIFKHLGSPEFPGNPMPPPKFQVPGSGSGNMAQGGDAKEGSVMTVGLSHCGSNQVVNEADLSRFSSSGGDRRQTETLEPTVTSSSGGGSGSSFGRTYKQSTDTNSHKRKGREAEESECQSEAAEHESAARNKASQRSGSTRRSRAAEVHNLSERRRRDRINEKMKALQELIPHSNKSDKASMLDEAIEYLKSLQLQLQLMWMGGGVAPMMFPGVQHYMARMGMGMCPPPLPSIHNPMHLPRVQLVDQSTSAVPPSNQPPICQTPVLNPVNYQNQMPNPNFPEQFAHYMGFHPMQTPSQVSC

SEQ ID NO: 1941 - protein, 245 aa, Lolium temulentum
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRSRKSQLMHESISELQKKERSLQEENKILQKELIEKQKAHTQQAQLEQTQPQTSSSSSSFMMGEATPATNRSNPPAAASDRAEDATGQPPARTVLPPWMVSHLNNG

SEQ ID NO: 1942 - protein, 98 aa, Zea mays
DRISWLLYSPVWLWISCRWRDVKLRAFDNAKHRTYVDLKDKWKTLVHTASISPQQRRGEPVPQELLDRVLAAQAYWSQQQAKLQPKTPPLLAEARLLT

SEQ ID NO: 1943 - protein, 206 aa, Brassica napus
MERNLVGYRFSPTGEEVINYYLKNKILDKPWLVNEAINEINICAHDPKFLPALSKLESKDLVWYFFTPREYHASEKKKGTKRTTPSGFWKATGKDRIIRDKRGHGVEIGIKKTLVYHHGKAANGVGTPWVMHEYHTTSLPLNQRNYVICQVMYKGADGDSWYGNNSNALSHSMVSDLNTVREIDTAPQVEQPRQDLYLSVDDWANP

SEQ ID NO: 1944 - protein, 227 aa, Brassica napus
  misc_feature (146)..(146): Xaa can be any naturally occurring amino acid
MDYSCIDDNTSNTSETLSMSKKTPSPPPPLPPAMRLYRMGSGGSSVVLDLENGVETESSRKLPSSRFKGVVPQPNGRWGAQIYEKHQRVWLGTFNEEEEAAASYDIAARRFRGRDAVTNFKSPASDAESAFLEAHSKAEIVDMLRXHTYADELRQSERKFLDGDGNGKKRRESKTTVTDENDGVLREVLFEKAVTPSDVGKLNRLVIPKQHAEKHFPLPVSVTPSPT

SEQ ID NO: 1945 - protein, 261 aa, Lolium temulentum
MGRGKVQLKRIENKINRQVTFSKRRNGLLKKAHEISVLCDAEVAVVVFSPKGKLYEYATDSSMDKILERYERYSYAEKALISAESESEGNWCHEYRKLKAKIETIQKCHKHLMGEDLECLNLKELQQLEQQLESSLKHIRSRKSHLMMESISELQKKERSLQEENKALQKELVERQKAARQQQQEQWDRQTQTQQAQNQPQAQTSSSSSSFMMRDQQAHAQQNICYPLVTMGGEAVAAAPGQQGQLRIGGLPPWMLSHLNA

SEQ ID NO: 1946 - protein, 325 aa, Picea sitchensis
MGSRSSSPYWCHACNRMLRLPAGDPTLCPTCGGGFVEEARDGDLISRTHPFEGFLMENRERSPGADLMTALLNQLSNRGINEGHDHVHDRMFYSPLLILRRGPMGGNGPMELILGSDTGIEPRTLPANIGDYFMGSGLEQLIEQLSQNDRCGPPPAPSAAVDAMPTIKINSRHLVNNSHCPVCKDRFEVGGEAREMPCKHIYHSDCILPWLAQHNSCPVCRHGLPGGVPGSSQARSSSRPSSAALYPTAPSTPGGQGSREHSRGSNSGDNQGRRSLLSYMWPFRSSTANQHSHRGQNSSNSNDNVGRRHPGWPFEEGNGPPWRFN

SEQ ID NO: 1947 - protein, 243 aa, Picea sitchensis
MLSGGYSTRSDTTPVNNGSANGPIGSAPPRINSIQNNNPGAVRPGWGTMPLRMNPYPPQPMPLPPPNVQGQLVCNGCRTLLVYPQGAPNVCCAVCNAVTAVPPPGTEMAQLICGHCRTLLMYVRGATSVQCSCCTTVNLAMEANQVAHVNCGNCFTTLVYPYGAPSVKCAVCHYVTSVGQISNMRMPLPAQRPPAAATTAPASSSALPTRSQTQTVVVENPMTVDERGKMVSNVAVGVTTEKL

SEQ ID NO: 1948 - protein, 275 aa, Gibberella moniliformis
MLEDPAHQDVARWGKDGDTFVVVENEKFTRSILPKHFKHSNMASFVRQLNKYDFHKVRQTNDSGSAANGANTLEFKHPNFRVGSKDDLDNIRRKAPAPRRTQATEDFTTSHHISVMTEQLTATQQQVQQLQELFTEVSQTNRLLVNEVLTLQKMLNAQKQSQHEMLNYLSPSNNRHQQSMHLNVGTSPLDGSDDSAPELRRARELLSSVTPDQIADRELERLQGVYGSPADSAVVIPQASMPMMHDPMNDINRYPVYPVGQTVGIDPFHSDHIHK

SEQ ID NO: 1949 - protein, 220 aa, Glycine max
MDSLEDSGCWDFLDYSFIDQAPPDFLWSNNNNSVSTEIDIPGDAVACQENTKKRGRTDSCFKAGSKACREKLRRERLNERFCDLSSVLEPGRPVRTDKPAILDDAIRVLSQLKTEAQELKKTNEKLLEEIKCLKAEKNELREEKLVLKADKERIEKQLKALPVAPAGFMAPPVAAAAAAYQAGVNKMAVYPNYGYIPMWQYLPQSVRDTSHDHELRPPAA

SEQ ID NO: 1950 - protein, 143 aa, Brassica napus
LLQHVMPPYGTPTHPYVTMYPPGGMYGHPSIPPGSYPYSPYAMPSPNGMTEASGNTTGGTEVEAKQSEMKEKLPIKRSRGGSLGSLNMITGKNSGASANGAYSKSGKSASDGSSEGSDANSQNVISLFHYTQYFSKNIMVCCG

SEQ ID NO: 1951 - protein, 644 aa, Oryza sativa Japonica Group
MATGVSVENINPKVILGPSSIAECIVIRGEVAIHAQVSWFSPSMFWKSISIYSFSANARREINRYLTFFFQHLQQQLQTQPGSLPFDEIVYCNIGNPQSLGQKPITFFREVLALCNHPNLLEREEIKSLFSTDAIARAKKILSMIPGRATGAYSHSQGIKGLRDEIAAGIASRDGFPANADDIFLTNGASPGVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEFTTQHPKAKEKQQPKMCGGAILAELIPSAPAARRVTAGHVWPGDANKAKKKGARADDFEAAFRDFDNDSDDEEMMVEEAEEEEATSEHKPFVFRAKKAAAAASSRRRKPAQYRGVRRRPWGKWAAEIRDPVKGIRVWLGTFTNAEAAALAYDDAARAIRGDRAKLNFPSATTPDTRKRGRATAAAAPAVKATPVINLVEEEDEEEVAAAMASIKYEPETSESSESNALPDFSWQGMSASDEFAVAAAALSLDSDDDLAKKRPRTEPEDTTDSGSGDDTDALFDALLFADQYNHFNGGAYESLDSLFSADAVQTTAAAAAADQGMGLWSFDDGCCLVDVEASLSF

SEQ ID NO: 1952 - protein, 242 aa, Brassica oleracea var. botrytis
MGRGRVQLKRIENKINRQVTFSKRRSGLLKKAHEISVLCDAEVALVVFSSKGKLFEYSTDSSMERILERYDRYLYSDKQLVGRDISQSENWVLEHAKLKARVEVLEKNKRNFMGEDLDSLSLKELQSLEHQLDAAIKSIRSRKNQAMFESISALQKKDKALQDHNNTLLKKIKEKEKEKNTGQQEGQLIQCSNNSSVLQPQYCVTSSRDGLVERVGGENGGTSSLIEPNSLLPAWMLRPTTK

SEQ ID NO: 1953 - protein, 395 aa, Coccidioides immitis RS
MADTINATMIYCHQCSQRWPRSEHGLSCPHCQSEFVEFIGEDEPLPRDSPSPPQEPINDHYGMPQNPFEQYLGENITRHQYRSGDGRVTYTSTTIRSPMRGMPFQRQPPQGMPGSDPLIPLFANLNALFQGIVASGNQPQPLPANEPPGIRSDFRGQQNHGEEHTTPVATVDDILRMLQQDFMERNARPRDPSGRIGGVPLVAPNPLEIVARIMGLGRHGDAVYSQEELDRVISELIEQTANSNAPGPASEEAIQALPKKQVDKTMLGHDGKAECSICMDSVQIEEEVTELPCKHWFHGNCISAWLVEHDTCPHCRRGIMETYRQNQSSQDSAASQSSSSPPGLGSRSNPYIVSDDPSESNGAHNNQQPPSGGGGNGRFAWWMRTHFGGGGNSGS

SEQ ID NO: 1954 - protein, 229 aa, Oryza sativa
  misc_feature (54)..(54): Xaa can be any naturally occurring amino acid
MSSASSMEALHAAVLKEEQQQHEVEEATVVTSSSATSGEEGGHLPQGWAKRKRXAPPPLSASAPPPAGAEFKCSVCGKSFSSYQALGGHKTSHRVKLPTPPAAPVLAPAPVAALLPSAEDREPATSSTAASSDGMTNRVHRCSICQKEFPTGQALGGHKRKHYDGGVGAGAGRIFNRAPGQSATRAFDLNLPAVPEFVWRPCSKGKKMWDEEEEVQSPLAFKKPRLLTA

SEQ ID NO: 1955 - protein, 292 aa, Brassica oleracea
MAGLDLGTAFGYVNHQLHRPDLHLHHSSASDDVTPGAGLGHFTADDDDNNHQGLDLASGGGSGSSGGGGGDGGGGGNVVGRRPRGRPPGSKNKPKPPVIITRESANTLRAHILEVTSGCDVFDCVATYARRRQRGICVLSGSGTVTNVTIRQPSAAGAVVTLQGTFEILSLSGSFLPPPAPPGATSLTIFVAGGQGQVVGGSVVGELTAAGPVIVIASSFTNVAYERLPLEEDEQQHLGGGGGSNGGGNLFPEVSAGGGGGLPFFNLPMNMQSNVQLPVEGWPGNSGGRGPF

SEQ ID NO: 1956 - protein, 115 aa, Brassica napus
VDHASARREKISERMKILQDLVPGCNKVIGKALVLDEIINYIQSLQRQVEFLSMKLEAVNSRMTPGIEVFPPKEFDQQTFENQGMQFGAQATREYSRGASPEWLHMQVGGGFERS

SEQ ID NO: 1957 - protein, 259 aa, Vitis vinifera
MARQKIQIKKIDNTAARQVTFSKRRRGLFKKAQELSTLCDAEIALIVFSAAGKLFEYSSSSVSQVIERHNQHPQTPEKPEPPSLELQLENSTCAALSKEIAQQTQRLRQMKGEELQGLKIEELIELEELLEAGLCSVVEEKAERIRTEISDLQRKGDLLREENERLRKEVENISEAPLLQQGHSSESITTNICSLSDPNQGLHNSDTSLKLGVEKLQSNWEGPYVVTKAEDLGAYHIQTLNKVSLLRPWNVTNLKQYYQ

SEQ ID NO: 1958 - protein, 193 aa, Brassica napus
  misc_feature (161)..(161): Xaa can be any naturally occurring amino acid
  misc_feature (170)..(170): Xaa can be any naturally occurring amino acid
  misc_feature (185)..(185): Xaa can be any naturally occurring amino acid
MVQNLISDESFSSTTMVMQEHCESLCDRASDELIISSTDAFCLKTRKPYTITKQREKWTEAEHEKFVEALKLYGRAWRRIEEHVGTKTAVQIRSHAQKFFTKVARDCGVTSEKSIEIPPPRPKRKPMHPYPRKLVIPDAKEMAYAGKLVPDEDSRSPTSVXSAHGSDGLXSIGSNSPNSSSADYXVHELSSHT

SEQ ID NO: 1959 - protein, 647 aa, Oryza sativa
MTDGHLFNNILLGGRAGSNPGQFKVYSGGLAWKRQGGGKTIEIEKSDLTSVTWMKVPRAYQLGVRTKDGLFYKFIGFREQDVSSLTNFMQKNMGLSPDEKQLSVSGQNWGGIDINVTLSIVGNMLTFMVGSKQAFEVSLADVSQTQMQGKTDVLLEFHVDDTTGGNEKDSLMDLSFHVPTSNTQFLGDENRTAAQVLWETIMGVADVDSSEEAVVTFEGIAILTPRGRYSVELHLSFLRLQGQANDFKIQYSSIVRLFLLPKSNNPHTFVVVTLDPPIRKGQTLYPHIVIQFETEAVVERNLALTKEVLAEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRSEYHNLFNFINGKHLKIMNLGDGQGATGGVTAVLRDTDDDAVDPHLERIKNQAGDEESDEEDEDFVADKDDSGSPTDDSGGEDSDASESGGEKEKLSKKEASSSKPPVKRKPKGRDEEGSDKRKPKKKKDPNAPKRAMTPFMYFSMAERGNMKNNNPDLPTTEIAKKLGEMWQKMTGEEKQPYIQQSQVDKKRYEKESAVYRGAAAMDVDSGSGGNESD

SEQ ID NO: 1960 - protein, 140 aa, Picea abies
  misc_feature (135)..(135): Xaa can be any naturally occurring amino acid
MAKSKPMKKVLDSYTIKGTDKVVKVGDCVVLRAEDAQKPPYIARVEKIEADGRGNHVKVRVRWYYRPEESIGGRRQFHGAKELFLSDHFDEQSADTIEGKCSVHTFKNYTKLDSVGSEDYFCRFEYNAATGGFTXDRVAV

SEQ ID NO: 1961 - protein, 358 aa, Oryza sativa Indica Group
MPTPAAAGEGPWPRRAADLGVAQSQRSPAGGKKSRRGPRSRSSQYRGVTFYRRTGRWESHIWDCGKQVYLGGFDTAHAAARAYDRAAIKFRGLDADINFNLNDYEDDLKQMRNWTKEEFVHILRRQSTGFARGSSKYRGVTLHKCGRWEARMGQLLGKKYIYLGLFDSEIEAARAYDRAAIRFNGREAVTNFDPSSYDGDVLPETDNEVVDGDIIDLNLRISQPNVHELKSDGTLTGFQLNCDSPEASSSVVTQPISPQWPVLPQGTSMSQHPHLYASPCPGFFVNLREVPMEKRPELGPQSFPTSWSWQMQGSPLPLLPTAASSGFSTGTVADAARAPSSRPHPFPGHHQFYFPPTT

SEQ ID NO: 1962 - protein, 85 aa, Pennisetum villosum
ECQKVGAPPEVSARLSAMAQELEARQRTALGGLSAATEPELDQFMEAYHEMLVKFREELTRPLQEAMEFMRRVESQLNSLSISGR

SEQ ID NO: 1963 - protein, 140 aa, Picea abies
MAKSKPMKKALDSYTIKGTDKVVKVGDCVVLRAEDAQKPPYIARVEKIEADGRGNHVKVRVRWYYRPEESIGGRRQFHGAKELFLSDHFDEQSADTIEGKCSVHTFKNYTKLDSVGSEDYFCRFEYNAATGGFTPDRVAV

SEQ ID NO: 1964 - protein, 245 aa, Zea mays
MGRGKVQLKRIENKINRQVTFSKRRSGLLKKAHEISVLCDAEVALIIFSTKGKLYEYSTDSCMDKILDRYERYSYAEKVLISVESETQGNWCHEYRKLKAKVETIQKCQKHLMGEDLETLNLKELQQLEQQLESSLKHIRTRKSQLMLESISELQRKEKSLQEENKVLQKELAEKQKAQRKQVQWGQTQQQTSSSSSCFMIREAAPTTNISIFPVAAGGRLVEGAAAQPQARVGLPPWMLSHLSS

SEQ ID NO: 1965 - protein, 142 aa, Vitis vinifera
MKMVQEEIRKGPWTEKEDFQLVCFVGLFGDRRWDFIAKVSGLNRTGKSCRLRWVNYLHPGLKRGKMTPHEERLVLELHSQWGNRWSRIARKLPGRTDNEIKNYWRTHMRKKAQERKRAISPSSPSSNCSSSAPHNPKEDPRH

SEQ ID NO: 1966 - protein, 222 aa, Hordeum vulgare subsp. vulgare
MDKHQLFDSSNVDTTFFAANGTAQGDTSKQRARRRRRRSARCGGGDGDGGEMDGGGDPKKRRLTDEQAEILELSFREDRKLETARKVYLAAELGLDPKQVAVWFQNRRARHKNKTLEEEFARLKHAHDAAILHKCHLENELLRLKERLGATEQEVRRLRSAAGSHGASVDGGHAAGAVGVCGGSPSSSFSTGTCQQQPGFSGADVLGRDDDLMMCVPEWFLA

SEQ ID NO: 1967 - protein, 897 aa, Lotus japonicus
MMDSPEPSKINRSSSASALNASVNTPSSESPQVQESPFFRFASNLSPMRPAKACHVAPSFLGLNSPPLVFKSPRVNCDRESRYLERPQGTHLSSVEMSQSYNGGNSLRVAPGDSNESNSQLPLPERFATDTQQDIGLRNDTNTQSCSFPTSVDEYLADPGDTDEMYSVNPDVEQSTYAVESEPSNLTRTKKVILKCNGNDDPGDKAEEPSPLSEESNEIHQERPVENPETEGDKRVVERVSQEHTKLESNLAADVSHNSLTQHAGNGPDHSDCAAQSMSDPLQDVKESKDCHEMVSTLHVRQENISQDGSEASLKYHGIRRRCLKFGEAASSALGSNMSNMKLNATSSQMHFVNPFKPVSSLYLQRGIPETGSKPAGIGLHLNSIINGMPPSCASTTGMRSSDVLQGMQSTSSISLNKVENMKKYVISSNMDRQPLVDNRNEIHETDASLAADYFSPSLKEPIALYPASGHDKRKLSPTDAGNSEGLDQHTPGKKKKKTSSTADGNGCKRCNCKKSKCLKLYCDCFAAGVFCLDPCSCQDCFNKPEYGEKVLETRQQIESRNPLAFAPKIVKSATNAPSNMEDVNLTTPSSARHTRGCNCKRSMCLKKYCECYQSNVGCSSGCRCEGCKNVYGKKEDYVAPDHALSKERVSSNVEKGSDSTMLNKPEMVASREDLFQKEFYDQHHLSPITPSLQCSDQGKDMFPSHRSLMLTDSCDSKSYENVQSPAPPCNSASCILQLTPLSNPDSTSGAPSIPAKPVGTSAPSSRVSHGCVRQLSGGSLRWRSSPVTPRNTNLGEAQHLQGLESDSRLFDIVEDETPAILKESSTPTKTVKANSPIQKRVSPPRVIGSSSSGGLRTGRKFILKSVPSFPPLTPCMDSKGNGNEDGNVDSGNGATK

SEQ ID NO: 1968 - protein, 89 aa, Picea sitchensis
MECTKQERRKGIPWTEEEHRLFLMGLAKHGKGDWRGISRNFVVSRTPTQVASHAQKYFIRLNSWNKENKRSNIRDIISPNPGAVSRSRL

SEQ ID NO: 1969 - protein, 305 aa, Arabidopsis thaliana
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSSSDDPPTSLSLSLPGADVSEESNRSHESTNINNTTSSRHNHNNTVSFMPFSGGFRGAIEEMGKSFPGNGGEFMAVLQEMIKAEVRSYMTEMQRNNGGGFVGGFIDNGMIPMSQIGVGRIE

SEQ ID NO: 1970 - protein, 446 aa, Arabidopsis thaliana
MDRRLLWVTDSGNVDALYALIHKDPYILQNIDVLPFVHTPLHEASSTGKTDLAMELMVLKPTFAKKLNSDGVSPLHLAVENHQVQLALELVKINPDLVLVAGRKGMTPLHLVVKKGDANLLTEFLLACPESIKDTNVNGETALHIAVMNDRYEELKVLTGWIHRLHKSDAASTEIHVLNKRDRDGNTILHLAAYKNNHKACSYPSLQFDIHRLMVVKELLKCISLNRDIQNKGGMTALDILRTNGSHMNIKTEKIIRHSGGKSGVSLSKVKTASVFLRSPITFVEYCSTTMTRYKNRMSDGTRNALLVITALIITATYQTAVQPQDKDEIYYTGNIMINVLFVWGFNTIAFCLAIALTFILLPVGKAYNWWYIFISVPLVCSYALSMFLKYIQFPILCMPLYLMMAFILGFLIYVFVLYVGWKRAKQEKVPEPKSELTFEGFTSMT

SEQ ID NO: 1971 - protein, 227 aa, Capsella rubella
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQPQPFDSRNYFQVAALQPNNHHYSSAGGRQ

SEQ ID NO: 1972 - protein, 226 aa, Capsella bursa-pastoris
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENEKNNPSISLMPGGSNYEQIMPPPQTQPQPFDSRNYFQVAALQPNNHHYSSAGRQ

SEQ ID NO: 1973 - protein, 272 aa, Pisum sativum
FVRQLNTYGFRKVDPDRWEFANEGFLAGQRILLRTIKRRRNVAQSPSMQRESGGACIELGEFGLEGEIERLRRDRSVLVAEIVKLRQQQNNSRDQISAMEARLLITEKKHQQMMAFLARALSNQSFIQQLANNKELKGVEMKRKRRLPASSSLENLQNDSVTMMTVPIESVVDYSSREQQEGLTAIESEIETLLSAYDNESRSEIKDPSANESNLSDWEELLNQKLVGGNPEDEVLIGDFSQIDAPVEDLVEKNDDWTVDLQNLVDEMDFEP

SEQ ID NO: 1974 - protein, 226 aa, Capsella bursa-pastoris
RGKTEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQIMPPPQTQPQQFDSRNYFQVAALQPNNHHYSSAGRQ

SEQ ID NO: 1975 - protein, 240 aa, Triticum aestivum
  misc_feature (117)..(117): Xaa can be any naturally occurring amino acid
  misc_feature (153)..(153): Xaa can be any naturally occurring amino acid
MAPVSLPPGFRFHPTDEELIIYYLKSKINGRQIELEIIPEVDLYKCEPWDLPEKSFLPSKDLEWYFFSPRDRKYPNGSRTNRATQAGYWKATGKDRKVNSQKRAVGMKKTLVYYRGXRAPHGSRTDWVMHEYRLDERECEIDNGLQDAYALCXRIFKKTAPGPKIMEHYGAAQYHGEPPQWTPSSVERSPTPCDGRGGGDDFESSSFSFPTGAPMTSGSMHGGWVPESNYRRHAFKRPAG

SEQ ID NO: 1976 - protein, 256 aa, Impatiens balsamina
MADLPSESMELLDISGQRKNGRGKIEIKRIENTTNRQVTFCKRRNGLLKKAYELSVLCDAEVALVVFSSRGRLYEYANNSVRGTIERYKKASSDTPNTAGSVAEANAQFYQQESSKLRQQIGNLQNSNRQILGESLSSMNLRDLKSLESRLERSISKIRSKKNELLFAEIDFMQKREVDLHNNNQFLRAKISESERAQQQQQHQQTQINLMPGGSNYELVQSQAQTSFDNRNFFQVTALQPDNQYSRDDQTPFQLV

SEQ ID NO: 1977 - protein, 237 aa, Triticum aestivum
MVTVREETRKGPRVRQEDMQLVCTVRLFGERRWDFIAKVSGLNRTGKSCRLRWVNYLHPGLKRGRMTPHEERLILELHARWGNRWSRIARKLPGRTDNEIKNYWRTHMRKKAQERKRNVSPSSSSSSVTYQSIQPQTPSIMGIGEQELHGGSSCITSILKGTPADMDGYLMDQIWMEIEAPSGVNFHDGKDNSYSSPSGPLLPSPMWDYYSPEAGWKMDEIKMAPQVSYSKGIGPSY

SEQ ID NO: 1978 - protein, 316 aa, Oryza sativa Indica Group
MEQEAAMVVFSCNSGSDGSSSTTDSKQEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLPTVDDDARVVVKLFGVDIAGDKTR

SEQ ID NO: 1979 - protein, 185 aa, Zea mays
GSERSWSERRACVAMDGAEDDGTEWMMHGAGGKGKGGGALDKNKKRFSDEQTKSLESMFATQAKLEPRQKLQLARELGLQPRQVAIWFQNKRARWKSKQLEREYSALRDDYHALLCSYESLKDEKRALLKQVRDQDDANKAHASCMPSIDLPCISRSFVRSRTALHAPHADLYICMLELRRSCIY

SEQ ID NO: 1980 - protein, 337 aa, Arabidopsis thaliana
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSEGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCYSISRT

SEQ ID NO: 1981 - protein, 369 aa, Oryza sativa Indica Group
MGVVSFSSTSSGASTATTESGGAVRMSPEPVVAVAAAAQQLPVVKGVDSADEVVTSKPAAAAVAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAVAATTTCAGDERPTTTTSGAEPRVVRLFGVDIAGGDCRKRERAVEMGQEAFLLKRQCVVHQRTPVLGALLL

SEQ ID NO: 1982 - protein, 202 aa, Solanum demissum
MTTSSSDAPCVDHNQKSKNQDKKQQEAKKPTTTKDRHTKVDGRGRRIRMPATCAARVFQLTRELGHKSDGETIEWLLQQAEPAVIAATGTASHQIGHIPATTLYMMTNNNNNTSHHDPNNCSMWASPSNNNIENSNIRGGLLNFMNFHQPILGTRGGGGGGTAAEGQWGMLTAAMNSYRQSGGHASGSSNQHNGGDDHQHHS

SEQ ID NO: 1983 - protein, 421 aa, Oryza sativa Japonica Group
MASAAAATGAALGARTARACDGCMRRRARWHCPADDAFLCQACDASVHSANPLARRHHRVRLPSASSSPASSPRSAAAPRAGSDDPDAPAWLHGLKRRPRTPRTKPGGGGKHDASAATVAAAAASAVPDLEAEESGIVGDTDHDVGEEDDEDLLYRVPVFDPMLAELYNPVAADDEEQQIEQKPAARVVPFSEPSPEFASGSVEADGLSGFDVPDMELASFAADMESLLMGVDEGFDDLGFLDDEKPHVKLDLDMDMDFASISPAPAPEREERKRKRPEMILKLDYEGVIDSWARDGASPWFHGERPRFDPSESWPDFPAGSRGGLGAAVTAVTGGEREARVSRYREKRRTRLFAKKIRYEVRKLNAEKRPRMKGRFVKRAAALPPLPLPRHQHPPPPPPRALPPVPMMLAPRGAHGRYRF

SEQ ID NO: 1984 - protein, 267 aa, Vitis vinifera
MARSPCCDKMGLKKGPWTPEEDKILVAHVQKHGHGNWRALPKQAGLLRCGKSCRLRWVNYLRPDIKRGNFSREEEDAIIDLHEKLGNRWSAIAARLPGRTDNEIKNVWHTNLKKRLKKKLATPNSKGHSTAAASKCDSGSACQSEPVNLNFPGKISPQPSSSEFSSITDSPIRNMEIHMNTGIKDEQMDSLESFPEIHESFWSDALSSDNSSMPTAFHTVNDESQLQFPLSPADALEVGYGHSSRIDDGMEFWYDVFIRAGGLQELN

SEQ ID NO: 1985 - protein, 543 aa, Physcomitrella patens subsp. patens
MPGSDIYASSSSPLKRKSLKMVPGQSLKREYSSSSSDDEGFNRNIKTKQCPKRVRVICTDPDATDSSSDEEDNFRSLRNSQRRLVQEIHMSNEFGAADELSSDSELDEPEVPSYHSVFIAKAMQCSVSYASPVDSESMLASSSFYDKPWQSKKKAPKATEKVTKLATAVERPVTAVNTPKSSVAPSQATRSVSMSTSKPRVGSKPQAKASSFSAITDGKPHKYRGVRQRPWGKWAAEIRDPSKGVRLWLGTYDTAEQAAQAYDRAAREIRGPQAHTNFSSDAEVEQYTSTTSGSNVSQKKSAKKEEPLKESAVVREPATKRQASTKNSVSKPMCSVQVERIIAGDVEEQCVSRGEDEDMEMFGSCDTIEEDIMSEDILFDNLNEDCGYLMCSPSSLSLDESEGSPCSSLTACEPSSSDVDASVKSEADSFSTPEYMTPKQVAAVTESFFASSSENSSDSESDLSDSLNETNCHKEVESCCDLGEVFLSDDFLFDFPAGDVTNTEGLDFAAGLEFLEGDIGDLAFGSDQNESLEWLNAADILVT

SEQ ID NO: 1986 - protein, 390 aa, Oryza sativa Japonica Group
MAPKRPAEEADAAAAAAAAAGGSASEGSDAEASAEAARGHGSSPSPSKVNSDSEDSALPLASDAYADQAAAAGAGAGADSDDGNTSPLPPPRPSRAEAAAIKPISSRPMDPPPRRSAGGSEPRAKRPRSAAVASSAEHSKRPSRVWSQADELVILRGLITYRTKRGVLPGSTQDIGKLHSYIRGQLSAKVSTTQLSDKVRRLKQKYQMLATRAKTGKEVFPTPHDHNIYQLAKKVWGTMSTAGEGGGSGYDNADAGESEEEQYGRESDDDMESGRDNRHRKNQRSVPVTMANGNGTGIGAVNAIVRGRSEFEKGKDVYPYLWETVEELSSQHPTGAVFKKAFELLEGSKAQVMEEKLRKFRLTEMRQQLRRMDLMKDTLSMVLDALEMAD

SEQ ID NO: 1987 - protein, 173 aa, Physcomitrella patens subsp. patens
METKQDCNIELPPGFRFHPTDDELVSFYLTRKVKNPHFAVKSIPNVSLNKCEPWDLPEKAKVGEKEWYFFSLRDRKYPTGIRTNRATEKGYWKATGKDRDVMNYSTHLLVGMKKTLVFYLGRAPKGAKTNWIMHEYRLENDLSNHLSNHESHQSKNHEWVVCRVFQKTVGNKK

SEQ ID NO: 1988 - protein, 319 aa, Oryza sativa Japonica Group
MMASCRRGGGGDVDRIKGPWSPEEDEALQRLVGRHGARNWSLISKSIPGRSGKSCRLRWCNQLSPQVEHRPFTPEEDDTILRAHARFGNKWATIARLLAGRTDNAIKNHWNSTLKRKHHSSLLADDLRPLKRTTSDGHPTLSSAAAPGSPSGSDLSDSSHHSLPSQMPSSPPHLLLPQHVYRPVARAGGVVVPPPPPPPPPATSLSLSLSLPGLDHPHPDPSTPSEPAVQLQPPPPSQMPPPTPSCVRQEPPQMPFQLQPPPPPRPSAPFSAEFLAMMQEMIRIEVRNYMSGSAAVDPRSSPDNGVRAASRIMGMAKIE

SEQ ID NO: 1989 - protein, 259 aa, Nicotiana tabacum
MAPKQQGGAVAVTAAVGKVNGISKEVHYRGVRKRPWGRYAAEIRDPGKKSRVWLGTFDTAEEAAKAYDAAAREFRGAKAKTNFPPPDEENLKIAQNNLGVKINKNINDDNNRSPSQSSTVESSSRDGLSPAVMVDSSPLDLSLGVKFPFQNHQFRTSPISGGFSGCGFTGATPAVNHHMYYLEALARAGVINLEKHQQRKTVDFLGGNGGHGGSSGGSGSGTQSEFDSSSVIDFMRNDVKPPTRTTFNLDLNFPPPEKV

SEQ ID NO: 1990 - protein, 226 aa, Capsella bursa-pastoris
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQIMPPPQTQPQQFDSRNYFQVAALQPNNHHYSSAGRQ

SEQ ID NO: 1991 - protein, 219 aa, Capsella bursa-pastoris
MNSSFSAFSEMFGSEYESPVSSGGGDYCPTLATSCPKKPAGRKKFRETRHPVYRGVRRRNSGKWVCEVREPNKKSRIWLGTFPTADMAARAHDVAAIALRGRSACLNFADSAWRLRIPESTGAKEIQKAAAEAALAFQDEMMMSDTTTTDHGFDMEETFVEAIVTAEQSASLYIDEEDMFGMPSLMASMAEGMLLPLPSVQWNHNYDIDGDDDVSLWSY

SEQ ID NO: 1992 - protein, 251 aa, Vitis amurensis
MDSDHEEFSASSSSSSSRTNPNSSDSLLPLQCIGHKRKAGRKKFRETRHPIYRGVRQRNGNKWVCEVREPLKKSRIWLGTFPTPEMAARAHDVAALALRGRFATLNFPDSAWRLPRPKSSSAEDIQVAALEATKAFNPTAPPSSSLASALDNMSGVADSKKVLETSPNVESPKLKSQRMVLEVSPVDTKRSEKVGDGSTTVFMDEEAMFNMQGLINSMAVGLLLTPPAMCKGFSWDDATDSHIDLSLWNDD

SEQ ID NO: 1993 - protein, 224 aa, Camelina sativa
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETLGSMSPKELRNLEGRLERSITRIRSKKNELLFSEIDYVQKRESDLHNDNQLLRAKIAENERNHPSISLMPGGSNYEQLMPPPQTQPFDSRNYFQVAALQPNNHHYSSAGRQ

SEQ ID NO: 1994 - protein, 244 aa, Nicotiana tabacum
MRRGRATAAAKQAAEASPAAGSGGLKDIRFRGVRKRQWGRFAAEIRDPWKKLGWLGTFDSAEEAAKAYDAAARTLRGPKAKTNFPLPPYSHFNQTINPNGPFIDPRLYSQENHPIVIQRPTSSSMSSTVESFSGPRPPPRQQTAVLPSRKHPRSPPVVPDDCRSDCDSSLLLLKMAIVIMIMKMIISFHQLFGNHCLSISTFLHLWMLILMIFTAQHYVFDGIWFRNLDLLIIRKSPIWFPFFI

SEQ ID NO: 1995 - protein, 253 aa, Vitis amurensis
MDLDRESSASSSSSTSSPSRANPVSSDSRCPSRCISHKRKTGRKKLRKTRHPIYRGVRQRNENKWVSEVREPSKKSRIWLGTFPTPEMAARAHDVAALALRGHFASLNFPDSAWRLPRARSSSAGDVQFAAIQAAKAFQQPPSSSSSTPFVMDNMSAGSRKILETSSIVDTPQLKSQKKVEGVSSVDSKSWEKAGDGFPTAFVDEEAVFNMPGLIDSMAEGLLLTPPAMCKGFSWDDAVSHIDLSLWIHDFLP

SEQ ID NO: 1996 - protein, 742 aa, Triticum aestivum
  misc_feature (60)..(60): Xaa can be any naturally occurring amino acid
NKFVQKSRLPPVRNSRDIVDPRVRLKAEADTDEVYAQVMLMPEPEQSDATTTEKSSPATXGTTPARPAVRSFCKTLTASDTSTHGGFSVLRRHADECLPPLDMTQSPPTQELVAKDLHGMEWRFRHIFRGQPRRHLLQSGWSVFVSSKRLVAGDAFIFLRGESGELRVGVRRAMRQLSNIASSVISSHSMHLGVLATAWHAINTKTMFTVYYKPRTSRSEFIIPYDKYMDSVKNIYSIGTRFKMRFEGEEAPEQRFTGTIVGSENLDQLWPESNWRSLKVRWDEPSTIPRPDRVSPWKIEPASSPPVNPLPLSRVKRPRPNVPPVSPESSVLTKEVAAKIDMDSAQAQQRNQNNMVLQGQEHMTLRTNNLTASNDSDATVQKPMMWSPSPNIGKNHASAFQQRPSMDNWMQLGRCDASSGAQSFGDSQGFFMQTFDEAPNRHGSFKNQFQDHSSARHFSDPYTKMQTEANEFHFWNSQSTVYGNPRDQSQGFRFEEHPSNWLRQQQFSPVEQPRVIRPHASIAPVDLEKAREGSGFKIFGFKVDTTSTPSNHLSSSMAAIHEPVLQIQASASLTQLQHTHADCIPELSVSTAGTTENEKSIQQAPHSSKDVQSKSHGASTRSCTKVHKQGVALGRSVDLSKFGDYDELTAELDRMFEFDGELMSSNKDWQIVYTDPEGDMMLVGDDPWEEFCNIVRKIFIYTKEEVQKMNSKSSAPRKEEGSGDADGANEKAHLATSSHLDN

SEQ ID NO: 1997 - protein, 228 aa, Lepidium squamatum
RGKIEIKRIENTTNRQVTFCKRRNGLLKKAYELSVLCDAEVALVVFSSRGRLYEYSNNSVKGTIERYKKAISDNTNTGSVAEINAQYYQQESAKLRQQIVSIQNSNRQLMGETIGSMSPKELRNLEGRLERSITRIRSKKNELLFAEIDYMQKREVDLHNDNQLLRAKIAENERNNPSISLMPGGSNYEQIMPPPQTQPQPQQFDSRNYFQVAALQPNNHHYSSAGRQ

SEQ ID NO: 1998 - protein, 281 aa, Arabidopsis thaliana
MATPNEVSALFLIKKYLLDELSPLPTTATTNRWMNDFTSFHQTGFEFSEFETKPEIIDLVTPKPEISDFEVKSEISIESNDSFTFQSNPPRVTVQSNRKPPLKIAPPNRTKWIQFATGNPKPELPEPVVAAEEKRHYRGVRMRPWGKFAAEIRDPTRRGTRVWLGTFETAIEAARAYDKEAFRLRGSKAILNFPLEVDKWNPRAEDGRGLYKRKRDSEEEEVKVVKKVLKKEESYAVSDGENVESGLTAIDDWDLTEFLSMPLLSPLSPHPPFGYPQLTVV

SEQ ID NO: 1999 - protein, 327 aa, Solanum lycopersicum
MCGGSIISDYIDPSRTSRRLTAEFLWGRFDLGKKQKNPNNYHSKAKHLRSEVVDDFEADFQDFKELSDDEDVQVDVKPFAFSASKHSTGSKSLKTVDSDKDAAADKSSKRKRKNQYRGIRQRPWGKWAAEIRDPRKGVRVWLGTFNTAEEAAKAYDIEARRIRGKKAKVNFPDEAPAPASRHTVKVNPQKVLPEESLYSLQSDSAIMNSVEDDHYDSFGFFEEKPMTKQYGYENGSSASADTGFGSFVPSAGGDIYFNSDVGSNSFECSDFGWGEPCSRTPEISSVLSAAIECNEAQFVEDANSQKKLKSCTNNPVADDGNPRYYGT

SEQ ID NO: 2000 - protein, 230 aa, Lepidium squamatum
RGKIEIKRIENTTNRQVTFCKRRNGLLKKAYELSVLCDAEVALVVFSSRGRLYEYSNNSVKGTIERYKKAISDNTNTGSVAEINAQYYQQESAKLRQQIVSIQNSNRQLMGETIGSMSPKELRNLEGRLERSITRIRSKKNELLFAEIDYMQKREVDLHNDNQLLRAKIAENERNNPSISLMPGGSNYEQIMPPPQTQPQPQSQSFDSRNYFQVAALQPNNHHYSSADRQ

SEQ ID NO: 2001 - protein, 239 aa, Vitis amurensis
MESERDQSSPSSSSSSSQTKCSISSSPVHKRKAGRKKFRETRHPVYRGVRQRNGNRWVCEVRDPKNKSRIWLGTFPTPEMAARAHDVAALAFRGDFAALNFPDSTSRLPRAKSSSARDIQVAALAAAMAFRPAAPSSSSSYISHVTACSEELETSCSEDSPQLESRKKVVGVTLEDSESSQSAPHGSSTVFMDEEALFNMPGLINSMAEGLLLAPPTMLGGFSWDDTTSYTDLSLWNDD

SEQ ID NO: 2002 - protein, 226 aa, Lepidium phlebopetalum
RGKIEIKRIENTTNRQVTFCKRRNGLLKKAYELSVLCDAEVALIVFSSRGRLYEYSNNSVKGTIERYKKTKSDNSNTGSVAEINAQYYQQESVKLRQHIVSIQNSNRQLMGETIGSMSAKELKNLEGRLERSIARIRSKKNELLFAEIDYMQKREVDLHNDNQLLRAKIAENERNNPSISLMPGGSNYEQIMPPPQTQTQPFDSRNYFQVAALQPNNHHYSSAGRQ

SEQ ID NO: 2003 - protein, 362 aa, Glycine max
MDGGSVTDETTTTSNSLSVPANLSPPPLSLVGSGATAVVYPDGCCVSGEAESRKLPSSKYKGVVPQPNGRWGAQIYEKHQRVWLGTFNEEDEAARAYDIAAHRFRGRDAVTNFKPLAGADDAEAEFLSTHSKSEIVDMLRKHTYDNELQQSTRGGRRRRDAETASSGAFDAKAREQLFEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAVQFFKSTGLDRQLYIDCKARSGKVNNNAAGLFIPVGPVVEPVQMVRLFGVDLLKLPVPGSDGIGVGCDGKRKEMELFAFECSKKLKVIGAL

SEQ ID NO: 2004 - protein, 346 aa, Oryza sativa Indica Group
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRSRFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 2005 - protein, 345 aa, Arabidopsis thaliana
MEELKVEMEEETVTFTGSVAASSSVGSSSSPRPMEGLNETGPPPFLTKTYEMVEDPATDTVVSWSNGRNSFVVWDSHKFSTTLLPRYFKHSNFSSFIRQLNTYGFRKIDPDRWEFANEGFLAGQKHLLKNIKRRRNMGLQNVNQQGSGMSCVEVGQYGFDGEVERLKRDHGVLVAEVVRLRQQQHSSKSQVAAMEQRLLVTEKRQQQMMTFLAKALNNPNFVQQFAVMSKEKKSLFGLDVGRKRRLTSTPSLGTMEENLLHDQEFDRMKDDMEMLFAAAIDDEANNSMPTKEEQCLEAMNVMMRDGNLEAALDVKVEDLVGSPLDWDSQDLHDMVDQMGFLGSEP

SEQ ID NO: 2006 - protein, 197 aa, Glycine max
  misc_feature (75)..(75): Xaa can be any naturally occurring amino acid
  misc_feature (187)..(187): Xaa can be any naturally occurring amino acid
  misc_feature (189)..(189): Xaa can be any naturally occurring amino acid
MVQQEVRKGPWTEQEDFKLVSFVGLFGDRRWDFIAKVSGLKVAGESKIGIRQKKSNAYLGIMLQKNIDYGRRSLXPPHFVVGLNRTGKSCRLRWVNYLHPGLKRGKMTPQEERLVLELHSKWGNRWSRIARKLPGRTDNEIKNYWRTLMRKKAQEKKRGEAASSSPTPSSVDSSISSNNHAVDPHAXKXAGEESFYD

SEQ ID NO: 2007 - protein, 370 aa, Zea mays
QQQMYHQQQLHTHNQHLSSSRPGLPPEKQFLLHGAGGGGGGGDAGLVLSTDAKPRLKWTPELHERFVEAVHQLGGPDKATPKTIMRLMGIPGLTLYHLKSHLQKYRLSKNLQAQAHTASAKNALVGCRTGADNALCQGSASPPPPPPPPHLNLEPPQINRSMHISEALQMQIEVQRRLHEQLEVQRHLQLRIEAQGKYLQSVLEKAQEALAKQSGGADETTTTTQQQQQLLLPDLISRATATRRGNVQQEHLHQQHHLGGDGSVDSCLTACEGSRCQRERDQDLLSIGLSSAPPPTPTPSRGYNDRGGGGSASCEEFLQFLDEPSRRGAGGGGSSDEQQELDLSISGGRSNPRPRGSQSQRIDLNGSSWN

SEQ ID NO: 2008 - protein, 459 aa, Ipomoea nil
MFDLNLSAVEAIGDRGVAASEKVLELSGTSNSSVVNAETSSTAGDDEYSCSDGYAFEILRREEDGKEYGESENRGGFETMELFPLSGGEAALFNQQQQQWLDLSANYGIVADPRIMILPPQRPQVKKSRRGPRSRSSQYRGVTFYRRTGRWESHIWDCGKQVYLGFDTAHAAARAYDRAAIKFRGLDADINFNVTDYEEDLQQMKNLTKEEFVHILRRQSTGFSRGSSKYRGVTLHKCGRWEARMGQFLGKKYIYLGLFDSEIEAARAYDKAAIKLSGREAVTNFELSAYEQELTSEVDTGGGSQDLDLHLGIAPTSFVDGMGTLQLQSGLASPKHWGVGTSASNTVESELLPHGFELLSEHPPICNGVNTQFFPIYKGTAIGKGMEIDSSPNWAQAYGGTPPATLFSTAASSGFANATFTSSPAAPRLPHFSSGMLPYHHSSPPIPTMNSTAHFCCRS

SEQ ID NO: 2009 - protein, 260 aa, Zea mays
MKVQCDVCTAEAASVFCCADEAALCDACDRRVHRANKLAGKHRRFSLLHPGSSSSSSAAHKPPLCDICQERRGFLFCKEDRAILCRECDAPVHSASDMTRRHSRFLLTGVRLSSAPVDSAGPSEEEEQENSRGPCNDESCSSGSGAGGATTATASDGSSISEYLTKTLPGWHVEDFLIDDASAGDVGACSDGLYQVGSVLSSQPGVLQEAYLPWTEREQVQTDVADERASWERWVPQMHAEFGGGGKRPRASPSPPCSYW

SEQ ID NO: 2010 - protein, 277 aa, Glycine max
  misc_feature (153)..(153): Xaa can be any naturally occurring amino acid
MANALEVSALNRIKLHLLGELSPLTQFQEPNTTSLCSQSSTSDSFTTVDQIFSEFLDFPTTTTSSTEQNQFSAFEFEPKPEIIEPQLEFSFPTTRCKSSRRPSLQISLPKKTEWIQFGEPEVTETVSQSNPNAEEKKHYRGVRQRPWGKFAAXEIRDPNKRGSRVWLGTFDTAIEAAKAYDRAAFRLRGSKAILNFPLEAGADDRKRQREEKVEPVLEVVKREKIGESDVSLIKNNPLTPSSWLGFWGSDANGIFTVPPLSPLSPHPALGFPQLMVV

SEQ ID NO: 2011 - protein, 78 aa, Zea mays
MDSSSGSQDKKFRDNDRPEAKEANSTAQHLVDFTEAEEDLVSRMHRLVGNRWEIIAGRIPGRTAEEVEMFWSKKYQER

SEQ ID NO: 2012 - protein, 85 aa, Setaria viridis
ECQKVGAPPEVSARLTAMAQELEARQRTALGGLGAATEPELDQFMEAHHEMLVKFREELTRPLQEAMEFMRRVESQLNSLSISGR

SEQ ID NO: 2013 - protein, 257 aa, Capsicum annuum
MKGEYVEVRKNHSNNITPSNIYMFGKLHQTQNFNHHHHQLPSQPIVSMSAPPPPPSSSSANDGATIEVVRRPRGRPPGSKNKPKPAPNYITTTRDDHMEKSTMSPYILEIPLGVDIIDSVYRFCRKHNTGLCIINGSGTVTNVTLRQPFTNNPDSTITFHGNFNILSISATIIPQSIFSKVLNGFSISLAGPQGQVVGGPVIRPLLSAGPVYLIAASFNNSFYHKFSVEDDEGSQSAVAGDGDSGHTLESTHHEYCY

SEQ ID NO: 2014 - protein, 453 aa, Striga asiatica
  misc_feature (429)..(429): Xaa can be any naturally occurring amino acid
  misc_feature (432)..(432): Xaa can be any naturally occurring amino acid
MPDMDGFKLLEHVGLEMDLPVIMMSADDSKNVVMKGVTHGACDYLIKPVRMEALKNIWQHVVRKKKYEWKEKEQEQSGSVEDGERQPKQEDVDYSSSANEGNNWKSSKRRKEDEEGEDKEDTSTLKKPRVVWSVELHQQFVTAVNQLGIDKAVPKKILELMSVPGLSRENVASHLQKYRLYLKRLSGQHQNGLGNSYMGPTDPSFGPLNPLNVNGLDFHTLASSPLPVQSLASIQAASLNRNPTNRFPLSSHIDQRNIFSFENQRINHPNAQIRPVNLLHGVPTSMDSRQLAFTNVNLPITPQLRTQMLTHHQPAFSQAIATTVPGLSGPTNFVDFSRSQRPNFPVSTNTSAAAAAVNNINNNSNNGFSLVGNPGIPSTSSYEVFGNEWGLSGFDGPHHVGPQARINVGPSVLVQPGSSNEQSRVSSFXNRXVFRQLRGPAVAAIIRILFIRS

SEQ ID NO: 2015 - protein, 212 aa, Hordeum vulgare subsp. vulgare
MDKHQLFGSSNVDTTFFAANGTHDAARARKQRARRRRRRSARCGGGDGDGGEMDGGGDPKKRRLTDEQAEILELSFREDRKLETARKVYLAAELGLDPKQVAVWFQNRRARHKNKTLEEEFARLKHAHDAAILHKCHLENELLRLKERLGATDRRCGASGRQLGATGHLWMADTPLAPLACAAGARARPSRREPASSSRVSAGQTCWGGTMT

SEQ ID NO: 2016 - protein, 485 aa, Oryza sativa
  misc_feature (166)..(166): Xaa can be any naturally occurring amino acid
MAAAGNSFLNQDPTMMGSGMPHMYFASSSHGTGAHYQSPGGAPITMAVPDMGFLVAGIGIAPSSFVMPEGALAASYSAMATVPVGVVVPQQQSSRFGGNNGNPGSFKGAWTRQEDEVLKQMVILHGDRKWATIAKSLPGRIGKQCRERWTNHLRPDIKKDVWTEEXDDRMLIEAHRTYGNRWSVIARCLPGRSENAVKNHWNATKRSLKSKRRMKKKSVQVVNSPPGQLSPLEEYIRSQYPSAVETTPPPPAVPAPPSDVIVHGAGSVSAGPTVATQEPTGTNPSEMGIYLGLGNPAGPTTQQLAAMNLNMSLAPDLNAYNDQREGYYLPFVPQGNLHYGMHVPAPPVQQQQQQGISVDQGLHSSCLSLYHPFPGTHPVSLDFGCQSSNHANAGGYYSEAGPSSGSGSGDPDDVDVIQMASRQFLMPSEAEVTLDLTRFKAGAVVPLWSEQAGGKKAPSPSLPNDDDYESRAPPPHQEMTRMEMR

SEQ ID NO: 2017 - protein, 612 aa, Oryza sativa Indica Group
MSSAAGGGGYGGGQGGGAEHHHHHHGHAGHLLLHHHPQHVAGAAVAAAAAAAGGQMYHVPQHSRREKLRFPPDAGDSPPPHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVSIGGGNGGVSLTLGLHQNNRVCIAEPLPAALPANLAHRFGLEEVSDAYVMSSFGGQDRHFGKEIGGHLLHDFVG

SEQ ID NO: 2018 - protein, 315 aa, Oryza sativa Japonica Group
MMKESYMEVLPPAPAHYFVGQAAAAGGWFLPDRRGGGGAWSQEENKVFEQALAALDRNDPERWERVALLLPGKTVADVMTHYDDLENDVCFIEAGLVPFPHYGAAGGGGGSGFTLDWDGGDDPAGLGFKRSCYMVGGKRARGPDQERKKGVPWTEEEHKLFLMGLKKYGRGDWRNISRNFVTSRTPTQVASHAQKYFIRLNSGGKDKRRSSIHDITTVNLPDDDHGNPSPSPPPSVLTAHSSSSAAAVSEQFGVLVDGKPPPPPLGRGAGHHHFMPHPYAQVKIEAGNSHVAGGGRLDDSVLVQMQCGQLMQPLG

SEQ ID NO: 2019 - protein, 228 aa, Triticum aestivum
MARERREIKRIESAAARQVTFPKRRRGLFKKAEELSVLCDADVALIVFSSTGKLSQFASSSMNEIIDKYSTHSKNLGKTDRPALDLNLEHSKYANLNDQLAEASLRLRQMRGEELEGLSVDELQQLEKNLETGLHRVLQTKDQQFLEQINELHRKSSQLAEENMKLRNQVGQIPTAGKLVVADTENVVAEDGQSSESVMTALHSGSSQDNDDGSDVSLKLGLPCLPWK

SEQ ID NO: 2020 - protein, 228 aa, Eruca sativa
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPGMISLMPGGSSNYEQIMPPPQTQPQTFDSRNYFQVAALQPNNHHYSSAGRE

SEQ ID NO: 2021 - protein, 231 aa, Eruca sativa
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKRSLQEVDLHNDNQLLRAKIAENERNNPGMINLMPGGSSNYEQIMPPPQTQPQTFDSRNYFQVAALQPNNHHYSSAGRE

SEQ ID NO: 2022 - protein, 315 aa, Ostreococcus tauri
MKVEELPIGVPRIQTARRAPRAEDAAMGTFGNGASPSESETVGTPGTGMEGAQWIERSRMRRERSGLKSRTESSETDSERSSEGDNLTLRSIEPKPVNERVTNVKATARRHDSRTSAYRGVSLLRQTGKFHAQINVQRKQLHLGFFFSEEEAARAYDRAAIFKASVEGGAICTNMDINDYKDEIPMLQSLTQRELLELLHKMKVKSNEASAPNSPRKASKPRAKSLQRECRTSHSEHSETEHVTIRVDAAEPPSSPRFDALSTAVGFVEHSRELSVGRIAASVQIISNTCPTVVDMHVSKRRRTRIWPRQAPAAA

SEQ ID NO: 2023 - protein, 811 aa, Oryza sativa Japonica Group
MATAEVGGGGGEGDAAAAAVARAGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIFAPVQPDGTGYLSCYLAT

SEQ ID NO: 2024 - protein, 226 aa, Guillenia flavescens
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQNIISIQNSNRQLMGETIGSMSAKELRNLEGRLDRSINRIRSKKNELLFAEIDYMQKREVDLHNDNQLLRAKIAENERNHPSMSLMPGGSNYEQIMPPPQTQSQPFDSRNYFQVAALQPNNHHYSSAGRQ

SEQ ID NO: 2025 - protein, 154 aa, Picea sitchensis
MAREKIEKKRIANASARQMTFSKRRRGLFKKAEELSILCAADVALVVFSSTGKLYNYSSSSMEVILDKYVLYPSTIQKDGQQILEFEGQDPKRIKQQFEDASQDLREELEGLTLKDLEKLEEQFEMELSCIRSQKVEHLVKKINELQQKVTTYI

SEQ ID NO: 2026 - protein, 226 aa, Thlaspi arvense
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSITRIRSKKNELLFSEIDYMQKREVDLHNDNQLLRAKIAENERSNPSMNLMPGGSNYEQLMPPPQTQSQPFDSRNYFQVAALQPNNHHYSSAGRQ

SEQ ID NO: 2027 - protein, 226 aa, Thlaspi arvense
RGKIEIKRIGNTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSITRIRSKKNELLFSEIDYMQKREVDLHNDNQLLRAKIAENERSNPSMNLMPGGPNYEQLMPPPQTQSQPFDSRNYFQVAALQPNNHHYSSAGRQ

SEQ ID NO: 2028 - protein, 281 aa, Oryza sativa Indica Group
MDHYASRGNWFMARKWSPEENKQFERALAGLDLRCPDWDRVARAIPGRSALEVMNHFRDLELDVQQIENGMVPFPVYGAAAAGGAFTLQWDAAHGVGDFRNAYRFGGGGGGKRHFGRTPEQERKKGVPWTEEEHKLFLLGLKKYGKGDWRNISRNFVQTRTPTQVASHAQKYFIRLNSGGKDKRRSSIHDITTVNLTDDRPPSPSQSSLISNQSNTSTLTAAVAPFSSTADVKPQNAANASFNSPSRTLGMAGYGMGLQDQGLQCGGPLHDQLAASRSILF

SEQ ID NO: 2029 - protein, 371 aa, Arabidopsis thaliana
MEDNDAAYDQVKSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAKHFYTTSESLLRHELLPSYGYLSNTQEEDEFYLKTIMTSEGNDWPSYVTNNVYCLHPLELVDLQDVMFQSYGTCIFANGTCGESDKCDGGYWKILHGDKLIKSNFGMVTGFKKVFEFYETVIHRYFCDGEEVKEETERLGHQRCQGLLLPHRRGHVQTKSCGVVTVKEKRSLVEQPEEIVAAPETPRQGKSEHNDPLKRKKAIGCVGEKAEM

SEQ ID NO: 2030 - protein, 343 aa, Oryza sativa Japonica Group
MKRGCEDELGAGDVILRGVEEVEEEDDDDLVLPGFRFHPTDEELVTFYLRRKIAEKRLSIEIIKEMDIYKHDPSDFLKTSTVGSEKEWYFFCLRGRKYRNSIRPNRVTGSGFWKATGIDRPICSAAGGGGGDCIGLKKSLVYYRGSAGKGTKTDWMMHEFRLPPPPADDLAAGRSSPPPSLQEAEVWTICRIFQRNITHKKQPQPQLAVAAAAVPAPVPDATSSITGSLESDSAGDDVVEYMNTLQPPPASNVNGGYSNQRYFQEQWNSSSNDNTTVFHQHAAAAPPPEPSPATAMAGFGHDQSVLSSPAPSDFYYKDGCNDDIYRMVMELADPSLFYDHIYA

SEQ ID NO: 2031 - protein, 140 aa, Picea abies
  misc_feature (15)..(15): Xaa can be any naturally occurring amino acid
MAKSKPMKKVLDSYXIKGTDKVVKVGDCVVLRAEDAQKPPYIARVEKIEADGRGNHVKVRVRWYYRPEESIGGRRQFHGAKELFLSDHFDEQSADTIEGKCSVHTFKNYTKLDSVGSEDYFCRFEYNAATGGFTPDRVAV

SEQ ID NO: 2032 - protein, 330 aa, Triticum aestivum
MAGMDPGGGSPGAGSSRYFHHLLRPQQQQQPSPLSPNSHVKMEHSKMSSPDKTPVGDADAGGSGGGAGADQPSSSAMVPVDGSSGGGGSGGSGGPTRRPRGRPAGSKNKPKPPIIVTRDSPNALHSHVLEVSAGADIVDCVSEYARRRGRGVCVLSGGGAVVNVALRQPGASPPGSVVATLRGRFEILSLTGTVLPPPAPPGASGLTVFLSGGQGQVIGGSVVGTLVAAGPVVLMAASFSNAVYERLPLEGEEEEVAAAAAGAEAQDQVAQSGGPPGQQPAASQSSGVTGGDAGGMSLYNLAGGNVGNYQLPGDNFGAWGGGGGGVRPPF

SEQ ID NO: 2033 - protein, 487 aa, Glycine max
MCSFEDPLDENPPALISLGGNAKLSGYNDRIPCSLLSKSRDNVPVVSRDDDENSYGCTHPINTKTKSFRLKTGIGDNRISKRLASNFQKVAEKTKDHTHSNNDGDWKRTYCSKRNCNKHQSSQMNIPFKKRKLFNYRSVSNSNGLIRSGGIYYSPENCMNQDGCGSPPGMHKDPGMPSLEACQHQTLRSRGSHVNLRIKSFRVPELFIEVPETATIGSLKRTVMDAVTAVLGGELHIGVFLQGKKVKDDSKTLLQTGISHQNELDALGFTLEPNSSQSLPIVCAAHSPGPKADITQPVIRYPSSPAVIHQRIQGNSDMLPEHQVTSLGSHFENDHDSAPSPVNASVEKGMKDSKELVTVPEMDEELAMVPVHQKSKRSEIVQRRIRRPFSVDEVEALVQAVEKLGTGRWRDVKVCAFDNAKHRTYVDLKDKWKTLVHTARISPQQRRGEPVPQELLDRVLVAHAYWSHQQTKPQHKHHPETETVFSF

SEQ ID NO: 2034 - protein, 337 aa, Oryza sativa Japonica Group
MEQQLPLLAPDSKAATSSPLCLTLDNPTSTSTSPAVPSSAPPPAAALEPSRQSFHERETDAIKAKIMSHPLYPALLRAFIDCQKVGAPPEVVGRLSALAGELDSRAEDRYLQGQSSDPELDEFMETYIDMLVSYRQELTRPIQEADQFFRNMEAQIDSFTLDDNGSEGGNSSEDEQEAGGGDMASAGLPEITSPCAEDKELKSHLLNKYSGYLSSLWRELSKKKKKGKLPRDARQKLLHWWQLHYRWPYPSELEKAALAESTGLDAKQINNWFINQRKRHWKPTPPAMEYRSLQPAGAASYGGASAGASTSGGGSAVVRGMEGQHFTGGGAYPRGDP

SEQ ID NO: 2035 - protein, 538 aa, Candida albicans SC5314
MVNTDFEKIYLNQSRAGGRMRIAESGLGWKASASSGSTSQPFLLPREEILIASWSRGSKGYELRVQTKNKGVVSLDGFDHDDFTQLKQELTRNFHINLEHREHSLRGWNWGKTDLARNELIFNVNNKPAFEIPYSDISNSNLTGKNEVALEFNLDNNKNGDEIVEMRFYVPGTIENETTIVKNETNGDVIEEAVVNETSAAQQFYEQLKDKADIGQVAGEAIVSFSDVLFLTPRGRYDIDMYPSSLRLRGKTYDYKIQYEQIERIFSLPKPDETHHLIVLQIDPPLRQGQTRYPFLVLQFVKDEETELELNVSDEDFEKKYKDRLKKTYDAPTNVVMSHCLRGLTERKLITPGAFQSRYLQAGVPCSVKASEGYLFPLDRCFLFVTKPTLYIPYSEISSVVMSRTGGGVSASRTFDLEVNVIGSNQPHVFSNIDREEQEFIESFCKEKGVKVKNEEKIAKARLAKALEQEANDDDDEDADMGSAGDEDEDEDVDFQSGSDSDVAEEFDSDAAPSSDDDEEMADSKETDDRPPKKKAKN

SEQ ID NO: 2036 - protein, 545 aa, Solanum bulbocastanum
MKVPFSTNDNVSSKPLISSNNNNNNLRNVTFPAATNSSNLCYEPKSVLELRRSPSPIVDKQIITTNPDLSALCGGEDPLQLGDHVLSNFEDWDSLMRELGLHDDSASLSKTNPQLSLTQSESLTQFHNLSEFSADSTQFANPDFSFSESTFPQQFPAVNQGSFINALDLSGDIHQNWNVGFDYVDELICFAECFETNAFQLAHVILARLNQRLRSAAGKPLQRAAFYFKEALQAQLAGSARQTRPSSSSDVIQTIKSYKIFSNISPIPMFSSFTANQAVLEAVDGSMLVHVIDFDIGLGGHWASFMKELADKAECRKANAPVLRITALVPEEYAVESRLIRENLTQFARELNIGFEIDFVLIRTFELLSFKAIKFMEGEKTAVLLSPAIFRRVGSGFVNDLRRISPNVVVHVDSEGLMGYGAMSFRQTVIDGLEFYSTLLESLEAANIGGGNCGDWMRKIENFVLFPKIVDMIRAVGRRGGGGSWKDAMMGGGFRPVGLSQFADFQADCLLGRVQVRGFHVAKRQAEMLLCWHDRALVATSAWRC

SEQ ID NO: 2037 - protein, 85 aa, Setaria viridis
ECQKVGAPPEVSARLTAMAQELEARQRTALGGLGATTEPELDQFMEAYHEMLVKFREELTRPLQEAMEFMRRVESQLNSLSISGR

SEQ ID NO: 2038 - protein, 678 aa, Arabidopsis thaliana
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLWHSSDQQHEWDRLNHVSEKQLE

SEQ ID NO: 2039 - protein, 286 aa, Triticum aestivum
  misc_feature (84)..(84): Xaa can be any naturally occurring amino acid
  misc_feature (147)..(147): Xaa can be any naturally occurring amino acid
  misc_feature (159)..(159): Xaa can be any naturally occurring amino acid
MAAAIDLSGEDLVRALEPFIREASAPPPLHSHLSPTSPFSFPHAAYSGYPYGVQAQAQTELSPAQMHYIQARLHLQRQTGQPGXSGPRPQPMKPASVAAATPPRPQKLYRGVRQRHWGKWVAEIRLPRNRTRLWLGTFDTAEEAALXAYDQAAYRLRGXTQRGLNFPDNAASRGPLHASVDAKLQTLCQNITASKNAKKSASVSASTAAATSSTPTSNCSSPSSDEASSSLESAESSPSPATTTAAEVPEMQQLDFSEAPWDEAACFALTKYPSYEIDWDSLLAAN

SEQ ID NO: 2040 - protein, 298 aa, Zea mays
MGAPKQRWTSEEEAALRAGIARHGVGKWRTILKDPEFSSTLCYRSNVDLKDKWRNMNVIVSTSSSRDKAKSALKRIRTIPKNNEHTMAITRVTSDIDDEIVDEKPIVSLPSEAKNTSSSKKSHRLDNIIMEAIKNLNEPTGSHRTTIANYIEEQYWPPSDFDHLLSAKLKDLSTSGKLIKVNRKYRIAPSSPNSERRSPKMPLLEDVQREPVKIWSDDTKTLTRSQVDAELARMATMTAEEASVAAARAVAEAEAIMAEAEAAAKEAEAAEAEAQAAQAFAEAAFLTLKNRNAGKLMA

SEQ ID NO: 2041 - protein, 207 aa, Physcomitrella patens subsp. patens
METGGSISQLQLPPGFRFHPTDEELVLHYLRRKADSHVFQIPVIAEVNLYKFDPWDLPDKALFGEREWYFFSPRDRKYPNGARPNRAAASGYWKATGTDKPIHMTNGHSKVGVKKALVFYRGKAPKGEKTNWIMHEYRLAEGVSPSAHHHRRGSLRLDDWVLCRIYEKCTHAQRAGKEHDRASVEDVLASLPEIDDPNHMLPRLNSM

SEQ ID NO: 2042 - protein, 226 aa, Triticum aestivum
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQRVLCTKDRQFMQQISDLQHKGTQLAEENMRLKNQMHEVPTASTVAVAEAENVVPEDAHSSDSVMTAVHSGSSQDNDDGSDISLKLALPWK

SEQ ID NO: 2043 - protein, 93 aa, Mycobacterium smegmatis str. MC2 155
MGGALFAGATGAAALAGAQPAGDSAPMSVLGPVPAFPPPPPPPPPFWGPPPPPPPPPPFWRPPPPPPIWLPPPPPPPPFWGPPPPPRPPGHWR

SEQ ID NO: 2044 - protein, 293 aa, Triticum aestivum
  misc_feature (96)..(96): Xaa can be any naturally occurring amino acid
MMMREPWMEVLPPAAMGYYGGPRGAGGWFTGQPRAWTADENKQFERALAGLDLRSPDWDKVAHATGKTVREVVDHFKSLELDVRQIESGTFPGPGXATAPGAFTLQWDGSGGHAGAGDFRHGYRFGGCGGGRRHGGRTPEQERKKGVPWTEDEHKLFLLGLKKYGKGDWRNISRNFVQTRTPTQVASHAQKYFIRLSSGGGKDKRRSSIHDITTVHLDDQPPSPSQSSMITQSSAPAPSPATGQYSLPADTKQHGGANAPYNSPPSYGMGLQDQGLQCGPLHDQLAANRSMLY

SEQ ID NO: 2045 - protein, 215 aa, Brassica napus
  misc_feature (174)..(174): Xaa can be any naturally occurring amino acid
  misc_feature (194)..(194): Xaa can be any naturally occurring amino acid
  misc_feature (208)..(209): Xaa can be any naturally occurring amino acid
  misc_feature (214)..(214): Xaa can be any naturally occurring amino acid
MRKGRGSSAVPPALPGSVKEPRYRGVRKRPWGRFAAEIRDPLKKSRVWLGTFDSAEEAARAYDAAARNLRGPKAKTNFQIDCSPSSPLQPLHHRNQIDPFMDHRLYGGEQEVVIISRPASSSMSSTVKSCSGVRPASSSVAKAATKRYPRTPPVAPEDCRSDCDSSSSVVEDGXDIASSSSRRKPPFEFDLNFXPLDGVDLFVGADDXXCTDLXL

SEQ ID NO: 2046 - protein, 226 aa, Triticum aestivum
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQRVLCTKDRQFMQQISDLQQKGTQLAEENMRLKNQMHEVPTASTVAVAEAENVVPEDAHSSDSVMTAVHSGSSQDNDDGSDISLKLALPWK

SEQ ID NO: 2047 - protein, 380 aa, Brassica oleracea
MESGSNSTSCPMAFAGDNSDGPMCPMMMMMMPVITSHQQHHGHDQQHQHQQQHDGYAYQSHHQHSSLLFLQSLTPPSQEAKNKVRSSCSPSSGAPAYSFMEINHQNELLAGGLNPCSSASVKAKIMGHPHYHRLLLAYVNCQKVGAPPEVQARLEETCSSAAAAAASMGPTGSLGEDPGLDQFMEAYCEMLVKYEQELSKPFKEAMVFLQHVECQFKSLSLSSPSPFSGYGEAAIERNNNGSSEEEVDMNNEFVDPQAEDRELKGQLLRKYSGYLGSLKQEFMKKRKKGKLPKEARQQLLDWWSRHYKWPYPSQKLALAESTGLDQKQINNWFINQRKRHWKPSEDMQFVVMDATHPHHYFMDNVMGNPFPIDHISSTML

SEQ ID NO: 2048 - protein, 89 aa, Physcomitrella patens subsp. patens
SPPGSGKVYKGVRMRAWGKWVSEIREPNKRSRIWLGSFPTAEMAAKAYDAAVVCLRGPSAPLNFPDTPPSDLPLCSTPRDVQAAAAAAA

SEQ ID NO: 2049 - protein, 198 aa, Picea sitchensis
MKNPELPVEMDEVEVKVDIQSTNASADEPRTAKRQGFELARIPEDPASKPTALSSPKKPKAASSSSSSPRAQPPACQVEKCAADLADAKEYYRRHRVCEQHSKARVVLVLGLQQRFCQQCSRFHVLEEFDEAKRSCRRRLAGHNERRRKTPSDSSVDRLDSNHHLNDNWLRHMTESDKMTMVLERNTTAKVCKEIKNH

SEQ ID NO: 2050 - protein, 267 aa, Oryza sativa
MGRGKVQLKRIENSMNRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIRSRKSHLMLESISELQKKERSLQEENKALQKELVERQKNVRGQQQVGQWDQTQVQAQAQAQPQAQTSFFFFFMLRDQQALLSPQNICYPPVMMGQRNDAAARRRWRPKARCNFRIGGFPPWMLSTFKA

SEQ ID NO: 2051 - protein, 225 aa, Eruca sativa
GRGKIEIKRIENTTNRQVTFCKRRNGLLKKAYELSVLCDAEVALVVFSSRGRLYEYSNNSVKGTIERYKKAISDNTNTGTVAEINAQYYQQESAKLRQQIISIQNSNRQLMGETIGSMSPKELRNLEGRLDRSINRIRSKKNELLFAEIDYMHKREVDLHSDNQLLRTKIAENERNNPSMNLTPGGYEQIMQPSQTQSQPFDSRNYFQVAALQPNNHHYSSAGRQ

SEQ ID NO: 2052 - protein, 299 aa, Phaseolus vulgaris
MSNISMVEAKLPPGFRFHPRDEELVCDYLMKKLTHNDSLLMIDVDLNKCEPWDIPETACVGGKDWYFYTQRDRKYATGLRTNRATASGYWKATGKDRPILRKGTLVGMRKTLVFYQGRAPKGRKTEWVMHEFRIEGPHGPPKVSSSKEDWVLCRVFYKSREVSAKPSMGSCYEDTGSSSLPALMDSYISFDQTQAHADEFEQVPCFSIFSQNQANPIFNHMTTMEPKLPATTYGGAPNLGYCLDPLSCDRKVLKAVLSQITKMERNPLNQSLKGSTSFGEGSSESYLSEVGMPHMWNNY

SEQ ID NO: 2053 - protein, 248 aa, Helianthus annuus
MGRGKVQLRRIENKINRQVTFSKRRGGLLKKAHEISVLCDAEVALIVFSNKGKLFEFSTDSCMDSILERYERYSYTERQLVAADATPRSWTLEYNKLKSRAELLQRNHRHYMGEDIESLSLKEIQNLEQQLDTGLKNIRTRKNQLLHESISELQKKGKAIQEQNTTLTKKIKEKEKDKTIPQNTQWEMHNYVDHDTTFLMPPPPPALNMGGDYNHGGGGSSEGADGRTNELDLSLQPIYSCHMRCFPS

SEQ ID NO: 2054 - protein, 229 aa, Guillenia flavescens
RGKIEIKRIDNTTNRQVTFRKRRNGLLKKAYELSVLCDAEVALIVFSSRGRLYEYSNNSVKGTIERYKKAISDNSNTGSVAEINAQYYQQESAKLRQQIVSIQNSNRQLMGETIGSMIPKDLKTLESKLDKSITRIRSKKNELLFAEIDYMQKRSLQEVDLHNDNQLLRAKIAENERNNPSMNLMPGGSNYEQIMPLPQTQSQPFDSRNYFQVAALQPNNHHYSSAGRH

SEQ ID NO: 2055 - protein, 256 aa, Phaseolus vulgaris
MDATTPSELPPGFRFHPTDEELIVYYLCNQATSKPCPASIIPEVDLYKFDPWELPDKTEFGENEWYFFSPRDRKYPNGVRPNRATVSGYWKATGTDKAIYSGSKLVGVKKSLVFYKGRPPKGDKTDWIMHEYRLAESKQPVNRKIGSMRLDDWVLCRIYKKKNTGKTLEHKETHPKVQMTNLIAANNDEQKMMNLPRTWSLTYLLDMNYLGPILSDGSYCSTFDFQISNANIGIDPFVNSQPVEMANNYVSDSGKY

SEQ ID NO: 2056 - protein, 307 aa, Zea mays
MGAPKQRWTPEEEAALKAGVAKHGPGKWRTILRDSDFSALLRLRSNVDLKVTLGSPGRDKWRNLSVTAGGYGSREKARMALKKGRRVVPKLTAEPMDVDVKDMDDAHDTAIDVEPLAMAFESLPTEESPDKSVARLDDLILEAIRKLKEPSGSSKAAIAAYIEDQYWPPADFQRLLSTKLKALVNSGKLIKVNQKYRIAPSPPPSGRIGTKVSSAEGMKAENNNAKRLTKHQVIAELEKMKGMTKEEAAAFAAKAVAEAEVAIAEAEEAARVAEAAENDAEAAKAFLDAVTLSMRNRNAASMMLRAC

SEQ ID NO: 2057 - protein, 226 aa, Guillenia flavescens
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIVSIQNSNRQLMGETIGSMIPKDLKTLESKLDKSITRIRSKKNELLFAEIDYMQKREVDLHNDNQLLRAKIAENERNNPSMNLMPGGSNYEQIMPLPQTQSQPFDSRNYFQVAALQPNNHHYSSAGRH

SEQ ID NO: 2058 - protein, 489 aa, Oryza sativa Indica Group
MACLQGNAMATDENGADDRAGGESTVDHLRSHMNYGDMDLSGEEHVPKARKPYTITKQREKWTDEEHRLFLEALQLHGRAWRRIQEHIGTKTAVQIRSHAQKFFSKVVRESSGSNTGSGGASAAAAAAAIQIPPPRPKRKPAHPYPRKVDGAAKKHVPALRQLEKPPLWMQSLSEQEGSPTSVLTAAQIGTEALGGGFSNNSSGSGSLAPSAAGTDEHVDGGGSPASSVDREDGCLSPSIPTAELAMQAPNTKMSIATTDAKEASSEASVFRLFGKSVVVKDSDQLHLLNGSNIATSGSVERATRNILVPSFAAAPEGSSSNPWPSSMQQFLYFLPRSDGFAAQPVMPWFSYNGSLPCALFYPAAAAAAANQQCHRDSEGVEFRVSQREGSLTGSNTASSVVLGSSAAVPAAAAAAQNSDVAESRGQGNSREAAASPRLTKCESSASVTLLQRGFMPYKRCAAESELLRSEAAGGEEAVADGELTRLCL

SEQ ID NO: 2059 - protein, 190 aa, Brassica napus
MGRAPCCEKMGLQRGPWTPEEDQILISFIHKHGHNNWRALPKQAGLLRCGKSCRLRWMNYLKPDIKRGNFTKEEEDAIISLHQVLGNRWSAIAAKLPGRTDNEIKNVWHTRLKKRLEDYQPAKPKSSNKKHGTKPKSQSVAAKLNSTRSESELGNSSNPSFESLFSASPSTSDEVSSVTLMSHEGHNNEA

SEQ ID NO: 2060 - protein, 406 aa, Arabidopsis thaliana
MMKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 2061 - protein, 385 aa, Dendrobium hybrid cultivar
MEKEGIQSSKRFRRDEETGDVKGVGGLRPWQNASSRIIRVSRVSGGKDRHSKVWTAKGLRDRRVRLSVSTAIQFYDLQDRLGYDQPSKAVDWLIKAADAAIADLPELDGGTFPMPPAMVLPGRINHPDGSSAIDHQISPSKSTCSSASETSKGSTLSLSRCQTRAPARERTSKEKENEQDAAAHENQNLNTPSSFTELLTAGSTTEVADCGTGFGLKQLRPLLATSTADYFCQAGIFGQTHKIPQLTPGYSSTLHGGNNTHMGMGMMAYNAASVGEHQDMQQYSFMQDHVIPVAAVAPGVDYDLNVSASSVFTGFNRGTLQSNSPHHHHLADGANLPFFFGASFPIAAAEGASSENQYLGGFNGRLQVFCNEAHRHPKLKGEGKG

SEQ ID NO: 2062 - protein, 336 aa, Triticum aestivum
MALEAAVLSRAAAGLFGRCAMAGAGGAWNGLFGGSEGLAGLDGGDWDAAVAAACSSMLLPPAAFQDLDISATAPQEESGGRGEMSAAGVGQDDAAPVTAAATGRRKRRRTRTAKNSEEVESQRMTHIAVERNRRKQMNEYLAALRSLMPPSYALRGDQASIVGGAINFVKELEQLLQTLETQRQTRERAAVDGGEAQPPLFANFFTFPQYSMSVTSAPAPPPANNDEGADGCAEAEASGSKPSAVADVEVTMVESHANLRMLSRRRPRQLLRLLVGLQGHRLTVLHLNMSSASHMVLYSLSLKVEDDCQLTSVDEIATAAHQIIEKIQEEQDFTSA

SEQ ID NO: 2063 - protein, 318 aa, Arabidopsis thaliana
MADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRLLFEAEISFLLAKHFYTTSDSLPRNVLLPAYGFCSPDKQEEDEFYPVTIMISEGKDWPSYVTNNVYCLHPSELVNVHDGKFHDNGICIFANRTCGVTDKCNEGYWKIKHREKLIMSRYGQTIGWKKVFQFYETEKERHFGNGEEVKVTWTLKEYRLTRKMNKNKVVCVIKYKVKCLPRITS

SEQ ID NO: 2064 - protein, 367 aa, Hordeum vulgare subsp. vulgare
MRSSEAETPAKANKASTPQEQQPPTSSTTTPTVYPDWTNFQGYPPIPPHGFFPSPVVSNPQGHPYMWGPQPMMPPYGTPPYVIYPPGGVYAHPSMRPGTTTTPATAGGETNGKSSDGIEKSPIKRSKGSLGSLNMITGKNCVEHGKTSGASANGTISQSGESGSESSSEGSEANSQNDLQHKESGQEQDGDVRSSQNGVSPSPSQAQLKQTSAIMQMPSSGPVPGPTTNLKIGMDYWANTASSSPALHGKVTPTAIPGDLAPTEPWMQDERELKRQKRKQSNRDSARRSRLRKQAECEELAQRAEVLKQENASLKDEVSRIRKEYDELLSKNSSLKDNIGDKQHKTDEAGLHNKLQRSGDDNQKDTN

SEQ ID NO: 2065 - protein, 692 aa, Oryza sativa Japonica Group
MVFQKRSSLEMESGGGSHVAEMPRVPKSARGKRSIRKKESQGQVMCAFDLLATVAGKLLDEGEGSLGNASSGTPAVDASPKDVRVKQEQCDEEAKHFKNEVMDQDSCNESALVSHIAFQRPVNHHGRKGEDPEGSHAVIEDPKAKSEALDKESSMISCTKAELGCNFAAIADRWSPESVESGAFTGDAAAIAMPATTSGFHKNAPDMYNLLDPMDVDVKPPPLVSSDSTGEMPLYGNKIRRSTSFPRVPKGGAGFTVDRDEDDDDKSSGCTHPSTATNRGFRPNCTAGHSRVKKLLACKHRKVAPARMHKGDLSYSDVDRKPSFRNKKMYYTRQRTQRSTFKRRKMFDRHSAQVSEEYAKANTKFAARDSHAVSLEANKGTNSTAFQKSQESSDCHVKLRIKSFKVPELLIEIPETATVGSLKKTVLEAVNAILGGGLRVGVLHHGKKVRDDNKTLMQAGISHDEVLDNLGFSLEPNCAPHPSQLSPPEDNEFMETVDTTEPLARIAPADSSSKHGEVDASQELALAPLSANYQGSDHDFVHSPGGMSSPDKASTNSRAIVPVTPADSNAGAIVPANKAKRSPEQGQRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPPLAEALLLT

SEQ ID NO: 2066 - protein, 387 aa, Arabidopsis thaliana
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 2067 - protein, 213 aa, Glycine max
MLKMRGKSGLQLQVIQIQQLKIQLKMMTTKKTVPPLVAMTASENPDGYCLIKERMTQALRHFKELTEQNVLAQVWAPVRNGNRYALTTSGQPFVLDPHSNGLHQYRTASLMYMFSVDGENDEILGLPGRVFQHKIPEWTPNVQFYSSKEYQRLNHAQHYNVRGTLALPVFELARQSCVAVVELIMTSQKINYASEVDKICKAFEAVKLRSSEI

SEQ ID NO: 2068 - protein, 337 aa, Oryza sativa Japonica Group
MEQLHLLLASGGGSKASTTITPFCLARDHASTSSPSPAAVAAPAPPPEATSGSEQSIHGSGTGLQSSEAMIKAKIMSHPLYPSLLRAFVDCKKVGAPPEVVGRLSSLAVVTDVPQYSGDRCLPAQQPAADPELDQFMETYCYMLTRYGQELARPIQEAEEFFRGIEEQIDSLALDEDVSYDYEDEVAGGLPEKSAAFGENEVTTTTRRHLMNKYSGYLNSLWTEISNKKKNSTGHLPRDARHKLLQWWHLHYRWPYPSEAEKAALAESTGLDKKQVTNWFINQRKRHWKPKPAAAMDAGFLQMHPRYGASSSSSPAAALRVEDGGGRRSAYHPRGGP

SEQ ID NO: 2069 - protein, 351 aa, Oryza sativa Indica Group
MAMGMEGSGGGGSAKKKEESLPPGFRFHPTDEELITYYLRQKIADGGFTARAIAEVDLNKCEPWDLPEKAKMGEKEWYFFSLRDRKYPTGVRTNRATNAGYWKTTGKDKEIFTGQPPATPELVGMKKTLVFYKGRAPRGEKTNWVMHEYRLHSKSIPKSNKDEWVVCRIFAKTAGVKKYPSNNAHSRSHHPYTLDMVPPLLPALLQQDPFGRGHHPYMNPVDMAELSRFARGTPGLHPHIQPHPGYINPAAPFTLSGLNLNLGSSPAMPPPPPPPPQSILQAMSMPMNQPSTTNQVMVTEQMIPGLANGVIPQGTDGGFTTDVVVGGTGIRYQNLDVEQLVERYWPGSYQM

SEQ ID NO: 2070 - protein, 667 aa, Glycine max
  misc_feature (44)..(44): Xaa can be any naturally occurring amino acid
MKRMNESNNTDDGNNHNWLGFSLSPHMKMEVTSAATVDNNVRQXFYMSPSQSHLSNFGMCYSVGENGNFHSPLTVMPLKSDGSLCILEALKRSQTQVMVPTSSPKLEDFLGGATMGTHEYGSHERGLSLDSIYYNSQNAEAQPNRNLLSQPFRQQGHMSVQTHPYYSGFACHGLYQAPLEEETTKETHVSDCSSLMPQMTEGLKNWVAPTREFSTHQQILEQQMNCGIWNERSGVSVGTVGCGELQSLSLSMSPGSQSSCVTAPSGTDSVAVDAKKRGHAKLGQKQPVHRKSIDTFGQRTSQYRGVTRHRWTGRYEAHLWDNSCKKEGQTRKGRQVYLGGYDMEEKAARAYDLAALKYWGPSTHNFFSIENYQVQLEEMKNMSRQEYVAHLRRKSSGFSRGASIYRGVTRHHQHGRWQARIGRVAGNKDLYLGTFSTQEEAAEAYDVAAIKFRGANAVTNFDISRYDVERIMASSNLLAGELARRKKDNDPRNKDIDYNKSVVTSVNNEETVQVQAGNNNNENDSEWKMVLFNHPSQQQQANGNGSDQKIMNCGNYRNSAFSMALQDLIGIDSVGSGQHNMLDESSKIGTHFSNTSSLVTSLSSSREASPEKRGPSLLFPMPPMETKIVNPIGTSVTSWLPSPTVQMRPSPAISLSHLPVFASWTDT

SEQ ID NO: 2071 - protein, 229 aa, Magnolia praecocissima
MARGKIQIKKIDNVTARQVTFSKRRRGLFKKAEELSILCDAEVALIIFSATGKLFEYSSSSMKEIIERHTMHSKNLQKLDQQPSLELQLENSNYNRLSKQVAEKSHLIRQMRGEDIQGLTVEELQKLEKTLETGLSRVMERKAEQIMKEISGLQIKGVKLMEENMRLRQRIIEMSRGDSKGDRQIIESEIVVNEDGQSSDSVTNACNSGAPQDYESSDTSLKLGVPFSS

SEQ ID NO: 2072 - protein, 443 aa, Gibberella zeae PH-1
MSMIATASPSPHPSSFGMPRPWETNRCPDYSLRPRTENDKVALPSIRQAFPELQLQTQPPHDLNTKPLVTGPPLGTAPLAAASPQYVHSPNSSKRRRLSMEREMESERVRQVPRLCYSPDRESPRQISPNLAIQAGTRENWTAPTRTSPYLTNGATHHSVPMEVGERLEARPALPSLPPPRSLEREAVLVSRGPAPAPVPTPVPTPAPAPASIPASVSASAPAPAPTEGYRSSHQPMSHSRTPIPESGVSPYRESSYGYPYHHPTRYQSLSAGSAHSFDRTPFTPGAYNAPYQDFVRFGEMGPASLSGDNKQRKRRGNLPKETTDKLRAWFVAHLQHPYPTEDEKQDLMRQTGLQMNQISNWFINARRRQLPTMINNARAETDAMSSARGGDMKVLATTERGDFDHGKREPVGPLSDGEGATYEEELEALSQRRPGTMGRGSV

SEQ ID NO: 2073 - protein, 226 aa, Triticum aestivum
MAGKRERIAIRRIENLAARQVTFSKRRRGLFKKAEELSILCDAEVGLAVFSATGKLFQFASSSMNQIIDRYNSHSKILKKADEPSQLDLHEDSNCARLSDELAEASLWLQQMRGEELQSLNVQQLQALEKSLESGLGSVLKTKSQKIMDQISELENKRVQLIEENARLKEQASKMEMQVAADSPVVYEEGQSSESVTNTSYPRPPLDTEDSSDTSLRLGLPLFNSK

SEQ ID NO: 2074 - protein, 226 aa, Triticum aestivum
MAGKRERIAIRRIENLAARQVTFSKRRRGLFKKAEELSILCDAEVGLAVFSATGKLFQFASSSMNQIIDRYNSHSKILKKADEPSQLDLHEDSNCARLRDELAEASLWLQQMRGEELQSLNVQQLQALEKSLESGLGSVLKTKSQKIMDQISELERKRVQLIEENARLKEQASKMEMQVAADSPAVYEEGQSSESVTNTSYPRPPLDTEDSSDTSLRLGLPLYNSK

SEQ ID NO: 2075 - protein, 113 aa, Brassica napus
  misc_feature (65)..(65): Xaa can be any naturally occurring amino acid
MAKTRPGVPSKIKTGRKELDSYTIKGTNKVVRAGECVLMRPSDAGKPPYVARVEKIEADARNNVXKVHCRWYYRPEESLGGRRQFHGAKELFLSDHFDVQSGHTIEGKCIVHT

SEQ ID NO: 2076 - protein, 184 aa, Rosa hybrid cultivar
MLKMMEVCQARGFVYGIIPEKGKPVSGASDNIRAWWKEKVKFDKNGPAAIDKYEAEILAMTDADNNRNGNSHTILQDLQDATLGSLLSALMQHCDPPQRKYPLEKAVPPPWWPTGNEDWWMKSGLPCGQSPPYKKPHDLKKMWKVGVLTAVIKHMSPDIAKIRRHVRQSKCLQDKMTAKITSEF

SEQ ID NO: 2077 - protein, 212 aa, Ampelopsis brevipedunculata
MNTTSPPYSDPHPLRYTDTWGSPNLPDSDGASEELMLASTHPKKRAGRKKFRETRHPVYRGVRRRNSGKWVCEVREPNKTSRIWLGTFPTAEMAARAHDVAALALRGRGACLNFADSAWRLQVPSSLDAKDIQKAAAEAAEAFRPMENDEAMQDERREGSEVRMPENVFIMDEDDVFGMPGLLANMAEGLLMPPPYSVTDGYGGDDMAADAD

SEQ ID NO: 2078 - protein, 364 aa, Glycine max
MSNSNSNPTRILHSQSQDPNTTTADPHVLLQNLSLVRTRMDSLQHFLSQSINTNTPLAVDQIAMVSSQIVSSIHQLIVNGSALVSYSQNSTAASGAPDPPLYPKKPEPEPSVADKAKQILDSKFGPLEDDDDDDGGAEDFDDGSGIVELDAIEILAEHMHFCEICAKGFRRDSNLRMHMRAHGEQFKTVEALAKPSETTAQRRATRFSCPFEGCNRNKLHRRFRPLKSVICVKNHFKRSHCPKMYTCERCRKKHFSVLSDLRSHAKHCGGEARWKCTCGTTFSRKDKLFGHIALFDGHAPALACDEEGKGKQVVEDDEDPMLMNESEFESDNCLLNQELPEGFFDDFGSIDDYCLKEVLGFPSN

SEQ ID NO: 2079 - protein, 373 aa, Zea mays
AICVHHQGLGLGKPMEEMLMAGNANLNQNPNPPPAAPSAPGAQRAGAPAAVAAAPPSAGATGGAGPERRARPQKEKALNCPRCNSTNTKFCYYNNYSLQQPRYFCKTCRRYWTEGGSLRNVPVGGGSRKNKRSSSAVSSAAAAAAASTSAAMSGTVPVGLAAKNPKLMHEGAHDLNLAFPHHNGRALQPPEFPAFPSLESSSVCNPGAAMLGNGAAGRGMGALSGLELLRSTGCYVPLQHFQLGMPAEYAAAGFSLGEFRVPPPPQSQSVFGFSLDTHGTGGVGGAGGYSAGLQESAAGRMLFPFEDLKPAVSAAGGGASNGADHHHYEHSKDQAAGDGGGASGVTGGHEAPAGFWSNSMIGNGSSNGGGGSW

SEQ ID NO: 2080 - protein, 218 aa, Eustoma grandiflorum
MGRGKIDIKRIENNTNRQVTFCKRRNGLLKKAYELSVLCDAEVALIIFSSRGRVYEYANNNIKSTIDRYRKATSDASTVFTTQEINAQFYQQESKKLRQQIQVLQNSNRHLMGEGLSSLNVKELKQLESRLERGISRTRSKKHEMILAEVEYLQKREIQLEQENACIRSKIAEQERLQELSMMPPGQDYNAMQAYLAQNFMQVNGLMEGPPVYSMLHK

SEQ ID NO: 2081 - protein, 350 aa, Arabidopsis thaliana
  misc_feature (326)..(326): Xaa can be any naturally occurring amino acid
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVHXSPPPPPTEMLSLVCSKKQRIFHAS

SEQ ID NO: 2082 - protein, 852 aa, Oryza sativa Japonica Group
MATAEVGGGGGEGDAAAAAVARGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 2083 - protein, 200 aa, Zea mays
MSSGEDGYCSSDSPRAESPDQPQAAADAESPRAGAGPNKRDLHASSPAAKRSRRSVEKRVVSVPLAECGEGPPPSDSWAWRKYGQKPIKGSPYPRGYYRCSSSKGCPARKQVERSRADPAVLLVTYTFDHNHEAPRPKSSCCHQQGRPPAPKPDEPVVAVAVAEQEDEAEDWQEPEQKVVLGLAGPETAPATATLAPAGE

SEQ ID NO: 2084 - protein, 423 aa, Zea mays
  misc_feature (348)..(348): Xaa can be any naturally occurring amino acid
SEHDTTEATPTKPDATGAALTQPAAAGASAPVPNATGARPDPAGARFTGSSSGKLVVEGGKSKKEEESLPPGFRFHPTDEELITYYLRQKIADASFTARAIAEVDLNKCEPWDLPEKAKLGEKEWYFFSLRDRKYPTGVRTNRATNAGYWKTTGKDKEIFTGQLPATPELVGMKKTLVFYKGRAPRGEKTNWVMHEYRLHHSSRSVPKSNKDEWVVCRVFAKSTGAKKYPSNNAHSRLHHHPYALDMVPPLLQHDPFARHHNYPYMTSADLAELARFARGTPGLHPHIQPAPHPGTSASAYMNPAAAGAPPSFALSGGLSLNLGASPAMPPSLPPTAFHATMSMAMSXRRRRRVVPAPVITIVIRWWRVSTSSSRWRRRGLGGCVIVPGADGGFVADAAAGGRYQSLDVEQLVERYWPAGYQV

SEQ ID NO: 2085 - protein, 366 aa, Populus trichocarpa
MSPPLLGVVEEEGHSNVTLLASPASAESACLNGLELKERNYMGLSDCSSVDSSAVSAASDERKTSLNLKATELRLGLPGSQSPERNHELSLLSSALLDEKPFFPLHPSNDGHYSSTQKNVVSGNKRVFSDAMDEFSESKFLSNSEVNAMLSPRPSPNMGLKPGMLENLGVQQAKVKEIVAPKAGQERPHAANETRPLRNSSANNSSAPAPKAQVVGWPPIKSFRKNSLATTSKNTEEVDGKAGPGALFIKVSMDGAPYLRKVDLRNYSAYQELSSALEKMFSCFTIGQYGSHGAPGREMLSESKLKDLLHGSEYVLTYEDKDGDWMLVGDVPWEMFIETCKRLRIMKSSDAIGLAPRAMEKCKNRN

SEQ ID NO: 2086 - protein, 211 aa, Zea mays
  misc_feature (190)..(190): Xaa can be any naturally occurring amino acid
GSERSWSERRACVAMDGAEDDGTEWMMHGAGGKGKGGGALDKNKKRFSDEQTKSLESMFATQAKLEPRQKLQLARELGLQPRQVAIWFQNKRARWKSKQLEREYSALRDDYHALLCSYESLKDEKRALLKQLEKLAEMLHEPPQGKYYGGNADDVRSGGVGGTKEEEESTDACAGAALYSSDSTPATAGXSSSAEQTCSGSQWWEFESLSE

SEQ ID NO: 2087 - protein, 280 aa, Arabidopsis thaliana
ISPSLFRSTPKLRPLSISLTSTTYTENQFQIDSSKWSDSTTPYMVSWSLQSESSDSDWNRFNLGFSSSSFGGNFPADDCVGGIEKAESLSRSHRLAEKRRRDRINSHLTALRKLVPNSDKLDKAALLATVIEQVKELKQKAAESPIFQDLPTEADEVTVQPETISDFESNTNTIIFKASFCCEDQPEAISEIIRVLTKLQLETIQAEIISVGGRMRINFILKDSNCNETTNIAASAKALKQSLCSALNRITSSSTTTSSVCRIRSKRQRWFLSSHYSHNE

SEQ ID NO: 2088 - protein, 351 aa, Picea sitchensis
MKMEMNVGQRGFNEKPIELPGFRFHPTEQELVGFYLKRMVQGRLHNFNFIPVLDLYRYDPWDLSSFSSLGEREMFFFVPRDERCQNNRGRPNRMTASGYWKATGSDRSVHDDNAKCIGLKKTLVFYRGRAPRGQKTDWIMNEYRLPDYSDNDKLKKEVVLCRIYKKATPLKWLEQQAMNQTEVTSTYEDLDCISQDSLPSPAKINDNKRVQEAKSICVRDSDYVACDEFTTEPSSSPRDNVTKSDITCCLGSAVDSDLMESTVCGGFIDPDFPVFVDDCERNEEFSSLMTMLNSSSSSSSVECCCWEPLLIPEMAEEPSLFQITKPSMDFRNEEAGSDGNWIYMDRISFSP

SEQ ID NO: 2089 - protein, 62 aa, Physcomitrella patens subsp. patens
QHFRGVRRRPWGKFPAEIRDPAKRGARVWLGTFDTAEEAAAAYDHAALRMRKSRALLNFPLK

SEQ ID NO: 2090 - protein, 85 aa, Setaria sphacelata
ECQKVGAPPEVSARLTAMAQELEARQRTALGGLGAATEPEPDQFMEAYHEMLVKFREELTRPLQEAMEFMRRVESQLNSLSISGR

SEQ ID NO: 2091 - protein, 324 aa, Zea mays
  misc_feature (238)..(238): Xaa can be any naturally occurring amino acid
MSSATPAPARHRTCRTYWCYQCGRALRIISCPSTDVFCPRCFGRFLHEEVDPPTARHGFPPAHFLPHPFHPQHQYAGRPRRWVIYGEEPTTVPGRAFRQPAPAQGPATPPAPAPALVRRRRVPSPPPAPVPRRPSTPPAIDPGDYFMGPNLNSLIEELTQNDRPGPAPAPPSAIDSLPTVRVAGAHLSDGSQCPVCKEDFELGEAARQLPCKHVYHSDCIVPWLRLHNSCPVCRYQLXRAGSNGSSQAAPRGGSNGSNNRNREMEREPLTMVQWGPFSWPFPPRGMDDPGDAWEHGQRGRHDAADAGDVLVESLSHPKMYASYP

SEQ ID NO: 2092 - protein, 218 aa, Triticum aestivum
PSCSPPPVVLCAKRIAIRRIENLAARQVTFSKRRRGLFKKAEELSILCDAEVGLAVFSATGKLFQFASSSMNQIIDRYNSHSKILKKADEPSQLDLHEDSNCARLSDELAEASLWLQQMRGEELQSLNVQQLQALEKSLESGLGSVLKTKSQKIMDQISELENKRVQLIEENARLKEQASKMEMQVAADSPVVYEEGQSSESVTNTSLRLGLPLFNSK

SEQ ID NO: 2093 - protein, 451 aa, Vitis vinifera
  misc_feature (15)..(15): Xaa can be any naturally occurring amino acid
  misc_feature (58)..(58): Xaa can be any naturally occurring amino acid
  misc_feature (72)..(72): Xaa can be any naturally occurring amino acid
MDNLKKVMQTHYSVXSRVPNFLGAESVGEYSLYGKESPAGIPPCIQREQVLNSLAQLXLFKHHILNTSPVSXKPFPMGSYVMNPHDMSTQPSMFPAALYSPSSTRFETHQHLGNPHFLPQYPPCVSPANSSESPLLLGDDVADKYDKENSEDLMKDFFGIPEESSDQSLQGLDAEKDSLTLMDLLDLRYLSEELDIPEICQAPNVSSIPPQSHPHALVPPMDNQVPEAAAAQKQRIRWTPELHELFLDAVSKLGGPDKATPKGILRLMNVEGLNICHVKSHLQKYRLAKAVQMKQDKKASSSEERKVATKTDERETPIERAMQVTETLRVQVEVQKILHEQLKLQKVLQLNLEQNGEYLRRILEDQHKAGVALPSLMGSHSNPQPIPLSSSDGASSPKQYDFEVDCFPSLLSKHKASHTTESEQPRCHKKPRRSSSVEIICIDSPAESVEG

SEQ ID NO: 2094 - protein, 238 aa, Picea glauca
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPLVKTEVCSGLRNQFEFHREQTGNCYTDQSSNTPVNPLVTSLASQARGEAQTIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 2095 - protein, 122 aa, Glycine max
  misc_feature (58)..(59): Xaa can be any naturally occurring amino acid
  misc_feature (81)..(84): Xaa can be any naturally occurring amino acid
LSSNKRAALTEIIDVLRAVCHAHRLPLALTWIPCCYSEGIRNETDRIRIKEGHTSPNXXCVLCIEESACYVNDGAVEGFVXXXXEHHLEEGQGIAGKALQSNHPFFYTDVKTYDIGEYPLVH

SEQ ID NO: 2096 - protein, 184 aa, Cissus quadrangularis
MNTTSPPYSDPHPLRYTDTWGSPNLPDSDGASEELMLASTHPKKRAGRKKFRETRHPVYRGVRRRNSGKWVCEVREPNKTSRIWLGTFPTAEMAARAHDVAALALRGRGACLNFADSAWRLQVPSSLDAKDIQKAAAEAAEAFRPMENDEAMQDERREGSEVRMPENVFIMDEDDVFGMPGLLA

SEQ ID NO: 2097 - protein, 362 aa, Petunia x hybrida
GFRFHPTDEEIITCYLQEKVMDKRFTAIAFAEVDLNKSEPWDLPAKAKMGEKEWYFFCQRDRKYPAGMRTNRATESGYWKATGKDKEIYKGKDCLVGMKKTLVFYKGRAPKGEKTNWVMHEYRLEGKLSYNCFHKASMEEWVICRVFNKSIGARRSPLLLDSFVEDLLDSPSSLPSLMEMPLSASCQDDKPCTSSYRDELNNTSSDEIHSSAYFSTGGFFNNNYYKQDQRLLMPKQEEAEKSYGLFVPTHHIFTGIDTYQHNNHLASSSSYDQTLFLPNSKFSEFRTIPNYSLTCDGTTLERQQLSSNNSMISLSQDTGLSTDVANEISSVIPRFDDSSKQFEDIDPCRTIAAPDLDSIWNF

SEQ ID NO: 2098 - protein, 228 aa, Sorghum bicolor
KVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAAASRQQQQGAVGPADTDPGPDKLIIVLLHDEAGSAGSAASTKHMLPAADNRRER

SEQ ID NO: 2099 - protein, 331 aa, Petunia x hybrida
MENFPGHVNKEDDEQLQLPPGFRFHPTDEELITHYLSKKVADNNFFAIAIGDVDMNKVEPWDLPWKAKMGGKGNGYFFGVRDKKYPQLDLRTNRATTAGYWKATGKDKEIFRGKTLVGMKKTLVFYRGRAPKGEKTNWVIHEFRLEGRAALQNLSKTSKDDWVICRVFHKSTGGKKVHISGLERLHSDENEMENSVLQPLTESASESRHVHCFSNFTTTQKSQKEMTNYFSNTPFPILSNTMDNFARNSGPNKFPWHQTPIPSSFPMQEPTILRTLYDNYDQNMQHIFKKEKVSLSQETGVSIDMNTEISSVVSNLETAVGPQYLDCLWNY

SEQ ID NO: 2100 - protein, 383 aa, Physcomitrella patens subsp. patens
MGRFIYSDGSWSSGLRFEAAALDTQVTFENLLHELGEKSVIKSGGMDSIGPGQGLHTPLALRPHTPMPVSGTGNPPLESGSSMPNLMAPMTSRMELNIGGAPYQGYQMPMKRKRGRPRKYTTGDSPQVTVSGFGNTSLFSALAKQIAAPYTPPDKSEKRGRGRPVGSTRKQQLANLGVVLAGTGKSFTPHILTVHTGEDASSKIMQFAQHGPRAMCVLSANGAVSNVMLRQDSSSEGTVTYEGRYEILSLSGSYLPLSGEDGAKQRTGIVVVGSFLLGLLKTDSKVDSPLRLTQGELSGMKTPFATQQISSRKSSVFLSLNLNGTGAGPQEGNQASPASGQSSDARPQAVGVFRPSEGWGIASHISLLGDNRRADINISLAGG

SEQ ID NO: 2101 - protein, 206 aa, Brassica napus
MTRRCSHCNQNGHNSRTCPNRGVKLFGVRLTEGSIRKSASMGNLSHHSGSGLSGLVSNNPGSPGNGPDNDGYASEDFVPGSSSSHRERKKGNPWREEEHRMFLLGLQKLGKGDWRGISRNYVKTRTPTQVASHAQKYFIRQSNVSRRKRRSSLFDIVPDEIMDSQEMEAEDIPMQGSDSVPAPLTLETEECESMKSTNSSGDEPPT

SEQ ID NO: 2102 - protein, 223 aa, Physcomitrella patens subsp. patens
MTHIAVERNRRKQMNEHLTALRALMPGYFIQKGDQASIIGGAIEFVRELEHLLHCLQAQKRQRAQSDISNLGNPSICPPAMPSLDQLHRTLPPLSFINSQVLLTSPATSVANPSSSTPIKPHTGHEIMGEAKSDQASVNVKMVRIDQALVKVLAPRRSGQLLRTVMALEGLALTVLHTNITTVHHTVLFSFHVHMGLLCRMSVKEIATVLHGTFSSSPPHSLQ

SEQ ID NO: 2103 - protein, 362 aa, Spinacia oleracea
MDYSTSWLSHSSPSLDISNANTLRLFDDAPVRDTNIFKQDPSPPRPPSTNLWHKDESGALVEELKRVNAENKRLTEMLTVVCENYNELKRQLVDHMSKQSSSNNEITKKRKLDNNNNNNNNNNNNNNNNGLVVRTNNNNNGESSSSDEEDSYGKPKEETIKAKITRVAVRTQASDSTLILKDGYQWRKYGQKVTRDNPCPRAYFKCSFAPGCPVKKKVQRSLEDQSMLVATYEGEHNHQPPAQQEGQGGAPSGSSRSLPLGSVPCTLDLTKSKSNANNVVNETTTTTTSSNNNNNNNNNNNNNKVLNNTTSSNHNQLPKFSSPEFQKLLAEQMASSLTKDPNFTAALAAAITGRFVQQTSSD

SEQ ID NO: 2104 - protein, 375 aa, Daucus carota
MGRSPCCDKVGLKKGPWTPEEDQKLLAYIEEHGHGSWRALPSKAGLQRCGKSCRLRWTNYLRPDIKRGKFSLQEEQTIIQLHALLGNRWSAIATHLPKRTDNEIKNYWNTHLKKRLTKMGIDPVTHKPKNDAILSSHDGHLKSTANLSHMAQWESARLEAEARLVRQSKLRSNSPPPNTTTTTTTLNKPMAPPPLCLDILKAWNGVWTSNNEAGGRSSGFVGNGIGHHESPTSTTVSYDITNGVENNASFKEEGNIEDDGKRLVSEFKQGIENAISGLSDVPILPMEIAWPTQESLIRVDHDDDITENINDQHVPSGNFVENFTDLLLNNSGKADRSPSDGDQSPVILLVRRCQWEVRVDTSKITRIIGIVFLIW

SEQ ID NO: 2105 - protein, 204 aa, Arabidopsis thaliana
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 2106 - protein, 330 aa, Oryza sativa Japonica Group
MALEAVVFSEGYYFGCGGAMAAEAAAGGAWSWSHGYGGGVDQGKGAMELVVDDGVVNAFWDGGGGGASSSPVMAAVSGFIEEPDGGRRKRRRARTVKNREEVESQRMTHIAVERNRRKQMNEYLAVLRSLMPASYVQRGDQASIIGGAINYVKEMEQLLQSLEAHRHARRARTDAAAALPFAGFFTFPQYSMSAVPTTTTTTVAAAATENGNAVAGAGAGDDADADVSGSKPSSVADIEVTMVESHANLKVLSRRRPRQLLRMVAGLQHHRLAVLHLNVASAGHMALYSLSLKVEEDCQLTSVDDIAAAVHGIVETIEQEQQQQQKQSCS

SEQ ID NO: 2107 - protein, 312 aa, Glycine max
MSTSKSVSSSSEDDNELRRGPWTLEEDNLLSQYIFNHGEGRWNLLAKRSGLKRTGKSCRLRWLNYLKPDVKRGNLTPQEQLIILELHSKWGNRWSKIAQHLPGRTDNEIKNYWRTRIQKQARHLKIYTDSREFQELVRRFWMPRLLQKAKESSSSNMSIQNQAIPMPFDYVSQHLTVGTIPPWQGPCMNEAGPTYMDQHEQNSDSEHNNGSCISLSESANIPKVPQHFGHTTITQFHALNTNDFGTFTYEGYNVNNNVYEMDNFKTTTTWVAEDAQYPIGDCQMVGSNWVNNDFACNMWNMDELWQFSKLQK

SEQ ID NO: 2108 - protein, 85 aa, Setaria pumila
ECQKVGAPPEVSARLTAMAQELEARQRTALGGLGAATEPELDQFMEAYHEMLVKFREELTRPLQEAMEFMRRVETQLNSLSISGR

SEQ ID NO: 2109 - protein, 121 aa, Brassica napus
MGAPKQKWTSQEETALKAGVLKHGTGKWRTILSDPEFTSILKSRSNVDLKDKWRNISVTAMYGSRKKAKLALKRTPSSHDDDNATALTIVAIANGAQHISPLPPALSCAPPRDFEGLFSRF

SEQ ID NO: 2110 - protein, 113 aa, Brassica napus
  misc_feature (14)..(14): Xaa can be any naturally occurring amino acid
MHPSALVDPHRDQXLHDSGLCIFANRTEACGYTDGCESGCWRIMEGDKPISSIMVGEMFGYRRVFKFCEKDIDKHLGKVDGEVMFLTWIMEEYRLAEEEMKDKVLCVIKLHRR

SEQ ID NO: 2111 - protein, 238 aa, Picea glauca
MEHLNTAAAQASSSLYGVGMAEYGDAGVSSMMALITQHEPHDSESIMSTKMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 2112 - protein, 297 aa, Mycobacterium sp. MCS
MSGPNPPGPDSPGPDQPEREGGRHSAPDEATEQVGAAEQPAAATGATEAYSQAYSAPESEQFSSGPYVPADPALYDYDSYEPVSDVGEEQAPPRWPWVVGVTAIIAAISLVVSVALLVTKTDTDQLATPATTTTTPPPPVQDEITTTTPPPPPPPPPTTEPPPPPPPETVTVTEPPPPPPSAEAPPPPPPETTTPPPPPPPTTTTPAGPRQVTYSVTGTKAPGDIITVTYVDASGRRRTQRNVYIPWSLTVTPISQSEVGSVQASSLFLVSKLNCSITTSDGTVLSSNTGNAAQTSC

SEQ ID NO: 2113 - protein, 204 aa, Capsicum annuum
MKVGNSKCNGVNNNKDVHYRGVRKRPWGRYAAEIRDPGKKSRVWLGTFDTAEEAAKAYDAAAREFRGCKAKTNFPLPSENQNGSDSGSPDESFSGENRAHAPSEFELTRCLGAGGEGVGNGGRLAEVGLVRNGDTIVHAPTELDLTRLLGAGGEGGDNSGYSAEVGLVRNGFPIFHHQPPIEAPMMSNRSSPAESYSGETIINT

SEQ ID NO: 2114 - protein, 203 aa, Brassica napus
MKIRCDVCDKEEASVFCTADEASLCDGCDHRVHHANKLASKHLRFSLLYPSSSKNSSPICDICQEKKALLFCQQDRAILCKDCDSSIHSANEHTKKHDRFLLTGVKLSPTSSVYKPTTESPSSSQDCSVPSPSKKPISAPQSNTSKILPSSKIGGDSEVSQWGSTSTISEYLIDTLPGWHVEDFLDSSLPPFGFSKSGHDDGV

SEQ ID NO: 2115 - protein, 573 aa, Hordeum vulgare
MSPARLPISRESCLTIPAGFSPSALLDSPVLLTNFKVEPSPTTGSLGMAAILHKSAHPDMLPSPRDKSVRNAHEDRGSRDFEFKPHLNSSSQSLAPAMSDLKKHEHSMQNQSMNPSSSSSNMVNENRPPCSRESSLTVNVSAQNQPVGMVGLTDSMPAEVGTSEPQQMNSSDNAMQEPQSENVADKSADDGYNWRKYGQKHVKGSENPRSYYKCTHPNCEVKKLLERAVDGLITEVVYKGRHNHPKPQPNRRLAGGAVPSNQGEERYDGASAADDKSSNALSNLANPVHSPGMVEPVPASVSDDDIDAGGGRPYPGDDATEEEDLESKRRKMESAGIDAALMGKPNREPRVVVQTVSEVDILDDGYRWRKYGQKVVKGNPNPRSYYKCTSTGCPVRKHVERASHDPKSVITTYEGKHNHEVPAARNATHEMSAPPMKNVVHQINSNMPSSIGGMMRACEARNYTNQYSQAAETDTVSLDLGVGISPNHSDATNQMQSSGPDQMQYQMQTMGSMYGNMRHPSSMAAPAVQGNSAARMYGSREEKGNEGFTFRATPMDHSANLCYSSAGNLVMGP

SEQ ID NO: 2116 - protein, 285 aa, Daucus carota
MGRSPCCSKVGLNKGAWTTAEDKILTDFIHLHGEGGWRNLPKRAGLKRCGKSCRLRWLNYLRPDIKRGNISDDEEDLIIRLHKLLGNRWSLIAGRLPGRTDNEIKNYWNTTLRKKAHDNHTSSAAAPKTPTKQCNNKKTKKHKKKREKSEPIKPEIKANASDVRAKAALDEADHQLITSTSTMEPLVQQALQNKTTDQSSDLVPGVDSSDMCLTDFLNYDFSGLLNTDINHQDYDMESASPCSSSEKPIMQILEEFWNAEEPCLVSNSNLYFTSLSECLVGDWLA

SEQ ID NO: 2117 - protein, 529 aa, Larix x marschlinsii
MWDLNHMPEATKEPQVVVPMEAACSAEGNLSVGNADFRDENVSGSSSSSSVAVANTAMSVDCEEYSMSQACLSEHAEMDARSSQENVNGPGSEVQVQPGKLFGFSFSNIMKSNFTETSNGVSNGGSGCTNRITRQFFPVGQEFESQVAIPGRPQLPRAHWVGLTFRQAESFRTPTAKEGTQPIKKSRRGPRSRSSQYRGVTFYRRTGRWESHIWDCGKQVYLGGFDTAHAAARAYDRAAIKFRGVDADINFNIDDYEEDVKQMTKLTKEEFVHVLRRQSTGFPRGSSKFRGVTLHKCGRWEARMGQFLGKKYVYLGLFDNEVEAARAYDRAAIRCNGREAVTNFSPELYESELALTEDKVPDPDLDLSLGNSVAKDGSLVPKDNNDGPMRSESDLCTLSEAEWKTSGLIKPKVPNHLEGLNQSAQSLSCEVPSLQRYQPAPGWVWQLPTNRPALPPAMIESAASSGFSRQIYSSTTSPSSEWLQKGGFHFLFQPALMQTKNVLHSATAPALINTYGTKPSDHSLNLSLG

SEQ ID NO: 2118 - protein, 231 aa, Lilium longiflorum
MATTVAIETPAFTPVAVDPPAAKPAKAKKAKVPKEKKASVAKPALHPTYLEMISEAIASLKERTGSSQIAISKFVENKHKAHLPANFKKLLLVQLRKLTAAGKLTKVKNSYKISAKPTTATKPKKTSAKSTTVAKPKSAAAKPKSTAAKVKKAAVKPKPKSAAVKPKAEPAAPKPKAVSKPKAVAPKPKTAGPAKKAKTSAKPSPSKKAAPVASKKAKPVKKATAPKKAKK

SEQ ID NO: 2119 - protein, 578 aa, Arabidopsis thaliana
MVSHKCVEEFGYASYLVPSNARAPRSARKRRSIEKRISKEDDNMCAIDLLATVAGHLSFESGSSLMSIDKLIEDHRVKEEFPEEEKPLMPVALSPYRGSLSPCGFSSVINGKVENEVDGFSYSGGSDACQVGNFSQDVKPDIDGDAVVLDARPNVVVSLGSSSRTEVPSIGNCVSHGVRDDVNLFSRDDDENFSKYIHPRVTKHSPRTVPRIGDRRIRKILASRHWKGGSRHSDTKPWRNYYLHQQRSYPIKKRKNFDHISDSVTDDYRMRTKMHRGSRKGQGASFVASDSHVKLRIKSFRVPELFIEIPETATVGSLKRMVMEAVSTLLSDGHRVGLMVQGKKVRDDNKTLHQTGISQDNSHLDSLDFSLEPSSEMPQLLTSHPLGHACEELLPVCQATKIDNVLESDHHDSALFPSDSLGNNNVTEDSKAMISVALNELSSQSQPPSRKSRRSEQQQQQAAQRRIRRPFSVAEVEALVQAVEKLGTGRWRDVKLCAFEDADHRTYVDLKDKWKTLVHTAKISPQQRRGEPVPQELLNRVLNAHGYWTQQQMQQLQQNVNKLEQETQSQTTEGLLLL

SEQ ID NO: 2120 - protein, 286 aa, Daucus carota
MGRSPCCSKVGLNKGAWTTAEDKILTDFIHLHGEGGWRNLPKRAGLKRCGKSCRLRWLNYLRPDIKRGNISDDEEDLIIRLHKLLGNRWSLIAGRLPGRTDNEIKNYWNTTLRKKAHDNHTTSAAASPKTPTKQCNNKKTKKHKKKREKSEPIKPEIKANASDVRAKAALDEADHQLITSTSTMEPLVQPALQNKTTDQSSDLVPGVDSSDMCLTDFLNYDFSGLLNTDINHQDYDMESASPCSSSEKPIMQILEEFWNAEEPCLVSNSNLYFTSLSECLVGDWLA

SEQ ID NO: 2121 - protein, 253 aa, Rumex acetosa
MEFSNELSRDMEDGSPQRKMGRGKIEIKRIENVTNRQVTFCKRRNGLLKKAYELSVLCDAEVALIVFSSRGRLYEYANHSVKATIERYKKTCSDSTGVTSVEEANAQQEAAKLRNQIRTLQNQTRNTSRNLMGEGLTSMNMKDLKNLETRLEKGISRVRAKKNELLFGEIEFMQKKEIELHNNNQFLRAKIAESERSQQSMNLMPGSSSGEQHYELMPQSQAGPFDSRNFFQVSDLQPDERYSCQNQTPLQLV

SEQ ID NO: 2122 - protein, 297 aa, Daucus carota
MGRSPCCSKVGLNKGAWTSGEDKILADFIHLHGEGRWRSLPKRAGLKRCGKSCRLRWLNYLRPDIKRGNISSDEQDLIIRLHRLLGNRWSLIAGRLPGRTDNEIKNYWNTTLRKKTHVNQTTSTSASPTPKSSRTKQCSTEKKRKKKDKKNVESTHQNVASSQVTHHSLITPPKSDHHPILMDTTSPEPLAAQNLMPKQDSSSNGQSLDLVPDVDSSDMGFKELLDFDFSGLLDTNNDDQRDSKIETTSLISLNENPLMDVLVDEFWSAVEEPNLAACNPFNQYFASESDFLGDWLA

SEQ ID NO: 2123 - protein, 405 aa, Zea mays
MDSASSLVDDTSGSGGGACTDKLRALAAAAASASGPPPERMGSGASAVVDAAEPGAEADSGSAPASVAAVAAGVGGKLPSSRYKGVVPQPNGRWGAQIYERHLRVWLGTFAGEADAARAYDVAAQRFRGRDAATNFRPLADAGPDAAAELRFLASRSKAEVVDMLRKHTYFDELAQNKRAFAAAAAAASSAAATTSTSLGNDNRSSSPACAREHLFDKAVTPSDVGKLNRLVIPKQHAERHFPLHLAAAAGGGESTGVLLNLEDAAGKVWRFRYSYWNSSQSYVLTKGWSRFVKEKGLQAGDVVGFYRSAAGADSKLFIDCKLRPNSVDTASTTSPVGSSPPPAPVAKAVRLFGVDLLTAPADAMARCKRARDLASPPQAAIKKQLVELALASVDQCYGAGRSFS

SEQ ID NO: 2124 - protein, 220 aa, Triticum aestivum
ICRGRKPAAATAKKGQKRPRQPRFAFMTKSEIDHLEDGYRWRKYGQKAVKNSPFPRSYYRCTNSKCTVKKRVERSSTDPSVVITTYEGQHCHHIGPFQRGGGGGGGGAATARYHSAAAVALAEQMSSSSSFIPARQLYSLPPLHPPQSSLSSEAVVSSAATTSFHQHVNDGDELRQASYSSRVSMAQSPSTPSSVPPAISVEKAGLLDDMVPHGVRHGTP

SEQ ID NO: 2125 - protein, 207 aa, Zea mays
  misc_feature (197)..(197): Xaa can be any naturally occurring amino acid
DVDSYTIRGTNKVVHVGDCVLMRASDSDKQPYVARVEKMEADGRGSVRVQVRWYYRPEESKGGRRQFHGAKELFLSDHFDLQSAHTIEGKFVVHSFKNYTKLDNVGPEDFFSRFEYKAATGSFTPDRVAVYCKCEMPYNPDDLMVQCEACKDWFHPSCMAMTIEQAKKLDHFVCSDCLKENGSKRLSNVYATSSNSXPKAESIRQTR

SEQ ID NO: 2126 - protein, 470 aa, Oryza sativa Indica Group
MAKTKQGKKDVESYTIKGTTKVVRVGDCVLMRASDTEKAPYVRRVERLETDGRGSVRVRWYYRPEESKGGRRQFYGAKELFLSDHFDTQSAHTIEGKYCKCEMPYNPDDLMVQCEGCKDWFHPSCMGMTIEQAKILDHFLCADCVKENGTKRPSNSYPASSNSDSKGGEVQLLTVDHCLEKNAEERERVTTSGGEVGRLNLFGDQAVGPLRCWTGGMCLSRSIGDIDVGEFIVPIPHVKQVKLSNIGGRLIIASDGIWDALPSEAASKVYLHNWLQSLWLRDAEYHQETLEILKLAIKSTKKLWAGVFEKKGIEEIEKIRKTSRPRVAGGEQEQSLHLPVILTPYQGQEASSHVLPINFAGLAKAVKPSATIFVGQCLFTGNETTSIWLRRFRKQSRIYMSTLVSPKCLVFNVKNRQMLTNLNGHSVMFLRGLLVKVFLQELPVKPIITQDDSTLIRLNFFQAARHRLVW

SEQ ID NO: 2127 - protein, 249 aa, Vitis vinifera
MAPKEKVAGVKPSANAKEVHFRGVRKRPWGRYAAEIRDPGKKSRVWLGTFDTAEEAAKAYDSAAREFRGAKAKTNFPLVSENLNNNNQSPSQSSTVESSSREGFSPALMVDSSPLDLNLLHGGGVGVGVGVGVGAAAGYATALRFPFQHHQFQVSSPSPAAGIVPTGGLPAANHLFYFDAMLRTGRVNQDFQRLRFDRAASDFRAALTGGVQSDSDSSSVVDLNHNDLKPRARVLIDLDLNRPPPPEIA

SEQ ID NO: 2128 - protein, 216 aa, Brassica rapa subsp. chinensis
MNTFPASTEMVGSENESPVTTVAGGDYYPMLAASCPKKPAGRKKFQETRHPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETIVEAIFTEENNDVFYMDEESMLEMPALLASMAEGMLLPPPSVHFGHNYDFDGDADVSLWSY

SEQ ID NO: 2129 - protein, 186 aa, Triticum aestivum
  misc_feature (64)..(64): Xaa can be any naturally occurring amino acid
  misc_feature (82)..(82): Xaa can be any naturally occurring amino acid
MASAGAAIGARAARACDGCMRRRARWHCAADDAYLCQACDASVHSANPLARRHHRVRLPSSSSXAATSSLQHADPDEPAWLXGLKRRPRTPRSKPGMVGKHGAPAAAKAAAASAVPDLEAEDSGSGIVGENDHGHGVEAKKKDLLGPLPVVTPPCSLYSTPPCRGEPFPLAPPKRKTLPSGGSSPA

SEQ ID NO: 2130 - protein, 350 aa, Arabidopsis thaliana
MANPVGFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTISIQTLSTCPSFGSSNPLYQITDLQESPNSIKLVSLAQEVSKTPGTGIDNDAQGTEIGEHKLGQETIKNKRAGFFHRMIQKFVKKIHLRT

SEQ ID NO: 2131 - protein, 284 aa, Arabidopsis thaliana
  misc_feature (22)..(22): Xaa can be any naturally occurring amino acid
MSNITKKKCNGNEEGAEQRKGXWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQKQARQLNIDSNSHKFIEVVRSFWFPRLINEIKDNSYTNNIKANAPDLLGPILRDSKDLGFNNMDCSTSMSEDLKKTSQFMDFSDLETTMSLEGSRGGSSQCVSEVYSSFPCLEEEYMVAVMGSSDISALHDCHVADSKYEDDVTQDLMWNMDDIWQFNEYAHFNG

SEQ ID NO: 2132 - protein, 362 aa, Helianthus tuberosus
MESGGDGGGTSSCLMSFGDTNNNINNSSSNNNNSNNNIGSLCLPPNPPGAYNTTTNNNNLIFSDHHPSAMMLEDNNININDGVGLAFMNPSSSVKAKIMSHPHYPRLLSAYLNCQKIGAPPEVVERLEEACRASVVAAMSSRSGGAGTSDGSGGGMNMIIGQDPALDQFMEAYCEMLIKYEQELSKPFKEAMLFLSRMESQFKAITFSNSDSGCGEGGMDRNGSSEEELDVDMNNGMVDPQAEDRELKGQLLRKYSGYLGSLKQEFMKKRKKGKLPKEARQQLLDWWTRHYKWPYPSEAQKLALAESTGLDQKQINNWFINQRKRHWKPSEDMQFVVMDAAHPHYFIDNIFGNPYPMDVSLL

SEQ ID NO: 2133 - protein, 646 aa, Selaginella moellendorffii
MEDMDMLEAVYERKSRMIPVGPQPSVGGGDFQQPMMQWKEEEESAMGMDELLAHAGYNVRASDLTHVAQRIEELDSLLGAAAPADILAQDTVHYNPSDLVSWIEGMLDELVPQQPTATSSSDMESVVTTITHQQQQHLDFGGIPPPPPHQQQGYGAAFNPNVLYADQMDLSKNEVGVVASHSQIAASTTPRPASGSSSSTSPHGIPPHAAGGMTSAAAMPTIQESDELSGVRLVHLLLACANAVQRGDLAAAGDMVAQLRILVAHPSSSSSAMARVATQFVEALSRRIQNSCYNGGGDRQYHHHQSQQQQQRQQQFKEESSDPGNTNNGAMDEILHFHFYETCPYLKFAHFTANQAILEALEGHKSVHVVDLDLQYGLQWPALIQALALRPGGPPTLRLTGIGPPQPHRHDLLHEIGLKLAQLADSVNVDFAFHGVVAARLNDVQPWMLTVRRGEAVAVNSVFQMHKALVEEPSDGGNPAAGGNGGGGRRSSPIDEVLRLVRNLKPKIVTLVEQDADHNSPVFMERFMAALHYYSTMFDSLEACNLAPGSVEQMVAETYLGQEIGNIVACEGAARTERHETLTQWRIRMARSGFQPLYLGSNAFKQANMLLTLFSGDGYRVEEKDGCLTLGWHSRPLVAASAWECC

SEQ ID NO: 2134 - protein, 240 aa, Magnolia praecocissima
MGRGRVQLKRIENKINRQVTFSKRRMGLLKKAHEISVLCDAEVAVIVFSTKGKLYEYSTDSRMSRILERYERYSYAERELVLSGPESEGSWCLEYGKLKAKVESLQRNLRHFTGEDLDTLSLKELQQLEHQLDAALKHIRSRRPIMLIHCGASKKEKSLREQNNMLEKEIQEKEKAMAQQAQWEQQNQSQSSHPSWLASPLPTLNIGTYHQGNEVEEEGARPPARTNSLMPPWMLRHVNE

SEQ ID NO: 2135 - protein, 806 aa, Zea mays
MPPAAMALPSQAPSNSGDPLYPELWRACAGPLVTVPRVGDLVFYFPQGHIEQVEASMNQVAGNPMRLYDLPSKLLCRVLNVELKAETDTDEVYAQIMLMPEPEQNDVAAEKTSSGSAAPPRPAVRSFCKTLTASDTSTHGGFSVLRRHADECLPALDMSQSPPTQELVAKDLHGMEWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSIGMRFRMRFEGEEAPEQRFTGTIVGCENLDPLWPDSSWRYLKVRWDEPSTIPRPDKVSPWKIEPASSPPVNPLPLSRGKRPRQNAPPPSPESSVLTKEGATKIDTDSAQTPHQNSVLQSQEQMSFRNNLTESTDSDSTVQKQMMWSPSPNGKVHTNFQPRPAMDNWMPLGRRETDFKDTRSAFKDARTASQSFGDTQGFFMQAYDDSRHRLSFNNQFQDQGSAHRFADPYFYMPQQPSLTVESGTRTQTANNDLRFWSERNSMYGNPSDQQQGFSFGQNTSSWLNQPLPQVEQSRVVRPHATVAPFDLEKTREGSGFKIFGFQVDTTNPSPVQLSSPLSAIREHVVQTRPSAPVNELQPVQIECLPEVSVSTAGTAAENIQQVQQSSKDIQSKSQGASTRSCTKVHKQGVALGRSVDLSKFTDYGELKAELDKMFEFEGELVSANRNWQIVYTDNEGDMMLVGDDPWEEFCNIVRKIYIYTKEEVQKMNSKSSVPRKEEPPAAGEGCAAAAANE

SEQ ID NO: 2136 - protein, 148 aa, Brassica napus
MSAVSESALISSLFHVSSPTRSSSSTSSALFFVLTTVLNSLRFCSKQRLVVEVPSLSMGVRPKRTHKRQRDFEVFESDMKKSVRGRKVRIIVSDPYATDDSSSDEWFECKPPKVKRIVHEINLPFQLSESSQYHKSCRRKAASMQLNK

SEQ ID NO: 2137 - protein, 203 aa, Brassica napus
MATETELEPQQSPMAEEQQPSPFSLPPYPQMIMEAIEASNDANGCNKTAIAKHIESTQTSLPPSHMTLLSYHLNQMKQSGQIAMVKNNYMKPDPQAPPKRGRGRPPKAKPQGESSHVAVPAPSVSSPRPRGRPPKAKGPSSEVETKVAAPSGSGRPRGRPPKKQKTESEAVKADVEPAEAPAGERRGRGRPPKAKPAMVPVGC

SEQ ID NO: 2138 - protein, 118 aa, Glycine max
MNNSIPGWDFESDTCLTNQRKLIGPDQELVELLWKNGQVVMHNQTHRKTLGNSSNLRQVQKSDQSVLKSNGPYGNSSNLDQEDAVPWVQFPLEDPLEQDFCSNLFSELPTCEFESYKP

SEQ ID NO: 2139 - protein, 404 aa, Larix x marschlinsii
CVTRHFFPLHNGEPSQILMPMPTECTGGDPLTKSHWTPLTSRQSESSETRIKQAENNKPVKKSRRGPRSRSSQYRGVTFYRRTGRWESHIWDCGKQVYLGGFDTAHAAARAYDRAAIKFRGVEADINFTLSDYQEDLDQTGKLSKEEFVHILRRQSTGFSRGSSKYRGVTLHKCGRWEARMGQFLGKKYIYLGLFDNEIEAARAYDQAAIRCNGKEAVTNFDPSIYQNDILTEGDSASFDQNLDLSLGISAPTVLDTLVSGDNKIGGLKMKTRENILVEPDWKKTRAISTPEDRSQQIQLEVPLSYGQLGQYVGLQDRETFSSQGKLTPFTFLPQYQIHHPNSEKIQVTDTLIYNPLNFFPNPYEDTRHLALEQQLWSRDCPLPFPFPNYKLHNPTGGLQGQGR

SEQ ID NO: 2140 - protein, 238 aa, Picea glauca
MEHLNTAAAQASSSLYGVGMAEYGDAGVSSMMALITQHEPHDSESIMSTRMPSSFSSFHGHADCLLSAAMFQAYQGDHKLKRQPGMDQLVSEQPGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 2141 - protein, 398 aa, Zea mays
MVKTTTTTNKEELESPSYRLAAFKSLFSCRNSHARPRAPDTGTGSRSKRLGCSAPSICKLKDDSVPVPPKETTGTASAGEPCKRRASVSGSSDRCVKKPQCGAGSNKQLQRGGSSSSSGGSSFRAGMQLRRLSGCYECHMVVAGSASMRATTICPCPDCGEVFVRQESLQLHQSIRHAVSELGTDDTSRNIIEIIFQSSWLKKQSPVCKVDRILKVNNTPRTLARFEEYRDAVKARAGAEQLAVAAANSNRHPRCTADGNELLRFHCATLACSLGLNGATHLCDAAGTCAACGIIRDGFSSGGVLTMATSGRAHDAAEAGAGLDEETTPRAMLVCRVIAGRVKRPKEAVPEEEAVADAAEESEYDSVAGSAGVYSNLEELLVFNPRAILPCFVVVYKA

SEQ ID NO: 2142 - protein, 347 aa, Zea mays
MDGLHTDLALGLLGCGGVGVGSSGRGEQLQTAPFVAKTYQMVCDPRTDALVRWGSENNSFVVVDPAGFSRLLLPCFFKHRNFSSFVRQLNTYGFRKVHPDRWEFAHESFLRGQTHLLPRIVRRKKRGEGACTSSGGDAQAQYAAAAAGCCISMGGEDHRTEGEAEAAVLEEVQRLRQEQTAIGEELAQMSRRLQATERRPDQLMSFLARLAEDPDGVTRHLVEQAAEKKRRRMMQLASQPVRRLPPPPPPPPVLHHPLLALGGAAAAAAKGLDGGCQWAEQKKPSVVLTAAFDHPAASYCGAQHAVPNLGGGNGGGGINGMGLTADETAVETTTTPFPFCLLGQGFF

SEQ ID NO: 2143 - protein, 243 aa, Triticum aestivum
MGRSPCCEKTGLKRGPWTAEEDITLVAHIEQHGHSNWRALPKQAGLLRCGKSCRLRWINYLRPDIKRGNFTSEEEDAIIQLHAMLGNRWSTIAARLPGRTDNEIKNVWHTHLKKRLDSSSSKTSGQAAPKRKAKKPVAAASTADGPASMPVSSPEQPISSSATDYSMPSSLENTRTLTSEEFQIEDSFWSETLAMTVDSSGSAMEAGVTLGADSASPSSSNDEMDFWVRLFMQAGEVQSLSQI

SEQ ID NO: 2144 - protein, 240 aa, Asparagus officinalis
MDQPDLSQVGPVGLTQLSPLQIQQIQAQIQLNHQHQLMVSRTLQARNYHNTLGVKPQPMKLQASVAAPQSKPTKLYRGVRQRHWGKWVAEIRLPKNRTRLWLGTFDTAEEAALAYDKAAYKLRGDYARLNFPNLKHTHLAGNPLHSSVDAKLEAICQTLESPGKKKVSTGSKPEPVVSSPTVETEEESSSSSSVTGATNSPVSEIESLDFNEVPWDETEDFVLRKYPSYEIDWDSILSSA

SEQ ID NO: 2145 - protein, 244 aa, Solanum lycopersicum
MGSPQETCTSLDLIRQHLFDESLDQTCFSFETTQTSNLDDIASFFNATSKTEYDGFFEFEAKRHVIHSNSPKQSNLRERKPSLNVAIPAKPVVVVENVEIEKKHYRGVRQRPWGKFAAEIRDPNRKGTRVWLGTFDTAVDAAKAYDRAAFKLRGSKAILNFPLEVANFKQQNDETKTETKSSGSKRVRGETEELVIKKERKIEEERVLPTAAAPLTPSSWSTIWDEKGIFEVPPLSPLSQLVMI

SEQ ID NO: 2146 - protein, 629 aa, Triticum aestivum
  misc_feature (272)..(272): Xaa can be any naturally occurring amino acid
MVVRKRLDYGSRGHQVPAMPRVPSSARGKRSARRKKDEMSPFDLLATVAGTLLVDHENSSNAPSINAAALTYARKRKSVKAEQCDDVPPLKSIAVENCIAGSGGVCASPRQANICLAENSSTRNGTDPVLESLTVKPDMLVRDSVFSCTKSCNRAHGVGGIPECGSSRSLEATNQVQVQQPMDGDTTALYSLVSSVDLDGRPPALVSSDSSSGVPLCIHEKDRTTSPLCHAEARHAADRDDDENSSGCTHPCTTGNNKSYMPQYTGDTRIRXMFASKIRKAARNKMCGEMSNKGSKLNLCGKKISTTRQRVQRAMFKRQKPVRRHFTPSSAKGILTEVKLRIKSFTIPELFIEIPENATVGSLKRTVMDVVTSIIESGLRVGVLLQGKSIQDDNKTLRQARICHGENLENIDFTLECEAGQNSSPGVRIPEEMDFHGADAMKPLAMVKCEEPFSETKAGYNSQQRVQASPNRVQSEHGSVHSLFETTAHEASASSQAIVPVASPSSEALAIVPVCKSKRPVIGQRRIRRPFSLPEVEALVEAVEQLGTGRWRDVKMLAFDNTDHRTYVDLKDKWKTLVHTASISPQQRRGEPVPQGLLDRVLAAQAYWSQQQQQQLSGKASGQGCSSSC

SEQ ID NO: 2147 - protein, 181 aa, Helianthus annuus
MSLQQVPTTETTTRKNRNEGRKRFTDKQISFLEYMFETQSRPELRMKHQLAHKLGLHPRQVAIWFQNKRARSKSRQIEQEYNALKHNYETLASKSESLKKENQALLNQLEVLRNVAEKHQEKTSSSGSGEESDDRFTNSPDVMFGQEMNVPFCDGFAYFEEGNSLLEIEEQLPDPQKWWEF

SEQ ID NO: 2148 - protein, 425 aa, Oryza sativa Japonica Group
MDMEHELRGGGVGAAAHGHGSICFSGGPVLVDGRRIQQLLLHCAAALESNDVTLAQQAMWVLNNIASSQGDPSQRLTSWLLRALVARACRLCAAAPAGAAVEFLERGRAPPWGRAMSVTELADYVDLTPWHRFGFTASNAAILRAVAGASAVHVVDLSVTHCMQWPTLIDVLSKRPGGAPAIRITVPSVRPAVPPLLAVSSSELGARLAIFAKSKGVQLEFNVVESATTTSPKKTSTTLCQELASVLSDPPSLGLRDGEAVVVNCQSWLRHVAPDTRDLFLDTVRALNPCLLTVTDEDADLGSPSLASRMAGCFDFHWILLDALDMSAPKDSPRRLEQEAAVGRKIESVIGEEDGAERSEPGARLAERMSRKGFAGVVFDEEAAAEVRRLLSEHATGWGVKREDDMLVLTWKGHAAVFTGAWTPN

SEQ ID NO: 2149 - protein, 396 aa, Oryza sativa Japonica Group
MVGGGRERNGGVRQYNRSKVPRLRWTPDLHHCFVHAIHKLGGQDKATPKRVLQLMGVGGLTISHVKSHLQMYRNMRNDLGMQGIQVQQVDQEHTYGGGVEVWTDMQQCDHDECDVPCCSCHSPKPRKEPLLHLQLKSSGMNIDEPGTRARIAAPNVRSCRDDAAASATETRRRRGGRPEEVDDDANASTSPRISQLQLLRLRGHGIRESDMSPSTSLQCYYVRSQRTTTMPPGAAAAAAGGDGGSQCYAAPRYSSSSKLKFLGFVVTSGPPPPRLPPPAACCCGSDDNIPFQVGTFAPHRVAPPTASCGGGGGGGRAEAPPSSSYRSVWFEPAAAAAASNNGVAPDGEHDDGCSLSLSLALDTGCAGAGGSLVSSTTSSSSGSRISLDLSLSTLDS

SEQ ID NO: 2150 - protein, 337 aa, Zea mays
  misc_feature (292)..(292): Xaa can be any naturally occurring amino acid
MAAAIDMYKYYNTSAHQIASSSSPSDQELAKALEPFITSASSSSSSSPYHGYSSSPSMSQDSYMPTPSYTSYATSPLPTPAAASSQLPPLYSSPYAAPGMAGQMGLNQLGPAQIQQIQAQFMFQQQQQQRGLHAAFLGPRSQPMKQSGSPPPLAPAQSKLYRGVRQRHWGKWVAEIRLPKNRTRLWLGTFDTAEDAALAYDKAAFRLRGDTARLNFPALRRGGAHLAGPLHASVDAKLTAICQSLSESKSKSGSSGDESAASPPDSPKCSASTTGGEGEEESGSAGSPPLSXPPPTLAPPVPEMGKLDFTEAPWDETEAFPLRKYPSWEIDWDSILS

SEQ ID NO: 2151 - protein, 158 aa, Chlamydomonas reinhardtii
MVAHQTQQVQQPPPLAAAAGAAANARAAAAAAADDVSTDDEKPARGRGGKGGGRAGGGGVLTVEGPQGQVLKLKPGAAAKRSRGAVHYRGVRQRPWGKYAAEIRDPLKVSGGRMWLGTFDSAEEAARAYDEAARMLRGSAALVRGCLRVHSRCGVLAV

SEQ ID NO: 2152 - protein, 875 aa, Physcomitrella patens subsp. patens
LAVERRSLNSELWHACAGPLVSLPPVGSRVVYFPQGHTEQVVAASTQKEADAHIPNYPNLPSRLVCLLDNVTLHADLETDEVYAQMTLIPVLPANEKEALISPDIGMRSRQPTEYFCKTLTASDTSTHGGFSIPRRAAEKVFPPLDYTQTPPAQELKARDLHDQEWHFRHIYRGQPRRHLLTTGWSVFVSAKRLQAGDAVLFIRDDKGQLQLGIRRQNRQQTVMPSSVLSSDSMHIGVLAAANHAAATSSRFTIFYNPRQSPSEFVIPVAKYQKAICSLQVSVGMRFRMVFETEESSVRRYMGTITGMGDLDPIRWPNSHWRSLKVGWDESTAGERQRRVSLWEIEPLTTPFLLCPPPVAFRTKRPRGGRDSTSKKSSFWSGDEDTGVLGGLNFRNLSMDSWMRPQQPGLPTQQNEYYRALAAAALQEFRTPDCSKHPTSRSQPSISPQMQFRSQPQMQSGHHGVQHVSEACGPLLQLSSSRPQSPLEVGMNMPQCSGYSEEDIQMASSPSASGSYPLHSMLGRTHLGCETGQVGLMMRPTQNAQQSQSGPILHGGKTSPYFFFRTIPISLRINCANVLQVSSSWYPSNRDPNQHDVSARMNQLDTSPTSRVSGSFSLSQQSEGNGQSGLTGMPVPASSFMFRESGQEQDSVQSDRHLLFGVSIEQQPLGASNPVASIHSQSYPKNKDVHNRFSGNNMLQGSYCSSTMPDISTMNGVGLDENGMCQRGAPWATMSPAPVRTFTKVHKLGSVGRSIDVQKFQNYSELRAELARLFNLDNLLDDPQRTGWQLVFVDNENDTLLVGDDPWEEFVNYVRSIKILSPNEIQQMRQEQLEILNTVPMQQRPTCSNSEDARTQTSPPNTSTLSLEHGHSGPG

SEQ ID NO: 2153 - protein, 295 aa, Oryza sativa Japonica Group
MSGEYQFQDELAPLFARPGGGAGEMQMLPSSWFADYLQAGTPMQMDYDLMCRALELPVGEDVKREVGVVDVVAAGGGGAPPLTPNTTSSMSTSSSEGVGGGGGGGAGAGAGEEESPARCKKEEDENKEEGKGEEDEGHKNKKGSAAKGGKAGKGEKRARQPRFAFMTKSEVDHLEDGYRWRKYGQKAVKNSPYPRSYYRCTTQKCPVKKRVERSYQDPAVVITTYEGKHTHPIPATLRGSTHLLAAHAQAAAAAAAAHQLHHHHGHHGHHGMAPAVAGWAPAPPRSSAGRPASTC

SEQ ID NO: 2154 - protein, 624 aa, Chlamydomonas reinhardtii
MVDGGSRAASGQLDDWAAGVAADLDQGEGDRAGARRRPARDASPAPDARKVTTFTNKKRPASDRDSSPEEDDEEQAQKGSLKADGTRPKLPRPDKKEACPRCNSMDTKFCYYNNYNIKQPRFYCKTCQRYWTAGGTLRNIAPGSGRRKSKSKAAREKNSPSLAEQLTAVAAGQGMFGLGGGGGYNGISPALALAAATDPTGLLAANSAAAYGLGGHGTISGLKLGGVGGLPAQFNSELALREHLAGQHSLETRLLLNGHLSAEDLPNGMSAAALAQASAQLHALHGQGSGIAQSLAAGNGHTGSPSPSPPPAGNGGQQHPLSSSPQHGGGSQASQQPSPPQQGSDDAEGGGEERYVAQGRRVRVKAELDGNAVSSSLAMGGGGGSGAYANGASIASSIANAQLAASLSMPPSMGALAAVMGPGGGPSGLHPLLAQDNGGSLLDAGLTRQQLLVLQQHQAMQQAQQQESLQQLSSLQQLQGLAALHGQHSAAGLAGLDPLQRSALLHSAAGLGGVGVGGWLQGGGGGNSLAAAAALESLQAQHLLQAQQVHPSAAAALIGGGGSSAAAQMLQAQAAAAAAGGGGGWQGVASAANWPSAWSSYSGPSSGSYAGYALQAAAAYSGAR

SEQ ID NO: 2155 - protein, 243 aa, Zea mays
TQSAGAAAMEEHQSAAALSSQEGPETPRRRYRGVRQRPWGKWAAEIRDPHKAARVWLGTFETAEAAARAYDEAALRFRGSRAKLNFPEDARLYPASTAGAAAPLAAAASTSPPVYSGGVQGSSDYLRYHQMLLQASTGSQGTLLPFYGGGMSNPYGGGAAMTGSYGGAGGGNTSGSLGSYYSFPASSVSVATVPSSTSSASGYYYSSPHDSQHSEASAAADWNWESALAWPDSSQYPPPPHTQ

SEQ ID NO: 2156 - protein, 274 aa, Medicago truncatula
MGLSSKQVSSRGVDWNQTLLQDQNLELPKTLPMRKQQQQNHQLEAVNCPRCDSTNTKFCYYNNYNKSQPRHFCRACKRHWTKGGTLRNVPVGGVRKNKRVKISTSISTTSKTTISTSFTTTSNANRLNKKNTPSSMHESLIHPPSFLPPQNLISTKDQSEGNNEEFGIGNGMFLSSSMPFHQNQSFIFPFSNSSTLRSNNGYNYGDEEFKIMEESTINNSAMPSTSGSGTITQPWEIPATSSGMDMSNYWSWEDIDSLVSTDLNVPWDDSDIKP

SEQ ID NO: 2157 - protein, 205 aa, Brassica napus
  misc_feature (75)..(76): Xaa can be any naturally occurring amino acid
  misc_feature (141)..(141): Xaa can be any naturally occurring amino acid
MEEREGTNNVTSFGLNQQQQQQQHEAAASSAAAYPMDPPRPDNPNPFSAPPITSSSSAAAAVENAAPQFSLTMPXXETGSSEQKKKRGRPRKYNPDGTLAVTLSPMPISSSVPLSSEFPPRKRGRGRGRSSRWLKKSQMFXFDRSPVVTNFAGAGVAAAADFAGANFTPYVLTVNAGEDVMMKIMTFSQQGSRAICILSASGPIS

SEQ ID NO: 2158 - protein, 249 aa, Ipomoea batatas
MVISSVWSESSSRVRKGAWSEEEDQLLRDCIQKYGEGKWHLIPLRAGLNRCRKSCRLRWLNYLRPDIKRGHFSVDEVDLILRLHRLLGNRWSLIAGRIPGRTANDVKNFWNTHLQKKVSAMASSRQDSYWKGKAPEITENTVVRPRPRRFLKASSSPTTLLTENATKVVGYDGQLQGHMTTQPETTSNLLMENFQQKNLTTTLPSALETTPHDNVKWWEDVLSDKELNDEGQICWSEFSTDIDLSELLS

SEQ ID NO: 2159 - protein, 399 aa, Solanum tuberosum
MAPKTKSRLVDQPPSASSSEEQELVEESQEEEEQQSREEEGEEESGEETEEDEEPKTAHPVVKKPISQKLVQTPQKPQFSSESGSENGSGSDSEAESGNSLPSPSASDFTVKPNVAAKAATPSKPAAKRPQEAQKEKGKKKPKIAEEEEKKSPATPRSLWSDDDQLALLKGILEYKTVKGMEPSADMSAFHEFIRGKLQAEVSKSQISDKVRRLKKKFLTNVKDGEEPVFKKGQDFLIFEHSKRIWGAPGISNGGVKDNVNNTSNGKAKKTVEVKKSSEPKKSAKVSKPKDDEKQKEEEQQVAVKEVVKEDIVKGDQQDFQSKYPRLAASLETMSGLSTMYPNGSSLLKENMSLIATDKAKVLEEKWKKLEDDEAALMVKRLDFIAEHYRLVVDAMRGN

SEQ ID NO: 2160 - protein, 249 aa, Ipomoea batatas
MVISSVWLESSSRVRKGAWSEEEDQLLRDCIQKYGEGKWHLIPLRAGLNRCRKSCRLRWLNYLRPDIKRGHFSVDEVDLILRLHRLLGNRWSLIAGRIPGRTANDVKNFWNTHLQKKVSAMASSRQDSYWKGKAPEITENTVVRPRPRRFLKASSSPTTLLTENATKVVGYDGQLQGHMTTQPETTSNLLMENFQQKNLTTTLPSALETTPHDNVKWWEDVLSDKELNDEGQICWSEFSTDIDLSELLS

SEQ ID NO: 2161 - protein, 254 aa, Zea mays
  misc_feature (206)..(206): Xaa can be any naturally occurring amino acid
MPEGDQVSSSSSRSRQASSGGTSSSPPWSPAGKKAGAAEKRARARETTTDPPSSYRGVRMRAWGKWVSEIREPRKKSRIWLGTFPTPEMAARAHDAAALVVKGPAAVLNFPDMAAALPRPASASPRDVQAAAARAAAMEMEPAAALHEPPDGPADEAAALQMQPAAAAPPAGGQQQDEELEAIVELPRLDEDCAVATLGATPLLVXSFHDVLAPAPWWVDDAAGYVAAAHDVDLFGLDGDHGWAQSVGALLWNL

SEQ ID NO: 2162 - protein, 203 aa, Zea mays
  misc_feature (77)..(77): Xaa can be any naturally occurring amino acid
  misc_feature (92)..(92): Xaa can be any naturally occurring amino acid
  misc_feature (120)..(120): Xaa can be any naturally occurring amino acid
MGHEGSCRCELCGAPAAVHCAADEAFLCAACDAKVHGANFLASRHRRTRLRLAAAGPPPPDDEAGYGSAASSCVSTXDSAPRPRRGARAPAXSVRPEAVLEAWAKRMGLGAGARRRVPPXVAMAAALWREVAGRGGTGGGGHGHGEALRRLEACAHVPAGLVVAVAKSMARARGRGDEADTDAAAEGWDECAWAGPKSSPPRP

SEQ ID NO: 2163 - protein, 249 aa, Ipomoea batatas
MVISSVWSESSSRVRKGAWSEEEDQLLRDCIQKYGEGKWHLIPLRAGLNRCRKSCRLRWLNYLRPDIKRGHFSVDEVDLILRLHRLLGNRWSLIAGRIPGRTANDVKNFWNTHLQRKVSAMASSRQDSYWKGKAPEITENTVVRPRPRRFLKASSSPTTLLTENATKVVGYDGQLQGHMTTQPETTSNLLMENFQQKNLTTTLPSALETTPHDNVKWWEDVLSDKELNDEGQICWSEFSTDIDLSELLS

SEQ ID NO: 2164 - protein, 359 aa, Zea mays
CAVAAPCACCRQSLGLVKPMEEMLMAASAGAANPSQGSNPNPPPPAAPLTGAGSTERRARPQKEKALNCPRCNSTNTKFCYYNNYSLQQPRYFCKTCRRYWTEGGSLRSVPVGGGSRKNKRSSSSSSSAAAASASTSSSATSSSMASTLGAASKSPELAHDLNLAFPHHGGQHAAEFPAFPSLQSSNDMCDPGGGMTSNGRGGGAGPAVGALSATELWRSSGCYMPLQMPGDYTAAGFALGEFRTPLLPDAHGPGSSGAAAAAGYGCSAGLPQGVPDNAGRLLFPFEDLKPPVSPGGGGVAGGGASATGGAGDGNSSHDQFDHNKEQGGGGSPGAGAGHDTAGFWSRVYNFGRKFPKFS

SEQ ID NO: 2165 - protein, 486 aa, Saccharomyces cerevisiae
MSEQKEDLFKPVGEAAAEVEDESIAEQNKANDGVKLTGAQDAMGHPVQEIESLCMNCGKNGTTRLLLTSIPYFREIIIMSFDCPHCGFKNCEIQPASQIQEKGSRYVLKVECREDFNRQVIKSETATCKFVELDIEIPAKRGQLTTVEGLLSEMIDDLSQDQEMRKSIDEALYKKIDDFIQKVKSYINCEPNTIPITFILDDPAGNSWIEYKPGEPQHKWSHTQYVRTDEQNVQVGIITRDQLEQRRQEQLKQLANRERNPSESVKVGSANPQFLSDATDIENFNNEVQTFRASCPSCTQECETHMKPVNIPHFKEVIIMSTVCDHCGYKSNEVKTGGAIPDKGRRITLYCDDAADLSRDILKSETCSMVIPELHLDIQEGTLGGRFTTLEGLLRQVYEELESRIFTQTSDSMDEATKARWVEFFAKLKEAIAGKVKFTVIMEDPLAGSYIQNVYAPDPDPNMTIEDYERTKEQNEDLGLSDIKVE

SEQ ID NO: 2166 - protein, 80 aa, Brassica rapa subsp. pekinensis
THQFFPEMESSVGDNGGGGTGPGFPRSHWFGVQFSQSDLATGSSVGKPATVGAVVEPTQPLKKSRRGPRSRSSQCRGVNH

SEQ ID NO: 2167 - protein, 333 aa, Vitis vinifera
MSLSPPRERNNGDRTYQFYWCYQCNRSVRIASDNPSQIICPRCLGQFLQEIDTTRPRAFNEIITWDPFPEARLLEALSLVLDPPLRGLNNGVGRGDEAETEAARNRGRRWLRRRSHSREHWEAEADTGVPGRRRNNELGGRLGWPFGNGLGAQGRTWIVLRPTGPPGQNGPFPQSENMRPPRFELRDFFSGPGLNELIEELTQNDRPGPPPAPDSAINAMPTVKITPTHLINDSHCPVCKEEFKVGEEVRELPCNHVYHSDCIVPWLQLHNSCPVCRHEVPVPSDESDESHEGEDRRVRCMRLRQLASLWPFRSRYRRINPQDRDVTPHRGES

SEQ ID NO: 2168 - protein, 335 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKDFANTISALG

SEQ ID NO: 2169 - protein, 439 aa, Oryza sativa
MTSSSPANSSVTCGGCRHLPPPSGWIWEGRPTSSVVPPPTPLPSVCAAADPSVCAVADTPPLRRIWEERGNDAADGGPLKWSAGKTTDFHRRMTKIHLGSYFRRRIFGSEELPPFHEVAKIDPLEHVFAKAPPSRPHHDKYPPDASPFQPYSAASEQPPPFQEHTTQEEQSSSDQSREGASTMGRAPCCEKMGLKKGPWTPEEDKVLVAHIQRHGHGNWRALPKQAGLLRCGKSCRLRWINYLRPDIKRGNFSKEEEDTIIHLHELLGNRWSAIAARLPGRTDNEIKNVWHTHLKKRLDAPAQGGHVAASGGKKHKKPKSAKKPAAAAAAPPASPERSASSSVTESSMASSVAEEHGNAGISSASASVCAKEESSFTSASEEFQIDDSFWSETLSMPLDGYDVSMEPGDAFVAPPSADDMDYWLGVFMESGEAQDLPQI

SEQ ID NO: 2170 - protein, 208 aa, Vitis vinifera
MFWIVCLLKKYKGVRMRSWGSWVSEIRAPNQKTRIWLGSYSTPEAAARAYDAALLCLKGASANLNFPTITSSYHLPDTLLSPKSIQRVAAAAANSFADNAAAAATTTTTTPTTPTTPPSPPPPSSSSSISSASTSSSPSDQLDDDVSVLMSSMANEPMSMMASWYDNFDSLQSPKYMDQMFSNCALFNPVPTIEDDYEEGDIHLWNFC

SEQ ID NO: 2171 - protein, 374 aa, Zea mays
MAMPPKPGDPPQRSPARSPNLNLPCPLPPVPGGAPPPPQQQPGAGLPPPRVGHHRRARSEVAFRFPDDLPGGGGGGFDEIGSEDDLFSTFMDMDKIAGADRDRAAETSSPPRPAKHRHSVSFDGFGMGAAAGGPGGQQDGGGGMFGEVMEAKKAMSSEQLSELAAIDPKRAKRIIANRQSAARSKERKARYITELERKVQTLQTEATTLSAQLTLFQRDTTGLSAENAELKIRLQAMEQQAQLRDALNDALRQEVERLKIATGEMSKSNNEHFNMGMQHVSYSPSFFQLSEQHTMQQHGNIQLPHHFQQPPLTVPSHQMLSHPNSLSNMVQQDSLGRLQGLDIGKGSMAVKSEAEVVVKSEGSSISAGESNTTF

SEQ ID NO: 2172 - protein, 427 aa, Arabidopsis thaliana
MATSASALLSPTTFSTAISHKNPNSISFHGLRPLRLGGSSSALPKLSTTGRKSSSTVVRAELSPSIVISLSTGLSLFLGRFVFFNFQRENVAKQGLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 2173 - protein, 237 aa, Triticum aestivum
MVTVREETRKGPWTEQEDMQLVCTVRLFGERRWDFIAKVSGLNRTGKSCRLRWVNYLHPGLKRGRMTPHEERLILELHARWGNRWSRIARKLPGRTDNEIKNYWRTHMRKKAQERKRSVSPSPSSSSVTYQSIQPQTPSIMGIGEQELHGGSSCITSILKGTPADMDGYLMDQIWMEIEAPSGVNFHDGKDNSYSSPSGPLLPSPMWDYYSPEAGWKMDEIKMAPQVSYSKGIGPSY

SEQ ID NO: 2174 - protein, 226 aa, Malus x domestica
TVTRQFFPVEQDSSPNFDVMGSATGGGSIPPPPSTTSSFPRAHWVGVNFGQSDSGSPGKPPPTAEASHQPMKKSRRGPRSRSSQYRGVTFYRRTGRWESHIWDCGKQVYLGGFDTAHAAARAYDRAAIKFRGVEADINFSIEDYEEDLKQQMSNLTKEEFVHVLRRQSTGFPRGSSKYRGVTLHKCGRWEARMGQFLGQKYVYLGLFDTEIDAARAYDKAAIKCNG

SEQ ID NO: 2175 - protein, 228 aa, Oryza sativa Japonica Group
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEGQSSESVMTALHSGSSQSQDNDDGSDVSLKLGLPCGAWK

SEQ ID NO: 2176 - protein, 277 aa, Zea mays
MSSGEDGYCSSDSPRAESPDQPQAAAAADADADAESPRAGAGPNKRDLHASSPAAKRSRRSVEKRVVSVPLAECGEGPPPSDSWAWRKYGQKPIKGSPYPRGYYRCSSSKGCPARKQVERSRADPAVLLVTYTFDHNHEAPRPKSSCCHQQGRPPAPKPDEPVAEQEDELGPEHEPEDEQEPEQKVVPGLAGPETAPATATLAPVAEEDESFDLGWFDQYPTWHRSALYAPLLPPEEWERELQGEDALFAGLGELPECAVVFGRRRELSLAATAPCS

SEQ ID NO: 2177 - protein, 371 aa, Triticum aestivum
MDSTTNQFAGAAAAAGASSANTAPLPAMLADALIGAGAGGGDGDPSAALQRLAALGDRMAAVRRLLVASISGESQPLSSSDIQSVSSEISSAAHLVVLNAASLLSSSLPFPAPSATPAPPAPIQELPAAASTADVLPQEATKGYDVVELDADELLAEHAHFCNICGKGFRRDANLRMHMRAHGDRFKTLDALSRPGQAKPVDGRDVRFSCPFTGCNRNRAHRRFRPLKSAVCARNHFRRSHCPKLYACERCGGKKRFAVLADLRGHLRHCGEEAQWRCSCGTTFSRKDKLFGHLALFEGHMPAMSPPNKDAVTTTTEAPLDIMDEGGIEEQEDGGEGGFDPEFFKEWMEELKDDGVPAGGTVWPGRAAAGQ

SEQ ID NO: 2178 - protein, 88 aa, Vitis vinifera
MDRRRRKQAKTHSSCCSEEVSSIAWEFINMTEQEEDLIYRMYKLVGDRWALIAGRIPGRKAEEIERFWIMRHGEGFAGIRKELKRYKF

SEQ ID NO: 2179 - protein, 239 aa, Phalaenopsis equestris
MDSSSMEPKEKMGRGKIEIKRIENTTNRQVTFCKRRNGLLKKAYELSVLCDAEVALIIFSTRGRLYEYANNSVKGTIERYKKASTDNSNTGSISEANSQYYQQEATKLRQQITNLQNSNRNLLGDALTTMSLRDLKQLETRLEKGINKIRAKKNELLHAEIDYMQKREMELQTDNMFLRNKISDNERAQQQHQHMSILPSTSTEYEVMPPFDSRSFLHVNLMDPNDRYSHQQQTALQLG

SEQ ID NO: 2180 - protein, 344 aa, Oryza sativa Indica Group
MGRGRAPCCAKVGLNRGSWTPQEDMRLIAYIQKHGHANWRALPKQAGLLRCGKSCRLRWINYLRPDLKRGNFTADEEDTIIKLHGLLGNKWSKIASCLPGRTDNEIKNVWNTHLKKRVSQREKPGDTKKKGKAADASDDADAHSPSSSASSSTTTVANNNNSGDTAGEQCGTSKEPENVDVSFFEQDIDISDMLVDAPTEAPLVAAPMPPSPCSSSSLTTTTCVGAVSDELLDLPEIDIEPDIWSIIDGYGGDEPVVSGADGDATVPCTASPGEEGAEWWVENLEKELGLWGPMDESLAHPDPPGQVCYPGPLTETEGDPVSTYFQSGPTASPLQEIASPAVLS

SEQ ID NO: 2181 - protein, 505 aa, Vitis vinifera
METFFSKKAGSLSSPFFEESKNRNPKYRVSRAANSPAAAMKAELRGNPPPISLQNSSLFNTPQNSLSGALRGCLGSLDGACIEKLLLHCASALESNDVTLAQQVMWVLNNVASSMGDPNQRLASWFLRALISRASRVCPTTAMNFSGSSGLQRRLMTVTELAEYVDLIPWHRFGFCAANSTIFNAIQGCPRVHILDFSITHCMQWPTLIDALAKRPEGPPSLRITVPSFRPPVPPLLNVSSEEVGLRLANFAKFRDVPFEFNVIEDSSSSTMGEMISRESSSLYSESLLNHLNASMLDLRDDEALVVNCQNWLRYLPDDQKGRAQNVSLRDTFLEVIKGLNPRILVVVDEDADLGASSLTSRITTCFNYFWIPFDALETFLPKDNHQRIEYEADIGHKIEDIITYEGLQRIERLESGPKLSQRMKSSGFLSIPFCEETVREVKFLLDEHASGWGMKREEDMLVLTWKGHNSIFATAWFPMRKNHIDFEIVLCTLKRRKIFKFEIK

SEQ ID NO: 2182 - protein, 431 aa, Oryza sativa Indica Group
MEASAAKEKDKGGKKMSRVGSWGSMAFYSSSSSSRSQPVSAAEGKNGGKKEKRRSSISRSITCVGSICSTKESSVSSRGRGRRRRSGGGGGGDGGGGGSTSSRSLMGPGYHGDSAAAVSASSSFNSVMTAATFATATTTTTTTTSSSATSPPSALSSPLSSIGGSFRAMQIRKLSGCYLHCHSVLDPRTLAAVFSCPDCDEVFVKPDSLELHRSTRHAVSELGADDTSRNIVEIIFQSSWLKKNAPVCRIERILKVQSSDKTIKRFEQHKEAVKEKARSAGDEAGRNPRCVADGNELLRFHCTTFACSLGLAGGTALCCASSSPPPLHCKLCSIIKDGFRVDGNGRITTMATSGRAHDTAEVSPDGEKRAMLVCRVVAGRVKKLHSSNSSEDHDCDSVSPCSEGVYSDLDELFVFSPRAILPCFIVIYSGY

SEQ ID NO: 2183 - protein, 126 aa, Triticum aestivum
CFLPDIGSSAKEHYPLSHHAKIFNLKGAVAIRLRCTRTGTADFVLEFFLPTNCEALEEQKAVLDSLSGTMRSACRTLRVVTDKEMGDEEMLEVNELNSFGPQGKNKVEELSLGNQATEHREEASWT

SEQ ID NO: 2184 - protein, 235 aa, Oryza sativa Japonica Group
MASKEPSGDHDHEMNGTSAGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEEEEAAAGGMMAPPPLMAGAADPLLFGGGMHDAGLAAWHHARPPPPPPY

SEQ ID NO: 2185 - protein, 399 aa, Arabidopsis thaliana
MEGETHQSEPLPLASGDSDEGISAAIEAELAELAAGDSSGGGGCGGGGGGIRSKVKGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLRRKYADLWNNGQWMANSVTTASVKNENVDETTNPPSSKQQLPQGDINSSPPKPPQVSDVVMEEAANEPQEPQEQQEQAPPVVSNVPTENNVFRPVARVGAFSIYNPTSQKNGYRDYNIVPCEGPLIQAAKPDSLAGKFLQSLCDEPQIPSKCGHGCSTLPAETKFSRNSVLGPEFVDYEEPSAVFNQELISIATDLNNIAWIKSGLDNAVVREAEQSLKMDNYNYNDPLIKFTGMMPRQDFFCARS

SEQ ID NO: 2186 - protein, 256 aa, Citrus sinensis
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLFKQIKEREKIFRAQQEQWDQQNQGPNMPPPLPPQQHQIQHPYMLFHQPFPFFNMGGLYQEDDPMAMRRNDLELTFEPVYNCNLGCFAA

SEQ ID NO: 2187 - protein, 264 aa, Citrus sinensis
MEAQASTELPPGFRFHPTDEELIVHYLRNQATSRPCPVSIIPEVDIYKFDPWQLPEKAEFGEKEWYFFSPRDRKYPNGTRPNRATVSGYWKATGTDKAIYGGSKYLGVKKALVFYKGRPPKGIKTDWIMHEYRLNDPTRQPYKHNGSMKLDDWVLCRIYKKRQTGSRSVLDAKVEEDQSCVDQLGKTGGYVEHANASDEQKLMVKFPRTCSLAHLVELEYFAPISQLLNDNTYNFNYDFQNGINNNAASDDQFEINFSQVTCTK

SEQ ID NO: 2188 - protein, 1827 aa, Oryza sativa
MDDVLPSGVGPNLLLGYLHRWDLMVTSNKKSIDEHISLLKWSSATDDKKTVVYLEMLEDKYSPRIDLQENGDDNVILGFGVENVSLFQKITVTVGPEQKEVAPQHILLYLTGEGKLNIYYLARISDPSELPQTKLSAIEDSDVMKEISPVTVSGKEFTPSATSSLDKSIRPDGAELSSVQPDRDLHGSTDMKNSSPVSKAKEIVASSPAPASFLAPASNLKPGISFSFSTANSVSLSPAGSNTSSELGSSWQQSSSSNFVNNQLGKGSIPSTQPVGAFGGSQNSKKDGNLSFNKSSVFTSDGSTLVKPGERNEPGFGSHPLQSSYTTDKKVPSSVGLSSKSSPSISPIKPSSAGPSSTGFRTGNLEAFPTSRGSPLPQESIDKPHDRTHAVVDHSKNFKLGAMFDTEQDLSKKFYSINDMTKELDTLLSYIEKDGGFRDACITFQERPLSMFEGDLQNFLELLQIFKNKIAEQCSRVEDLRNKMFQGTSTTRVSARQAYMKGIVDQSSDTQYWDIWNRQKLSPEFEAKRQNILKANQNLTNQLVELERHFNNLEMNKFGETGRVASSRRAIYSSKARSSQTQISSVYNALNSQLAAAEQLSDCLSKQISALNISSPSTKRGSVAKELFESIGLDHTMDAAKFSGGTPSKSVKRYPSTREHITSISGPSKTAEPETARRRRESLDRSLASLEPQKTTVKRIAQQQRLKISSDLPFRSNKKIFDSQMAAMSQEKSSSSPTSSIVESYANKLHYPSEVLHEKTKPSGPQHNTLFKWVKESAGPSQGPQHKYPELPGQLKSSDQTPKLGSSSPLSFSYSHKDVWDNISSSNVPSSGTTHTMPKSSTLTFKTTVIPKTNTSTLPDLSPLMTGSKFSLSPLTVKTLSGDSGGASSIITKNKQGGQAMPYLGTTKGLDVSPQNMGGAFRDLNKPSLSPEPPKSALLQGKTVQLGKITETVQSPVKAKPEVAFQPPAFPPTPVAQSSPCSIKPTVPSSATSSSSTMQESAAKTSDVLSPTGPSILPSKESMTKPSSPLPDGTISSSLLSIPMPVKESSTGLNKIVSKPEVVTSEVTGTTVSASTSSSVPITEGKPSSIPATSGSLPSIPVSAPKVVPVSAESVVVTSTGKDVGPSNPSSDEDDMEEEVPSASSDLNLGALGGFGLGSVPSSSPPKSNPFGNSFTTSDNKSSGSSFTLTTSPGQLFRPASLSIPSSQPAQSSQSTSSSTFSSAFSSGLSGFGQSAQIGSAQQSGFGQPSQIGAGQQAGFGQPAQIQSGFGQPAQVGVAQQSGFGQPAQIGTAQQSGFGQPAQFGAQQALGSVLGSFGQSRQLGSFGAGGFGGFASASASGGFSSNSGFAGGATGGGFSAAAAPAGGGFAAAATGGGFAALASKGGGFAAAASSGGGFGGAAQGSGFSSVALMHAPKIVLRALAVAIVELPAPGIDTISQEHFAYLSTSDIRTWVSHQDSLTNLDEIVSNHPTTSRQTFQCMTGTEQMMYHQQQVQSDSQHLSSRPGLPPEKQFLLQGGADSSSGLVLSTDAKPRLKWTSELHERFVEAVNQLGGPDKATPKTIMRLMGIPGLTLYHLKSHLQKYRLSKNLQSQANASRAQGVLGCSTTEIDKPCEGNGSPASHLDLETQTNSSSMHINEALQMQIEVQRRLHEQLEVQRHLQLRIEAQGKYLQSVLEKAQEALGTIAVAETAATANASSSKRLQNEHTQLHHHQQQQQVGDGSVDSCLTACDCEGSHHSRSHGHRGEQDILSIGLPPFEPAAARSGKEHHYLLFPNEPSRRRSCSDERRREMSTLQASELDLSINGRSSSHSHRRENIDLNGAGWS

SEQ ID NO: 2189 - protein, 190 aa, Methanococcus maripaludis S2
MEKQCNVMDCPICGKEDSLKLITQELEIPYFGKVIETTILCEACKYKKSDIFPVDVKEPKRYTLTVEDEYDLNKRVIRGSSGHISIPEFGFEVSPGPASEAYVSNVEGVLTRMEDAIKTLKSWVENEDERKKADELIEKLEQVKLGKEKITLILEDPLGHSAIIGDGVKEELLTEDEIALLSDNTIIVDK

SEQ ID NO: 2190 - protein, 208 aa, Vitis vinifera
MAREKIKIRKIDNVSARQVTFSKRRRGLFKKAEELSVLCDAEVALIIFSSTGKLFDYSSSSMKDILGRYTMHSNNLEKLEGPSLELQLENSNHVRLSKEIADKSHQLRQMRGEDIQGLNIEELLKLEKMLEAGLSRVLKSKSDRIMTEIATLQTKMEIICKGKRLMTMESDNMILEEGQSSESITNVYSCSSGPPQEDDSSDTSLKLG

SEQ ID NO: 2191 - protein, 302 aa, Nicotiana tabacum
MSTTTTATPPQHHHTFWCHECDMSVFLLHLPSTDPPRCPHCHSDFLEQMDSFTPTLLPQFPNQPDSNPNLEDLISTDLNTATNFTPSDDNFLLDSPYLHRLIHHLTTANDAPIPNRQHSPASKAAMEALEGIKISSLMLENDPVIPCPVCKDNFLLDMEVKMLPCKHMYHSDCILPWLEVNNSCPVCRFKLPTEEEDDEECIRRRERFLGAMRLGEILAEEEDLFGFRRTLRRVARRHQLDGGESTIGQAGQGVGVVARANSVETVSSWPSWPVENGSDGDEVGGSDNRLGGGQGDTTVVRS

SEQ ID NO: 2192 - protein, 132 aa, Brassica napus
MTDVHSFNNISLSGRGGSNPGLLKINSGGIQWKKQGGGKAVEVDKSDIVGVSWMKVPRTNQLGVKTKDGLYYKFIGFRDQDVASLTSFFQSAFGKTPEEKQLSVSGRNWGEVDLNGNNLTFLVGGKQAFEVS

SEQ ID NO: 2193 - protein, 120 aa, Brassica napus
MEDGKDQDIDVGSLVEAVSADHSFGAPLYVVESMCMRCGENGTSRFLLTLIPHFRKVLISAFECPHCGERNNEVQFAGEIQPKGCCYHLEVLAGDVKIFDRQVVKSESATIKIPELDFEI

SEQ ID NO: 2194 - protein, 339 aa, Physcomitrella patens subsp. patens
MRDSSAKTDTSSDMDGDPKLDDGHHLVTGGSNDSSHEAGTKNGDFKVLRRLAQNREAARKSRLRKKAYVQQLESSRIKLNELEQELQRTRQQGLYLGPGSCSVDQNGHSAGGTWGTNSSSVAAAFDMEYAKWVEEHHRQTSKLRAALQGHVADSELRVLVDAGLAHYDDLFRLKAVVSKADVFHLVSGIWKSPAERCFMWMGGFRPSGLLKILLPQIEPLTDQQASNICNLQKASQQVEDALSQGMEVLQQSLADALSVGSLGSSANVAIYMGQMAMAMGKLGTLEAFMCQADKIRQQTLQQMHRVLTTRQAARGLLAMGDYFARLRALSSLWSARPRE

SEQ ID NO: 2195 - protein, 438 aa, Zea mays
MAPKRPAAASGSASEASDAEADAGHHQPSSPSPSKTPPPPNPNPKSTAAGPTSAAEDSTAAGSGSEAAYDSDADHRTAPRNAASPSSKPRSTRPRSRSRSRSPDAASYSDGVASDADADPAAVDGADSADDGNASPLAPPRPSRAEAAAVKPISSRPMDPPRRSMVPSFSEQRSKRPRSVAVPSSVEHLKRPTRLWSLHDEIVILRGLATYRAKRGVLPGSTYDISKLHGRIRSELSVKVTTTQLGDKVRRLKQKYNLLASRGKSGRDPDLPSQHEQSVYEIGKKVWGGSANGGGSTGGDGYEIGGDSEEEHEFRESDEDVENGRDERARKNRRVMPIAMANGNGAGLGAVNANSRGKFETEKGKDAYPYLWETVEDLSKEHPNGVAFKKAFESIEGPKARGMEEKLRKFRLTEIRHQLRRMELMKETVKMVLDALEG

SEQ ID NO: 2196 - protein, 260 aa, Glycine max
MTATSRPQHPNGSLAPASDGGESFAKFFECWILEQSRDLAALRAAATARPDDADLRRLVDRVLGHYEHYYRAKSAAASADVLPMFAPSWISATESLYLWCGGWRPTSAIQLLYSKSGLQLEAQLPAFLDGGSLGDGDLGGLSAEQLQAADQLQRRTIRREREIEEAAAGAQESLATTKMVELAGKGGMDAAEGMELEMDAKAEAMKRVLEMADGLRLETLRGVVGLLRPAQAVHFLVAAAELHLAVHKFGRRKDGAAAAE

SEQ ID NO: 2197 - protein, 507 aa, Oryza sativa
MCDYFLQRMEGEQAAGDLADIVLRAGGAAAAAVAGGGIPSTEWQLPPAEEEEEEPGLFPLPPSSSDGSGMSGADAFGDPFAGLPDPFGGDYPSSSGGAAGADDFFNADGGKAGFVDVGVLGGGGGGGCDGGGVDGGGGGSSLLGMSKPILPRAAMQLPSVSPRAIRPYPVMACDTVKLGAPMAGGPCAFDGAAAAGLHMSSSPRGAVGGIKRRKNQARKVVCIPAPAAAGGRTSGEVVPSDLWAWRKYGQKPIKGSPYPRGYYRCSSSKGCSARKQVERSRTDPNMLVITYTSEHNHPWPTQRNALAGSTRSHHAKNSSSNSSSSGASSASKNNSSHSGYHHHHHQKPLVKAEPNDQSAAATTAATVPVKEEAAMVGTSSEALAKTTQKSMEDAAAAASATAAAVEHSDLMQQMFSQSYRPMIPEAAAGGHHDDFFADLAELESDPMSLIFSKEYMATNYKPAGDPAGKEMNAVDKGLDPAYMLDWSSTTVVTRAGGSSFMQGEGGL

SEQ ID NO: 2198 - protein, 342 aa, Populus trichocarpa
QPIRQRRTGKKDRHSKIHTAQGPRDRRMRLSLQIARKFFDLQDMLGFDKASKTIEWLFTKSKAAIKELTDTVPKVRKCSSTSAGKSVSSTSESEVVSGIKLTPDTNGDRRVMEAKSDSLVSKPKEKRSKKVHKPVFNPVDRESREKARARARDRTREKMKNKGINKSSQSSQANPDNLEKFGYSSTLEYGENLASGRQEINSSVKVVDEEEESNNHHHLLPHQMDHVSIIDKFFGITNSPRSSSIFDFSESIEVPSGATLKDEFSGFPLKWDVTNGRVQYKYNALPNMKLPSGNVQAQNPNVNFMTTPHALEPNLSTMIMTTLNAHVEESPNSAFVNMPNPN

SEQ ID NO: 2199 - protein, 207 aa, Prunus persica
MKMTREKIKIKKIDNLPARQVTFSKRRRGIFKKAAELSVLCESEVAVVIFSATGKLFDYSSSSMKDVIERYQEHINGAEKFDEPSIELQPEKENHIRLSKELEEKSRQLRQMKGEDLEELNFDELQKLEQLVDASLGRVIETKMLSRGNIGPALMEPERLNNNIGGGGEEEGMSSESATSTTCNSAPSLSLEDDSDDVTLSLKLGLP

SEQ ID NO: 2200 - protein, 370 aa, Vitis vinifera
MDRISYPPQISILSSPWIPQSHTLQNSPLPPPPPPLDGCSLLSQKQFEETEEVLKDEVFDSYNEDESYGEVNKIIGSRAAEGGKGMEYLIEWKDGHVPTWVPARYVAGDVVAEYESPWWTAAKKADDAALKALLESGDGRDVDAVDENGRTALLFAAGLGSEACVQILADAGADLNHRDNGGGGLTALHMAAGYVKPGVARLLIQLGADPEAEDDRGRTPLDLAREMLRATPKGNPMQFARRLGLENVVRVLEEAIFEYAEVQEIMERRGKGQNLEYLVKWKDGSDNEWVKAGLIAEELVRDFEAGLEYAVAQGVMGKRTGDDGNMEYLVKWTDIDEATWEPEENVDPDLIKAFEENGAADLGAHVEGGS

SEQ ID NO: 2201 - protein, 299 aa, Zea mays
  misc_feature (148)..(148): Xaa can be any naturally occurring amino acid
MSSGEDGYCSSDSPRAESPDQPQAAAAADADADAESPRAGAGPNKRDLHASSPAAKRSRRSVEKRVVSVPLAECGEGPPPSDSWAWRKYGQKPIKGSPYPRGYYRCSSSKGCPARKQVERSHADPTALLVTYTFEHNHEAPQPKTSGXAAAATSKASRPRGRSRVSLEGPKLTFQPGELGPEHELVETEVPEQEQETEPEEEHDPAEEGVPCLAGPEAAASLTVAPAAEEDESFDFGWFDQYPTWHRSALYAPLLPPEEWERELQGEDALFAGLGELPECAVVFGRRRELSLAATAPCS

SEQ ID NO: 2202 - protein, 226 aa, Prunus persica
MVKTMRKKIKIKKIDYLPARQVTFSKRRRGIFKKAEELSVLCESEVAVVIFSATGKLFDYSSSSTKDVVERYQAHTNGVEKSDEPSVELQLEIENHIRLTKELEEKSCQLRQIKGEDLEELNFDELQKLEQLVDASLGRVIETEGAELVEANNQLRQRMVMLSRGNIGPAPTEPERFVNNIGGGGEEGMSSESATNATISSCSSGPSLSLEDDCSDVTLALKLGLP

SEQ ID NO: 2203 - protein, 235 aa, Arabidopsis thaliana
MAREKIQIRKIDNATARQVTFSKRRRGLFKKAEELSVLCDADVALIIFSSTGKLFDMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 2204 - protein, 240 aa, Prunus persica
MVKTMRKKIKIKKIDYLPARQVTFSKRRRGIFKKAEELSVLCESEVAVVIFSATGKLFDYSSSSTKDVVERYQAHTNGVEKSDEPSVELQLEIENHIRLTKELEEKSCQLRQIKGEDLEELNFDELQKLEQLVDASLGRVIETEEELIMSEIMALERKGAELVEANNQLRQRMVMLSRGNIGPAPTEPERFVNNIGGGGEEGMSSESATNATISSCSSGPSLSLEDDCSDVTLALKLGLP

SEQ ID NO: 2205 - protein, 262 aa, Zea mays
MDCSNDWDLQALVRSCGGGNRSVQHSRAGADAPPREEAAMVRGGGRAAAQLELLGQPVGAVSSWRRGLDHFDDLVDRDRDPRAACPSPSLSRLHHLARRRPPGVVSRSGHQMVQPRRRQPGRKAGGRTPRPKRSKKRQVKKVVCEVPAAGGVVSTDLWAWRKYGQKPIKGSPYPRGYYKCSSLKSCTARKLVERSPAKPGVLVVTYIADHCHAVPAMLNALAGTTRNRPSSSSSASPDDGDHNQDQETSSDGAAPSADNNSK

SEQ ID NO: 2206 - protein, 211 aa, Triticum aestivum
  misc_feature (5)..(5): Xaa can be any naturally occurring amino acid
  misc_feature (10)..(10): Xaa can be any naturally occurring amino acid
  misc_feature (12)..(12): Xaa can be any naturally occurring amino acid
  misc_feature (14)..(14): Xaa can be any naturally occurring amino acid
  misc_feature (16)..(17): Xaa can be any naturally occurring amino acid
  misc_feature (19)..(20): Xaa can be any naturally occurring amino acid
  misc_feature (22)..(23): Xaa can be any naturally occurring amino acid
  misc_feature (61)..(61): Xaa can be any naturally occurring amino acid
SNQSXQNPGXPXKXPXXSXXSXXGFAAANKSRLRWTLELHERFVEAVNKLEGPDKATPKGXVLKLMKVEGLTIYHVKSHLQKYRHAKYIPEIKDEKKASSDVKKVQSGSSGSDPFKNKNLAEALRMQMEVQKQLHEQLEVQRQLQLRIEEHAKYLQRILEEQQKASSGISLSLKTPTAPSVSTSKDRTEPEEATTSSPQTTKNSETGSPCS

SEQ ID NO: 2207 - protein, 771 aa, Candida glabrata CBS 138
MSEKDGGNTVFINKLYDLLENKDLDDLIWWAANGESFLIRPSESFSQNLAHYFKHTNITSFVRQLNIYGFHKISNDHFHNLKREKKQKSSTDNNTGVSNNNSGDENIKVWEFKHSGGLFKKGDLENLKLIKRRSSSRTIPSLSLASSNTNTSTLETNDGAEIDNVKVIASAVHNATEHLKKKDKVKKEGKKSSKKSTKLKNEPTVDISNTETTSAAITNESEQSSNKRATRVYKSVGTISNQDSKNPEKLTKKPKKNSNLKNKGKKSKSNSVDGQSIDNIQPNENQPINIQVNTTEIPTDNTLHHYNETLYEQSIQLNHQIAQMRNTNMDMLAILELMSKLAEMNKEVLNINNSEKIPELMANHYRFFDAQLTSLKNNILDRINNTNIHKFGMDSNDLRSASQTNIHLSHPIAQNMVYSSADQAIPKSVPYYLKQGQRTSPDNGTTTPAGAQNYSKNQVVQHPQAANDYFSSVHVQTANPFEKFQTEKNGIINVTARRHMSVLVDPLTPASMMSVPTTTQSSLSGPSLYNQQHAIIFPHDLNQAFNSRSEPTITPITGHHSNFTRASDSNLMNTKQTIVNSMKNRASYPSRRTESPLKYSSGMPIEEEQRWEYKITKDNGRNTDIPQLPSNQCQIDSPVPVRSPYNKFVSPHSFYAGGRNISPPMNGNVDMLAQRPSTEVVSLTSSDNKIDNAVVIKRSSTANPILRGSSSEKENKESSNKLIGSTVTEKTSRTKRNSSGVYSLLNGTIKEEKANETFIDTDSHVDKKIKL

SEQ ID NO: 2208 - protein, 239 aa, Prunus persica
MVKMMRKKIKIKKIDYLPARQVTFSKRRRGIFKKAAELSVLCESKVAVVIFSATGKLFDYSSSSIKDVIERYKAHTNGVEKSDKPSVELQLENENQIGLSKELKEKSHQLRQMKAEDLEELNFDELQKLEQLVDASLGRVIETKEELRMSEIMALERKGAELVEANNQLRQTMMLSGGNTGPTLMEPERLSNNIGGGGEEEGMSSESAISTTCNSALSLSPSLGDDSDDVTLSLKLGLS

SEQ ID NO: 2209 - protein, 185 aa, Boechera stricta
MLDSGIPHADDVTNSGNLVDSNLELVPYQSDISVDEPSSDSKALVPLPALEVKALAIVPLNQKPKRTELAQRRTRRPFSVTEVEALVQAVEELGTGRWRDVKLRAFENADHRTYVDLKDKWKTLVHTASISPQQRRGEPVPQELLDRVLRAYVYWSQHQGKHQARGASKDPDMNRGRALESGVAV

SEQ ID NO: 2210 - protein, 284 aa, Picea abies
MEHMNTTAQSSSSLYGVHMVEYGGDVGVGSMMALMTEHQPESESIMTSIPIPSSYSSYSHGHGHGHGHGHGHGQSECLLSAAAMFQSSRPCQGSNKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 2211 - protein, 235 aa, Prunus persica
MMRNKIKIKKIDYLPARQVTFSKRRRGLFKKAAELSVLCESEVAVVIFSATGKLLDYSSSSTKDVIERYNADINGVEKLNNQEIELQLENENHIKLSKELEEKSRQLRQMKGEDLEGLNLDELLKLEQLVEASLGRVMETKEELIKSEIMALERKGTELVEANNQLRQTMVMLSGGNTGPALMDPERLNNNIEGGGEEEGMSAESAISTTCNSAVSLSLEDDSSDEVTLSLKLGR

SEQ ID NO: 2212 - protein, 202 aa, Brassica napus
MSSEAEEFAEFSALFERMIRRGEGLSRFLPLILALAGEADEDGESTDQTATHREIVIDPVNRRVVMIRSALGEFLNGDFSEKQGRSPASKLSVESLPRVVIGKDEERRGSCPICLEEWSEGDVAAEMPCKHRFHSKCVEEWLGRQATCPLCRYEMPVEEVEEEKKVGVGIGFSVGNGERRNGEEDGGGRSEGGSNTRDEKEA

SEQ ID NO: 2213 - protein, 245 aa, Zea mays
MGRAPCCEKMGLKRGPWTPEEDRILVAHIERHGHSNWRALPKQAGLPRCGKSCRLRWINYLRPDIKRGNFTREEEDAVIQLHQMLGNRWSAIAARLPGRTDNEIKNVWHTHLKKRLEPKTATQAPKRKPKKQQQPEAVTLAAPVSPEQSAVSTSTTSTTTDYSAASSSLENADSFTSEEEDYQIDDSFWSETLAMAVDSSDSGMEEAEGAFGASPPAPSTNDDVDFWLKLFMQASDMQNSPQIYA

SEQ ID NO: 2214 - protein, 137 aa, Brassica napus
  misc_feature (15)..(15): Xaa can be any naturally occurring amino acid
  misc_feature (25)..(26): Xaa can be any naturally occurring amino acid
  misc_feature (53)..(53): Xaa can be any naturally occurring amino acid
  misc_feature (57)..(57): Xaa can be any naturally occurring amino acid
  misc_feature (63)..(63): Xaa can be any naturally occurring amino acid
  misc_feature (87)..(87): Xaa can be any naturally occurring amino acid
KHLKSSDSHCPVCKXEFELKSEVKXXPCKHMYHSDCIVPWLVQHNTCPVCRKXLPSXGSSSSXERDQNRGSNRRRNLFSSLWPFRSXSSSSTQNRRDTSNTATAEEGGQYSHHHQLQHQQQHEQQSHMGYSGWPFDY

SEQ ID NO: 2215 - protein, 277 aa, Oryza sativa
MEGVQHMEATSKCQTRHTHTEQQQQQQQHQTARHNERSLAFQAIKRFDMVKTAASNGAAAARRVGGGGDGKRAAYKGVRMRSWGSWVSEIRAPSQKTRIWLGSYSTAEAAARAYDAALLCLKGSAAADLNFPVRLPFDLPAAAMSPKSIQRGAAAAAANANANASSSCSAAVFAGVDDSGGASASEASTPACSSSDGAASPSPVSSPETVISDVDVDYSLLADIEAFFQSPKCMEYAMMDPCSAFFAPPPPPAMAMEEECGWEEEGDIALWSFSSLD

SEQ ID NO: 2216 - protein, 209 aa, Arabidopsis thaliana
  misc_feature (12)..(12): Xaa can be any naturally occurring amino acid
  misc_feature (109)..(109): Xaa can be any naturally occurring amino acid
  misc_feature (173)..(173): Xaa can be any naturally occurring amino acid
  misc_feature (196)..(196): Xaa can be any naturally occurring amino acid
CAFLSSPPPHNXSQHRITLLSNKDAALVTADSPLVRRIKEASAPEIIHHEDGGHHRGGGGGCVIIIVVFKKFMVAVLPSITKKMLVGITLLSVTLLFFEHPVAGVFTYXNICSDEQISIVSSIDNIIMKRHNEKIVEEEEEESSSSHHSRSNIFFEIIEEPSEEIRVTPQPYXSSSEKKKIVVDEEKEMLPIIDVXYNNEKSNSTKQQS

SEQ ID NO: 2217 - protein, 356 aa, Arabidopsis thaliana
MPTLYKKAGCQFPLTTMVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKAFPIPCAPLRGNQTT

SEQ ID NO: 2218 - protein, 144 aa, Zea mays
  misc_feature (84)..(84): Xaa can be any naturally occurring amino acid
MARRLLSYLSDSASVKVPELESELSCGTLGGMVTIVEGLIVKICEALERIHGFQLGDSTLEWKKKKWDDFKERLSKLLSLQEAXTLIIDDGLAASFVAPATDSLEDDSQLTIEEYQRSWEQNEELGLNDMDTSSADATYNMTNT

SEQ ID NO: 2219 - protein, 239 aa, Vitis vinifera
MSTGGNTHWCYQCRRRVRLQGRDTVCSYCYGGFIQELNDLEGLMSSIFDAFNGLVRQGNADQRFGLVNAVNDFMRQRMAGRNPNFDVRVRSGLVPEDNSMSGYRSGPWLVFHGQIPVEALFSGGTGRGGNVGDLFLGPGLEELIEQLTMNDRRGPPPATRSSIDAMPTIKITQRHLRSDSHCPVCKDKFELGSEARQMPCDHIYHSDCIVPWLVQHNSCPVCRQELPPQFKWWKQEQQE

SEQ ID NO: 2220 - protein, 644 aa, Arabidopsis thaliana
  misc_feature (30)..(30): Xaa can be any naturally occurring amino acid
MADGHFLNNISLSGRGGKNPGLLKINSGGXQWKKQGGGKAVEVDRSDIVSVSWTKVTKSNQLGVKTKDGLYYKFVGFRDQDVPSLSSFFQSSYGKTPDEKQLSVSGRNWGEVDLHGNTLTFLVGSKQAFEVSLADVSQTQLQGKNDVTLEFMLMILLVLMRKTPLMEISFHIPNSNTQFVGDENRPPSQVFNDTIVAMADVSPGVEDAVVTFESIAILTPRGRYNVELHLSFLRLQEQANDFKIQYSSVVRLFLLPKSNQPHTFVVISLDPPIRKGQTMYPHIVMQFETDTVVESELSISDELMNTKFKDKLERSYKGLIHEVFTTVLRWLSGAKITKPGKFRSSQDGFAVKSSLKAEDGVLYPLEKGFFFLPKPPTLILHDEIDYVEFERHAAGGANMHYFDLLIRLKTDHEHLFRNIQRNEYHNLYTFISSKGLKIMNLGGAGTADGVAAVLGDNDDDDAVDPHLTRIRNQAADESDEEDEDFVMGEDDDGGSPTDDSGGDDSDASEGGVGEIKEKSIKKEPKKEASSSKGLPPKRKTVAADEGSSKRKKPKKKKDPNAPKRAMSGFMFFSQMERDNIKKEHPGIAFGEVGKVLGDKCVKCLLMIKSHMKPRLQVDKQRYKDEISDYKNPQPMNVDSGNDSG

SEQ ID NO: 2221 - protein, 184 aa, Arabidopsis thaliana
MNGRSMRLPPGFRFDPDDEDLVFEYLAKKVLHRPMDFDLPELRSCNVDPWDLLGEKNKEVYYFVKKEERERKGRETLSGYWEECEEEEVMEAGGRDCIHLEGRRKTFAFFIGKKPRGTITPWIMYEFRLLSSRATRWSSSPLPRGEVGKWRAVKVVVKEENDEEMVEDEHESDESDGEEVIQSR

SEQ ID NO: 2222 - protein, 543 aa, Oryza sativa Indica Group
MEGEQAAGDLADIVLRAGGAAAAAVAGGGIPSTEWQLPPAEEEEEEPGLFPLPPSSSDGSGMSGADAFGDPFAGLPDPFGGDYPSSSGGAAAAADFFDAVVAKAGFVDVGVLGGGGGGGCDGGGVDGGGGGSSLLGMSKPILPRAAMQLPSVSPRAIRPYPVMAGDTVKLGAPMAGGPCAFDGAAAAGLHMSSSPRGAVGGIKRSLHALQFPHLAPPNKAVRIKIKERNCEPVFDLFRQKQQKSRKNQARKVVCIPAPAAAGGRTSGEVVPSDLWAWRKYGQKPIKGSPYPRGYYRCSSSKGCSARKQVERSRTDPNMLVITYTSEHNHPWPTQRNALAGSTRSHHAKNSSSNSSSSGASSASKNNSSHRGYHHHHHHQKPLVKAEPNDQSAAAAATTTAATVPVKEEAAMVGTSSEALAKTTQKSMDDAAAAASATAAAVEHSDLMQQMFSQSYRPMIPEAAAGGHHDDFFADLAELESDPMSLIFSKEYMATNYKPAGDPAGKEMNAVDKGLDPAYMLDWSSTTVVTRAGGSSFMQGEGGL

SEQ ID NO: 2223 - protein, 207 aa, Prunus persica
MKMMREKIKIKKIDNLPARQVTFSKRRRGIFKKAAELSVLCESEVAVVIFSATGKLFDYSSSSMKDVIERYQEHINGAEKFDEPSIELQPEKENHIRLSKELEEKSRQLRQMKGEDLEELNFDELQKLEQLVDASLGRVIETKMLSRGNIGPALMEPERLNNNIGGGGEEEGMSSESATSTTCNSAPSLSLEDDSDDVTLSLKLGLP

SEQ ID NO: 2224 - protein, 226 aa, Prunus persica
MVKTMRKKIKIKKIDYLPARQVTFSKRRRGIFKKAEELSVLCESEVAVVIFSATGKLFDYSSSSTKDVVERYQAHTNGVEKSDEPSVELQLEIENHIRLTKELEEKSRQLRQIKGEDLEELNFDELQKLEQLVDASLGRVIETEGAELVEANNQLRQRMVMLSRGNIGPAPTEPERFVNNIGGGGEEGMSSESATNATISSCSSGPSLSLEDDCSDVTLALKLGLP

SEQ ID NO: 2225 - protein, 240 aa, Prunus persica
MVKTMRKKIKIKKIDYLPARQVTFSKRRRGIFKKAEELSVLCESEVAVVIFSATGKLFDYSSSSTKDVVERYQAHTNGVEKSDEPSVELQLEIENHIRLTKELEEKSRQLRQIKGEDLEELNFDELQKLEQLVDASLGRVIETEEELIMSEIMALERKGAELVEANNQLRQRMVMLSRGNIGPAPTEPERFVNNIGGGGEEGMSSESATNATISSCSSGPSLSLEDDCSDVTLALKLGLP

SEQ ID NO: 2226 - protein, 175 aa, Glycine max
MQSQVVCNGCRSLLLYPRGATNVCCALCNTITSVPPPGMEMSQLYCGGCRTLLMYTRGATSVRCSYCHTVNLVPPASNQVAHVHCGNCRTTLMYPYGAPSVKCALCHFITNTNNGRLPIPVHRPNGTNNAGTLPSTSTSMPQSQSQTVVVENPMSVDSSGKLVSNVVVGVTTDKK

SEQ ID NO: 2227 - protein, 240 aa, Prunus persica
MVKMMRKKIKIKKIDYLPARQVTFSKRRRGIFKKAAELSVLCESKVAVVIFSATGKLFDYSSSSIKDVIERYKAHTNGVEKSDKPSVELQLENENQIGLSKELKEKSHQLRQQMKAEDLEELNFDELQKLEQLVDASLGRVIETKEELRMSEIMALERKGAELVEANNQLRQTMMLSGGNTGPTLMEPERLSNNIGGGGEEEGMSSESAISTTCNSALSLSPSLGDDSDDVTLSLKLGLS

SEQ ID NO: 2228 - protein, 238 aa, Prunus persica
MLPFLSWSDQNHYAHDPSLVNLMDGADSILSPAASMTETSRSAEASKSHKEAERRRRQRINTHLSTLRTLLPNTTRTDKASLLAEVVQHVRELRRQAGDLARQDGGSCCGGSTGSEPWPFPGESDEATVSYCDGEARLLKATLCCEDRPGLNRDLIQAIRSVQARAIRAEMMTVGGRTKNVVVMQWAGGGGEEEVRALKRALKAVVENRASGCGPGRLVLGKKRARVYGSVYEDENEY

SEQ ID NO: 2229 - protein, 185 aa, Coffea humilis
PNKVAKLNASSKTVDHAQAEATMRKARVSVRARSEAPMITDGCQWRKYGQKMAKGNPCPRAYYRCTMAVGCPVRKQVQRCAEDRTVLITTYEGTHNHPLPPAAMAMASTTSAAANMLLSGSMSSADGLMNPNFLARTILPCSSNMATISASAPFPTVTLDLTQTQNPLQFQRQPSTPFQLPFGTP

SEQ ID NO: 2230 - protein, 275 aa, Glycine max
MANAAEVSALNRIKLHLLGELSPLATPLNYFDESNPSPSESSNSQSSSVSLNHYFTDLFEFDSKPQIIDLQTPKTLTSAQKKPQLNRKPSLLIAVPKKTEWIQFGSPDPNPVMAAPENLPQKNHYRGVRQRPWGKFAAEIRDPNKRGSRVWLGTFDTAVEAAKAYDRAAFRLRGSKAILNFPLEVSAVAETVSVAAAEGNVERKRRREEEEVVVEEVKPVVKKEKITEQDVSCFREMPLTPSMWTGFWDSDVKDIFNVPPLSPLSPFGFSPLVAV

SEQ ID NO: 2231 - protein, 426 aa, Zea mays
MAWDTPASRTQSPYPLAHHPSKHTTVFRVRSTRATTRDLPLVTPMEAVLRHPSLSRTRPPNLNPPTTPSPSLHAPSLLRLRARRLIAAAVFQDQKPKEPASKGGDDEEEAYGEVDRIVSSRTVSSPVFAEDGSATAAVATEFLVEWKDGHEPSWVPAEAIAADVVAEYETPWWTAAKKADSEALAALLADETLRRDPDAEDAQGRTAAHFAAGLGSEECLRALGAAGADVGRRERAGGGLTPLHMAVGYGRAGAVRALLELGADPEAPDGQGRTPLELVQEVLARAPKGNPATFQLRQGLEAAQKELEKAVYEWAEVEKVIDGRGEGKWREYLVEWRDGGEREWVKAAWVAEDLVSDFEAGLEYAVAEAVLDKRQAATATAEGEDSWEYLVKWVDIEEATWEPAENVDTELVQKFEQQQSGSAGGD

SEQ ID NO: 2232 - protein, 246 aa, Glycine max
MEKDIIDLSPTWDCDNGNSTEKRLRLFGFELNPSSKEGCAKESGEGDESVNSSNSASSGGDKTVQEKTSANDPDERKFECQYCYKEFANSQALGGHQNAHKKERMKKKRLQLQSINRYLQHPFQSNHGFAYPSDTPWFYDPSTYNNNSEFTLCEEPQISFNSNSVLDSNFSNDQKTSWYSLASHPSNIQQDTCMFTFSSNASNNNNSPFIFKPCHFPASNQNHNKTLDLQLGLNLESNTRSSLRRM

SEQ ID NO: 2233 - protein, 66 aa, Taraxacum officinale
NDGQAKITPRAYDESYAEDEDEHGETLCGSCGGNYSGDEFWIGCDICERWYHGKCVKITPAKAESI

SEQ ID NO: 2234 - protein, 447 aa, Capsella rubella
MLTSFKSSSSSSEDATTETPPPPFCQLASSSSSSAATSASHHLRRLLFTAADFVSQSNFTAARNLLSILSLNSSPYGDSTQRLAHLFTKALSLRINRLQQEQDPTVATCTTNEMTMSTNSTVFTSSVCKEQFLFRTKNNNSDFESCYYLWLNQLTPFIRFGHLTANQAILDATETNDNGALHILDLDISQGLQWPPLMQALAERSSSPNSPPPSLRITGCGRDVTGLNRTGDRLTRFANSLGLQFQFHKLVIVDEDLPGLLLQIRLLALSAVQGETIAVNCVHFLYKFFNDDADLIGHFLTVIKSLNPRIVTMAEREANHGDHSFLIRFSEALDHYVAIFDSLEATLPPNSRERLTLEQRWFGKEIMDVVAAEATERKQRHRRFEIWGEMMKRFGFVNVPIGSFALSQAKLLLRLHYPSEGYNLQFLNDSLFLGWQNRLLFSVSSWK

SEQ ID NO: 2235 - protein, 451 aa, Oryza sativa Indica Group
MASWVSARGAATAYATGAADANAAENVLPSATAAQHLHHPLALSMSSGSLSSCITAGEYGMAAVAAADGGRKRGGAGGGGQKQPVHHRKSIDTFGQRTSQYRGVTRHRWTGRYEAHLWDNSCKKEGQTRKGRQGGYDMEEKAARAYDLAALKYWGPSTHINFPLEDYQEELEEMKNMTRQEYVAHLRRKSSGFSRGASMYRGVTRHHQHGRWQARIGRVSGNKDLYLGTFSTQEEAAEAYDVAAIKFRGLNAVTNFDITRYDVDKIMASNTLLPADLARRNAATTTSKDDHSAAGAGAIVSVHSAADIAVADTLWKATTAPRQQQQHHDDVVLSGADQAAFSVLHDLVAVDAAAAHHHQQQQQHMSMSAASSLVTSLSNSREGSPDRGGGLSMLFAKPSPAVAASAQQQASTKLMAAPLPLGSWVSSPPASARPPAVSIAHMPLFAAWTDA

SEQ ID NO: 2236 - protein, 456 aa, Saccharomyces cerevisiae
MQPKTFVHQLHAILLEPEVNKWIYWSPTDNTVFFLKPYDPNFSTHVLKRYFKHGNVNSFVRQLHMYGFHKLSHPSPDQSSANNGNVKELVEWKFTHPSGFFFKEANAGILNKIQRKSTGVGKDGKRKNILSPISVSYVDASRLNVLSQQSGPVSAREPSNMFMGSPVHYSTSQSPPHISIPQQQQSSGPYLISSLPPQQPTVNMMRRQSISARMMNSYDYPNQFSTQDSIVQPQQPQQVLSPQALSGPPMKKSGTLSSTDDLKTTSLPIVNYPMPYHPGAFAQQQQQQQQPLPTVPPYSSYSTPFPSMMNSLSNSASNSPALGVCNNNVTLPKKSNISERQALDNHIQTLKNSLSTITDLIEKHINSASQDENKTLTNDAMNKDLRTSLSLLQNSKEEIIQLESKWMSMQSVKTTALPLQETTNTSSTLTSLTSSIIPKSIPIITKGEVATKPASY

SEQ ID NO: 2237 - protein, 840 aa, Paracoccidioides brasiliensis
MLAMTSPGVSRKRPAPGTSPIIRQQIAPAADTQLSNDQFLQWGLSVPAHPDSSSAPLDGSPQYPVAPHPVDVDPMQHSNQLTRRTGHQLISRTRLQDQNMTPLIDQGRLISDDRGDPTLAETEAELEQRALMAKKDAQAKRKQIPPFVQKLSSFLDESKNTDLIRWSDDGNSFIVLDEDEFAKTLIPELFKHNNYASFVRQLNMYGFHKKVGLSDNSMRASERKNKSPSEYSNPYFKRGHPDLLWLIQKPKNVTGQGRGAAKGGSRTKIEVDGEDGENEDFGDEGGGTLHEKSKFRGQLSIGAAEGTLGGDQLANVYRELQNIRQQQQIISSTISKLRREHEQLYGQAATFQEQHTRHENSINAILTFLATVYNRSLQGHEGAQGIVNSFAGAIPQDNSQGNIVNMDNYIGNINSDHSAQRPFKKQPLLLKAPPVIGPDGQPIQPNKLSLSPAGSHYDLSQDHRRLSDQTSVTSTNIEELYESPHNSVSQPQVSHQQQQHAVQNQRTRSPQAVEDQSTSNFPQKDIMSVIQNSNARNNLPANLSDFPRILSSFETSDGNSPLTASQRADMLRLIANQNHVSDPTSSASNSALISPTPPPMPASYPNRLANTRAEIDNLVKMQAEQDRSVQNLTNLLQPLSPTGSIPGLGPNSLTSSVPPPLDLDQIFNSGDYFSDFTDMEKGGGDISGFNHDLQTGPGKELDFKSDSSNHNGNSTAANDIHASDLFDFDGLPSTTTSDPFRSLNAPVDAHSVPGYFEGHTGLNRDSSNLENTRPDDRLSSINFGSGRRESDGARITEAFSSSECPSPATTSVDENLQGIDDGNCASAGAKPSNKRRRRNR

SEQ ID NO: 2238 - protein, 218 aa, Populus trichocarpa
MASETEFPAEFSSMFERLLRHRDLSLFLPFILGFTSTNTTEQRDPDQEAPQTTDPNERIILINPFTQGMVVIEGAASLESLLRDIGNKKGQPPASKASIEAMPKVEIGEDNKDGECAICLEEWELGGVVKEMPCKHRFHGGCVEKWLKIHGNCPVCRYKMPVDEEELGKKRDEGDGGRERRVEREIWVSFAFNGSRRNGDSNENPSNDSSTEDQERFL

SEQ ID NO: 2239 - protein, 226 aa, Physcomitrella patens subsp. patens
MAKPKNGKKTLDSCVIKGTRKIVKVGDTVLMRSEDADKPPYIAKVEKIEGDSRGNVKVRVRWYYRPEESMSGRKQFHGQKEVFLSDHYDVQSADTIEGKCIVHSFKNYTKLETVSAEDYFCRFEYKATTGGFTPDRVAVYCKCEMPYNPDHVMLECNSCKDWFHRHCVGLSEEQVKHVDRYICPTCAPETVKKSNGSSHKTPDAKVTSVEFALAAFSSIALVFHYT

SEQ ID NO: 2240 - protein, 631 aa, Coccidioides immitis RS
MENTQSGGGTSTGNSSDFVRKLYKMLEDPSYAQVVRWGDDRDSFVVLECEKFTKSILPKHFKHSNFASFVRQLNKYDFHKVRQNNEETGQSPYGPGAWEFKHPEFKADNKDSLDNIRRKAPAPRKPPQSAEDSIPTQQLDLMNQQIVAQQQQFQHLADRFAVDQQLMMQEIRRVQKTVLGHEQVIHYMMTFLHSVDARQRRENRAAAAAFQGQPGGSELSPAQAQAQNDEPASPLQHAMKLLSEMNSDIQFNLSSLESMGEMQNRLPGAVPTPPLDQTQRNGTVRPPTSTGPASAMAFPKLNGDLEQVVYPVGVTNGIDPMYGDHINSIPYTMSSKEADPSDPRRQFVDRKKSTGTSTYADPGWIRSPHILLVEDDQTCRQIGGKFLYSFSCVIDTAFDGLEAVNKIQSGSKYDLILMDIIMPNLDGVSACSVIRRFDATPIIAMTSNIRSSDIELYFQNGMNDVLPKPFTRQSLLNMLEKHLVHLKNIPTAIDATQSAPPTAIPQNSATQSVKEETTPGQSPGTSIGNWQSPAQFPGVSPINVSIPNQFMQQQAGAPATPFTIDQNGGIQYPGNQMGSMNVAAAPRTSHRRQMSDISSGADAHNLAKRQRMFATPANNTVVNPMQTNRMP

SEQ ID NO: 2241 - protein, 351 aa, Solanum peruvianum
MEDVMKVKVEEDGIPTAVLPMEGLHDVGPPPFLSKTYEMVEDSSTDQVISWSTTRNSFIVWDSHKFSTTLLPRFFKHSNFSSFIRQLNTYGFRKVDPDRWEFANEGFLGGQKHLLKTIKRRRNVGQSMNQQGSGACIEIGYYGMEEELERLKRDKNVLMTEIVKLRQQQQSTRNQIIAMGEKIETQERKQVQMMSFLAKIFSNPTFLQQYLDKQVHRKDKQRIEVGQKRRLTMTPSVTGSDQPMNYSSSLQESEAELASIEMLFSAAMDNESSSNVRPDSVVTANGTDMEPVADDIWEELLSEDLISGDRAAEEVVVVEQPEFDVEVEDLVVKTPEWGEELQDLVDQLGFL

SEQ ID NO: 2242 - protein, 262 aa, Triticum aestivum
  misc_feature (75)..(75): Xaa can be any naturally occurring amino acid
  misc_feature (97)..(97): Xaa can be any naturally occurring amino acid
  misc_feature (141)..(141): Xaa can be any naturally occurring amino acid
  misc_feature (156)..(156): Xaa can be any naturally occurring amino acid
  misc_feature (167)..(167): Xaa can be any naturally occurring amino acid
  misc_feature (183)..(183): Xaa can be any naturally occurring amino acid
  misc_feature (201)..(201): Xaa can be any naturally occurring amino acid
MAKTKQGKRDIDSYASRGTTKVVRVGDCVLMRPSDPDNAPYVARVESRDSDGRGSVRVRVRWYYRPEESKGGRRXFHGAKELWLSDQYGAHTAHTIXGKSIVHSSKNYTKLDNVSPENSFCRFEYNAATVAYTPDRVEEYXKCEMPHRPYHLMVQXDGCKDRFHPTXMGMSMDQATKLDTLVXRDGSKDQGAQRPSNSYPXSQGAESKEEPEKGGKGYSLQQAPSRVEGIPGLKGVRPNKSSLGTQKIGLGPPPWEIPPGRC

SEQ ID NO: 2243 - protein, 528 aa, Nicotiana tabacum
MAENEASSKRAPMRPTITLPPRASVENLFMGGPGGISPGPMTLVSSFFSDPASEYPSFSQLLAGAMASPAAFSGQRQGFPPPPEMTVSISKGKESGSGDMDFGFKQNRPSGLVITQSPMFTIPAGLSPARLLGSPLLFSPGQGPFGMSHQQALAQVTAQAAHPQSQMHIQPDYPSSSAAPAPSFSQFQSLTSNATANKQIPPPASDPNVMKEASEVSLSDQRSEPASSAVDKPADDGYNWRKYGQKHVKGSEYPRSYYKCTHPNCPVKKKVERSLDGQVTEIIYKGQHNHQPPQSSKRSKESGNPNGNYNLQGPSELSSEGVAGTLNNSKDSMPSYSLRMTDQESSQATHDQVSGTSEGEEVGDTENLADGNDERESKRRAIEVQTSEAASSASHRAVAEPRIIVQTTSEVDLLDDGYRWRKYGQKVVKGNPYPRSYYKCTSQGCNVRKHVERAPSDPKAVITTYEGEHNHDVPAARNSSHNTTNNSVSQMRPHNPVVDKQDATRRIGFSNNEQQPIALLRLKEEQVT

SEQ ID NO: 2244 - protein, 445 aa, Arabidopsis thaliana
MDPRLIVATQIGSIDELYAHIHENPYILEIIDAIPFINTPLHIASASGNLSFAMELMNLKPSFARKLNTYGLSPLHLAIEEGQTRLVLSLLKVDSDLVRLRGREGMTPFHQVVRRGETDLMTEFLLACPGCIKDANVNGETALHIAVSNDRYEELEVLLGWVQRLRQTDAESLEMQFLNKRDQDGNTALHIAAYQNRFKAVKILVKCSAVNRNIHNRTGLTALDILHNQRDHHANSNIENIIRKWGGKSGNSLPKSKKVSEILRSPISFTEHLFTQTARYRNQTSEGTRSALLVIAALIITATYQTALQPPGGVYQENAAEESKKSVGTVVMSHKYFFVLRGVNTMAFVGAIFMAFCLLPAGEGYVWWFLWIAVPLYVSYLVSMSVISPDTVWYVSTNAGSVIIVVFAYMVVFFLRWKRSKKKVPGTSSELILEGLTTLDLAKGS

SEQ ID NO: 2245 - protein, 290 aa, Zea mays
MDAEWSGDESKTGAAGGVSSADCPGSPPPVSPAPPSTSPAATGAGRRRSANKRVVTVPLADVSGPRPKGVGEGNTPTDAWAWRKYGQKPIKGSPFPRAYYRCSSSKGCPARKQVERSRAEPDKVIVTYSFEHSHSEAMAAARAQNRQAPKPKPAQPQPVPPESSSSGSHDVAAAATVVCAGGAPIAAETEAGAEAVEVHDEFRWLYDGVSVTSSASPPDVEAADEMLYGAMFFGDPPAPLPDEFGDVGGLFDGEGGEEDAMFAGLGELPECAMVFRRHAGDGISVAGRVK

SEQ ID NO: 2246 - protein, 269 aa, Pimpinella brachycarpa
MGRQPCCDKLGVKKGPWTADEDNKLINFILTNGQCCWRAVPKLAGLRRCGKSCRLRWTNYLRPDLKRGLLTDAEEQLVIDLHARLGNRWSKIAGRLPGRTDNEIKNHWNTHIKKKLIKMGIDPVTHEPLHKEETNSQKEILLQPFQSPAETENHVPPIPHTNDMASSENSCTPTDQNSSGDESNSLSAICDQIDDSLISYLFEDDTPGLVDAPWENFNKVDMVLPSWDESFPWLLDCQDFGIQDFGFDCFNDIEMNMLTQLDVKNDQTG

SEQ ID NO: 2247 - protein, 360 aa, Glycine max
MSPPVLSMGEEEGKSNVTLLGSSSTAMESVCLKSLEFKERNYMGSSDCSSVDSSVPSFSEECKSNLNLKATELRLGLPGSQSPERDSDLCLRSSTQLDEKPLFPLHPLTDDHHSSAKTAVLGNKRGFSDAMNGLSSEGKFLVDLEAANPILSPRPACNLGLKPGSTLDKVGAQQTKMKEVATTKGNETRPSIDGSANNNSAPATKAQVVGWPPIRSFRKNSLATTSKNNEVVDGKKGVGALFVKVSMDGAPYLRKVDLKNYSTYPELSSALEKMFSCFTISKCGSHGILGREMLNETKLKDLLHGSEYVLTYEDKDGDWMLVGDVPWEMFIETCKRLRIMKSSDAIGLAPRAVEKSKSRT

SEQ ID NO: 2248 - protein, 185 aa, Coffea congensis
PNKVAKLNAPSKTVDHAQAEATMRKARVSVRARSEAPMITDGCQWRKYGQKMAKGNPCPRAYYRCTMAVGCPVRKQVQRCAEDRTVLITTYEGTHNHPLPPAAMAMASTTSAAANMLLSGSMSSADGLMNPNFLARTILPCSSNMATISASAPFPTVTLDLTQTPNPLQFQRQPSTPFQLPFGTP

SEQ ID NO: 2249 - protein, 319 aa, Oryza sativa Japonica Group
MEPATETTATSPAAAAAAQPEAEAEAEAESAATPVAVAAAAAATYQPPAPVVPVAVAGAAAGRGNGKRKRGRPRKYGPDGSLLRPLKATPISASVPDDSGGGQYTPAAAVGAVMKRGRGRPVGFVSRASPVSVAVTAATSTAAVVVSSPATHTQTPLGPLGELVACASGANFTPHIINVAAGEDVNMKVISFSQQGPRAICILSANGVISNVTLRQQDTLGGTVTYEGRFELLSLSGSFTPTDSGGTRSRSGGMSVSLAATDGRVIGGGVAGLLVAASPVQVVVGSFLPSYQLDQNATKKPVIEITTVLGSGSTPTCDA

SEQ ID NO: 2250 - protein, 306 aa, Glycine max
MDTAQWAQGIGVVKQPTMEGGSKPPPPPMLERRARPQKDQALNCPRCNSTNTKFCYYNNYSLSQPRYFCKTCRRYWTEGGSLRNVPVGGGSRKNKRSTPSAPPPSSASAQAKKLPDLTTPNFPQSASQDPKIHQGQDLNLAYPPAEDYNTVSMSKLIEVPYNTELDKGGLHQNPTSSSTPTSASSHHQLSAMELLKTGIAAASSRGLNSFMPMYNSTHHGFPLQDFKPPHHGLNFSLEGFDNGTYGGLHQGIQEDPTTGGARILFPTVEDLKQQVPSTNEFDHQQNRSQEGSAHGYWNGMLGGGSW

SEQ ID NO: 2251 - protein, 240 aa, Medicago sativa
RGKIQIKRIENTTNRQVIFSKRRNGLLKKAKELAILCDAEVGVMIFSSTAKLYDFASTSLRSVIGRYNKSKEEHNQLGSTASEIKFGQREAAVLRQQLHNLQESHRQIMGEELSGLTVKELQGLENQLEISLRGVRMKKEQLFMDEIQELNRKGDIIHQENVELYRKVYGTKDKNGTNRVLSLTNGVGIGDDSNRTCESPAQPATETRTTTALMHSLEISVLTCKQGKWTQILISYMNGI

SEQ ID NO: 2252 - protein, 81 aa, Chlamydomonas reinhardtii
QVEQCGIDLKSAPKTHQRFRLCNTHIKAPVVVVDGVHSRFCQQCSRFHPVDEFNGTNRTCRMMLAKNRARQRSTTSGPGSG

SEQ ID NO: 2253 - protein, 301 aa, Oryza sativa
MEDLYSIHPGISRVGGAASEASGVGVVVGGGGGSSSSDLTELMKAQIAGHPRYPTLLSAYIECRKVGAPPEVASLLKEIGRERRAGGGGGGAGQIGVDPELDEFMEAYCRVLVRYKEELSRPFDEAASFLSSIQTQLSNLCSGATSPPATTATHSDEMVGSSDEDQCSGETDMLDIGQEQSSRLADHELKEMLLKKYSGCLSRLRSEFLKKRKKGKLPKDARSALLEWWNTHYRWPYPTEEDKLRLAARTGLDPKQINNWFINQRKRHWKPSDGMRFAFMEGVAGGSSGTTLYFDTGTIGP

SEQ ID NO: 2254 - protein, 1019 aa, Physcomitrella patens subsp. patens
MERARWGPGWQEGEKGEGREGGVGREGKQGNWARGRRGGWLAYGAGTGMDEEGGGDESSFGRDRGPVLWLVSLGADEEVGVASSFCSGSLDGVCRRWGRKILVEALAMMQFVPIVVARAHRKFFATALSCSEGSLVWVADRVEHGARKEHALGSSGLVSSAAVNGSFVASPLDSLLPTHSLPCFSGTSDASCALVELFPAAVKKQQEEEEMTLSNLTSASAGEVSVSSGNRMDGTNTGMPPTSSTPPTPTTTTVTVSSGQPLTVAVKRKRNLPGTPDPEAEVIALSPKTLMATNRFVCEICNKGFQRDQNLQLHRRGHNLPWKLRQRTSKEIRKRVYICPEPSCVHHDPSRALGDLTGIKKHFCRKHGEKKWKCDKCSKRYAVQSDWKAHSKTCGTREYRCDCGTLFSRRDSFITHRAFCDALAEESARVSAGKQGGGQPDGLMGAGSSSISVMGAPSSPHGNNVGRMSGDPLASVVPLASRPGGGMPQSMVGLGGLSEGGHSLLPRWSGNPGSSPVSRTGTGLSLWLGPGPGPPGNQHQMHQLLSGSDGNSSFLMQPHKGMQGGPGLPGMMNPLDYDVPQAPRPSSGHLPLTPRGSLFAHLFASGNGMHGLQGSSPSQSGSTAGIGISGFSDLTAGANRMERGSPTSSAGLTSNSSSGNTNGAGNLSSVSPLFNAHHQQQQHTASAQMSATALLQKAAQMGATASNTSLLRGFGLGGTDSSSMGIWQGQRQEQQSQQQSQQQQHQSQQQHQSQQQQQSQSQPQLQHQQQQQQQSQSQPQLQQQPQQQQQQQQSQTQPQLQQQQQGRAGDLPLNSMCNMVNHPLMRRPGDLQSVSQGLGGTSPGQSNNFGGGQGRLSDSSANVQDFMNSLSGGAGIFGGPLGNMPSMFGPSSNNMGGMLPPSTHRMSPSEVLANSAFAGGQGVLQGLSPSSLLPGLGGSSRGENDGSDRFTRDFLGVGRASGMTAAGGGMGRTLSQRDLASITSLGPGVDLGAFFNQRENLRSVNASGHSPGKSWDAAT

SEQ ID NO: 2255 - protein, 1001 aa, Oryza sativa
MSTGGNGGGVGVRRRRWNLYWCYVCRRALRVVVPSATSDVYCPRCFGRFLHEIDLPVPRVSPPAEDQFFQPPFLPYDGPRRWVLYTGGGGGGDYGGADVTARRRRLPSPPPAPGTRRQDGAGDGDPPPPAPAIDPGEYFAGPDLNALIDALTQDDRPGPPPAPESAIESLPTVHISPDHLPADGGSECPVCKEEFELGEAARELPCKHAYHSDCIVPWLRLHNSCPVCRQEVPPPPEPDGESPGIDGGCDDGVGGGGEPAEPPRPAMAGWDPIALLAIALRPDLNGWENSHGRSESEADDDEVAGGGVSPHLLKRTTTLTFWVLHPPIITGVHALTKPALDERCRWNRFGFFLFDEKIGMIARDTVLRFAVRLFVVIVVSSRSSSADDGGGDGGVDFIYQGFQHAANLTMDGSAKVLHGGALQLTNDSNRLVGHAFHAAPVRFLDDGAGGGGGGVVSSFSTAFVLDIVTVGSGGGHGLAFVIYLGVLGPRTNGNASDHVFAVEFDTVMDLEMNDTNGNHVGVDVNSLVSVVSEPVAYYAGDGSTKVPVQLESAQQIQAWIDYDGGSSILNVTVAPATVTERPRRPLISTKLDLLPIFKENMYVGFSSATGKLASSHYILAWSFRTNGVAQSIDLRRLPKVPRQSSPPPKLLIIKFAAVACAGTLTLIAAAMVAVLWLRRRAALADTLEEWELEHPQRIPYKELYKATKGFKESELLGAGGFGQVYRGVLRRRSGEAVAIKRISNGTRQGMREFVAEVASLGRMRHRNLRFAILKGVAHGLLYLHEEWEHVVVHRDVKANNVLLGAGDTGAARLGDFGLARLYEHGATPATTRVAGTLGYMAPELTFTSRATTATDVFSFGALLLEVACGRRPIEPAAAGEADGDVLLVRWVRDRALDGDGGGGDVLRAVDPRLEGCYDEEEARLVLWLGLMCSQARPEARPSMRQVCRYLDGEEMLQEDATPAAIFSGADSSDLFGGSFVVSMTSSSAGGTMSASSLQGGR

SEQ ID NO: 2256 - protein, 382 aa, Glycine max
DFEIPPEAQRGSLSTVEGILMRAADELQTLQEERKKVAPETAEAIDQFLVKLRACATGESAFTFILDDPAGNSFIENPFAPSSDPSLTIKFYERTPEQQASLGYLVDSTHIEGIHDETPEGGEAVTADQVRREPHGSIGATAGHRAIAQSNSSEIAEALFRYTAPEEVMTFPSSCGACAASCETRMFVTNIPYFQEVIVMASTCDSCGYRNSELKPGGRIPEKGKRITLNVKNVNDLSRDVIKSDTASVKVPELDLELASGTLGGIVTTVEGLITKISESLERVHGFTFGDSLDEQRKGKWIDFKARLNKLLSLEEAWTLILDDALANSFVAPATDDLKEDNQLSFEEYERSWEQNEELGLNDIDTSSADVAYESTNTTKTE

SEQ ID NO: 2257 - protein, 425 aa, Oryza sativa Japonica Group
MMGSGMPHMYFASSSHGTGAHYQSPGGAPITMAVPDMGFLVAGIGIAPSSFVMPEGALAASYSAMATVPVGVVVPQQQSSRFGGNNGNPGSFKGAWTRQEDEVLKQMVILHGDRKWATIAKSLPGRIGKQCRERWTNHLRPDIKKDVWTEEDDRMLIEAHKTYGNRWSVIARCLPGRSENAVKNHWNATKRSLKSKRRMKKKSVQVVNSPPGQLSPLEEYIRSQYPSAVETTPPPPAVPAPPSDVIVHGAGSVSAGPTVATQEPTGTNPSEMGIYLGLGNPAGPTTQQLAAMNLNMSLAPDLNAYNDQREGYYLPFVPQGNLHYGMHVPAPPVQQQQQQGISVDQGLHSSCLSLYHPFPGTHPVSLDFGCQSSNHANAGGYYSEAGPSSGSGSGDPDDVDVIQMASRQFLMPSEAEVTLDLTRFK

SEQ ID NO: 2258 - protein, 609 aa, Schizosaccharomyces pombe
MIQTASTISSNGGTNQGMESSSANSPEMHGTQNSMSVGMSGSGSSQNRKITQFSNKLYNMVNDSSTDSLIRWSDRGDSFLVIGHEDFAKLVLPRYFKHNNFSSFVRQLNMYGFHKVPHIQQGVLQSDSPNELLEFANPNFQRDQPELLCLVTRKKAGSQPVEESNTSLDMSTISSELQNIRIQQMNLSNELSRIQVDNAALWQENMENRERQRRHQETIDKILRFLASVYLDGKQKPPSKVMPKSRRLLLEAKYPTVSPTNEPSAHSRPSPQGTTANSSSASISSLHNTTPDGEGKYRSVQNGRALNYVSSFNSDSHSPKDYISQSYTNEPGLKKESADSFNNSIDSYISPNQSPNTDVPSLNRDDTTDPKVVNTGDIINMLDDANSIEGSNMNSLSPLLFDYPNSLYPVNNTSSEQHHNSYRGSVSNSQPSGNLSESTNLQPVQPVDYMSNSNPSYGSYNAEDQLTNFHPGYAMDQKRISKLSDGITKQDQNIQALADILGIPLGDGKIDDAGFSANSPTNLNLPVSSDLDSVLNIPPNEDVFPDSNPVFDEFTNISNLTSPIEASNGNTFGSNPVSLPNQQKSVNPSLMTVSSPRQVRKKRKSSIGA

SEQ ID NO: 2259 - protein, 208 aa, Triticum aestivum
  misc_feature (186)..(186): Xaa can be any naturally occurring amino acid
NFQNCSSTGKNVSLTVLQESTSDRLKIRSSTEKNVSLKVLQQYFAGSLKDAAKSIGVCPTTLKRICRQHGISRWPSRKIKKVNRSLQKIQNVISTVHGVEGEIKYDPATGCIVSSVSHTEESSMMMNVEHQSSDSLPIECHKFQPDYDAYQREHLGQAVLHKAQNDKRSETHINLNPGGLCRNSNXARTSKGPRCQDASNKFVSYKKK

SEQ ID NO: 2260 - protein, 110 aa, Glycine max
IILNSSDQQSLHPSLLVCIISGSSEGKDRSMSTTATTTSEEVSSNEWKVIHMSEQEEDLIRRMYKLVGDKWNLIAGRIPGRKAEEIERFWIMRHGDAFSVKRNGSKTQDS

SEQ ID NO: 2261 - protein, 232 aa, Brassica napus
KDKTALDVQFPKPVCVDGDDLKSPSCVNMIPNGSLARHGNHTNLVRDDDEKLYSSRKCSNKFTSYKSPAIRRIRKSKYSKQVSKDFGHYRADVGIKALYRKRKSCYGYNTWKHETIYKRRRSPDRGSVVTSDGGLSNGSVSKLPEKRKSVKLSIKSFRIPELFIEVPETATVGSLKRTVMEAVSVLLSGGIRVGVLVHGKKVRDDKRTLSQTGISSEENLSNLGFTLEPGGT

SEQ ID NO: 2262 - protein, 200 aa, Oryza sativa Japonica Group
MDGESSLFEGESAPPDYAKKAMPADRLAELALLDPKRAKRILANRQSAARSKERKIKYTGELERKVQTLQTEATTLSTQLTLLQRDTSGLTAENRELKLRLQSMEEQAKLRDALNDALREEVQRLKIAAGQVPNMNGNSFNGGLQQQQQQQMPTYFSQQQQMHYLSGHQGRHHHPNNPHNSLNGGQSMSGQTLNDSMDFM

SEQ ID NO: 2263 - protein, 389 aa, Zea mays
HETITYNILIEKSRGATTPQAQPYKSTNKVEFYGPLGLGKPMEEMLMAGNANPNPPPAAAPSAPGAQTQSQRGGGAPPPAAGAAAPSAGATVGAAGTERRARPHKEKALNCPRCNSTNTKFCYYNNYSLQQPRYFCKTCRRYWTEGGSLRNVPVGGGSRKNKRSSSSAASTSAAMSGTVSVKNPKLVHEGAHHDLNLAFPHHNNGRALQPPEFPSSFPNLESSSVCYPGAAMLGNGAAGRGMGALSAMELLRSTGCYVPLQHVQLGMPAEYAAPAGFTLGEFRIPPPPQSQSVLGFSLDTHGTGGYSAGGLQESAVGRMLFPFEDLKPAVSAAGGGASNDGADHRQNDHRKDQAAGDGSSVTGGHETPGGFWSNSLIGNGSSNGGGGHW

SEQ ID NO: 2264 - protein, 306 aa, Triticum aestivum
  misc_feature (98)..(98): Xaa can be any naturally occurring amino acid
  misc_feature (116)..(116): Xaa can be any naturally occurring amino acid
  misc_feature (128)..(128): Xaa can be any naturally occurring amino acid
  misc_feature (135)..(135): Xaa can be any naturally occurring amino acid
  misc_feature (145)..(145): Xaa can be any naturally occurring amino acid
  misc_feature (175)..(175): Xaa can be any naturally occurring amino acid
  misc_feature (258)..(258): Xaa can be any naturally occurring amino acid
  misc_feature (286)..(286): Xaa can be any naturally occurring amino acid
MAYQYHHQDHALGMDAAAAAAGNPGGGFAPGLGAGAGGGGWEREKAAIEAHPLYERLLEAHVACLRVATPVDQLPRIDAQIAARAPPPMPPAGAPAGXGEELDLFMTHYVLLLCSXRNSSSQHVRVHXMEALMAXCWDLERTSQXLTRASPGEVHRGNYVCDDEDQSGLTVESNXYPGNDVSDGMGFGMLTEGDRPLVQRVTQDLIHHLNTGVYTENLVGIRGGVLRKRRAGKLPGDTASTLKAWWQAHAKWPYPTEXEEKARLVQETGLQLNQINSGFINRRKRXNWNSNPNFFPFPNKNQKKNG

SEQ ID NO: 2265 - protein, 770 aa, Kluyveromyces lactis NRRL Y-1140
MSEQKSEISAVKNQEHPDTEPKQEQEGESPNKRIHLDTRDGKEQPEKSGQEKKDDKSNGSNATEGTSNVKSEVQPTVQNSSTPQNPHFIHKLYSMLEDDDLKNLIWWSPSCDSFLIRPTERFSKALSAFFKHTNVASFVRQLNMYGFQKVSDHKSTWAANTDDSDEPSINLWEFKHSSGYFRKGDTESLKSIKRGSSKYHMSNNRKNSAPTASTFSGSGSQDSASWNEFPPPNRSHSYTSHDAAHIMPNPLYNTQDGLALYPTGANYPVNLVPSVDYYNSPQHHIKNKQQQQQQHQHQQQQQQQQSIDTNVHELHQSISGLRNEHSDLQHSYEMAVEELRATNIDMIKMLDIVQKTMVERIGSPLNEDGSVPRPRTPLSNATRKGSMLSPGSKPPAHTLKTNKEFNSDEQRASTMNELAKIRESIFARFQKFHETMQHSISVMDLKPQSFSSLQPNMNSSTLPSSVNLLQHQYNAFNGNAGPSPQSYHMNPRGSQSDQHVNLMMNPFERRISSTGSSKKRHMSVLMDPLAPAPPQQPLQAQIQLQPQQQPQQQSQQQSQQQQQQQQQQQPHQQQHQQQHQQLQANQNPQQAFTIAQGSSQPNVISYKPYYPYGTVPVSNFSGSQLYSNTPINSTPGHSSVPSEYGLAIEAQGNFVINGPQTPVNIIKPIPAKVPYTVLSDHTTPTGLGPLHGSATQLPQVLSQHQHQHPAFQPAHTLVQPQPISQPQSLSQPPQAPPSMNTSQFSVSKQPQHQSGSNSGLHSLLTHDSRN

SEQ ID NO: 2266 - protein, 356 aa, Capsicum annuum
MSSNSSLSVVESKLPPGFRFHPRDEELICDYLMKKIDQSPDQQQQYPFLIEVDLNKSEPWEIPEVACVGGKEWYFYSQRDRKYATGLRTNRATVSGYWKATGKDRAVVRKGSLVGMRKTLVFYQGRAPKGRKSDWVMHEFRLEGPLNNNIRPQISSPREDWVLCRVFHKNKELLAAKQGTSSNNIYYDDGTISSSSVPQLMENPYITFDQTQPNNNNINMNELYYEQVPCFSIFTPNQTTFTSHSHHHHHPATSTTTGATPITTAYGGFPADIGNYLNATATSSTCDNKVIKAVLSHLSTKNIIMEGNNNNSNFNNSSAQNIMNIKGGNSPSFGEVSSETSFLSEVAYHPTMWNNY

SEQ ID NO: 2267 - protein, 232 aa, Vitis vinifera
MAAVDDGSLACLNSIATARKKKEKNKRRFSDEQIRLLESMFESETKLEPRKKLQVAKELGLQPRQVAIWFQNKRARWKSKQLERDYSILRGNYNSLVSRFESLKKEKQALVIQLQKLNEMVQQSGGAKQDSEQRLVQNSAESEADNRDNGNCESEVKPNLSLERSEHGGGVLSDDDSSIRADYFVMEEEPSLLTMVEPVDGCLTSPEDWGSWDSENVFDQSSGSYQWWDFWG

SEQ ID NO: 2268 - protein, 261 aa, Arabidopsis thaliana
MSVDSEETSSNGVVPPNSLPPKPEARFGRHVRSFSVDSDFFDDLGVTEEKFIATSSGEKKKGNHHHSRSNSMDGEMSSASFNIESILASVSGKDSGKKNMGMGGDRLAELALLDPKRAKRILANRQSAARSKERKIRYTGELERKVQTLQNEATTLSAQVTMLQRGTSELNTENKHLKMRLQALEQQAELRDALNEALRDELNRLKVVAGEIPQGNGNSYNRAQFSSQQSAMNQFGNKTNQQMSTNGQPSLPSYMDFTKRG

SEQ ID NO: 2269 - protein, 184 aa, Coffea canephora
PNKVAKLNAPSKTVDHAQAEATMRKARVSVRARSEAPMITDGCQWRKYGQKMAKGNPCPRAYYRCTMAVGCPVRKQVQRCAEDRTVLITTYEGTHNHPLPPAAMAMASTTSAAANMLLSGSMSSADGLMNPNFLARTILPCSSNMATISASAPFPTVTLDLTQTPNPLQFQRQPSTPFQLPLEP

SEQ ID NO: 2270 - protein, 357 aa, Vitis vinifera
MKILVFYILFIYSDSICASETDCCAQCSIYSVQLLRNNYCLTKSVPRKRTGKKDRHSKIYTAQGPRDRRMRLSLQIARKFFDLQDILGFDKASKTIEWLFTKSKAAIKELTGNLPQIKHIGGGGTSGGTSASSISESKGTSRLKEIAHNGEPKGIVTNGESSVLTTPKEKKNRKPRSKSALNPLAKESREKARARARERTREKMIMRSLEKSKQCSEANPNNLEHTHSLEHQMATVGIIEKFLGIPSSSTSSSIFNYSPNIAVSSGVNSNNFPCFPGNWDIDDSRIHSGYSAMTNMGPSTGNFQDQNPTSVFMTTTNVRQQNPTSLFMTTSNRRLESQFQDQNSRNPLDGNKNHRLC

SEQ ID NO: 2271 - protein, 385 aa, Oryza sativa Japonica Group
MMMSSSADHFSNNNNNQAMYLEQDEDFSQMIMELCDFDASSTTQARHGGEAAAAAAGNARAVLTYLTFLEQKIGHLRGIISSTPNPPPQIVAAELSCIVVQLVSISKNLAAARRGGDDADADAKHDGSSDADEGADGDGERAPPRGSYEVVQIEKEEILAPHVHFCGVCGKGFKRDANLRMHMRGHGEEYKSAAALAKPGGSPSRSPAAADAAARRRFYSCPYVGCKRNREHKSFQPLKTPTCVKNHYRRSHCDKSFTCRRCNVKRFSVVADLRTHEKHCGRDRWVCSCGTSFSRKDKLFAHVAIFDGHSPALPPEDYDDDAASGQLPHAAGEAVGRTVDTNRFFSDGLMIKGSMEDERGSLSPMGLDYCEFDGIDLFAAAAFDF

SEQ ID NO: 2272 - protein, 456 aa, Saccharomyces cerevisiae YJM789
MQPKTFVHQLHAILLEPEVNKWIYWSPTDNTIFFLKPYDPNFSTHVLKRYFKHGNVNSFVRQLHMYGFHKLSHPSPDQSSANNGNVKELVEWKFTHPSGFFFKKANAGILNKIQRKSTGVGKDGKRKNILSPISVSYVDASRLNVLSQQSGPVSAREPSNMFMGSPVHYSTSQSPPHISIPQQQQSSGPYLISSLPPQQPTVNMMRRQSISARMMNSYDYPNQFSTQDSIVQPQQPQQVLSPQALSGPPMKKSGTLSSTDDLKTTSLPIVNYPMPYHPGAFAQQQQQQQQPLPTVPPYSSYSTPFPSMMNSLSNSASNSPALGVCNNNVTLPKKSNISERQALDNHIQTLKNSLSTITDLIEKHINSASQDENKTLTNDAMNKDLRTSLSLLQNSKEEIIQLESKWMSMQSVKTTALPLQETTNTSSTLTSLTSSIIPKSIPIITKGEVATKPASY

SEQ ID NO: 2273 - protein, 558 aa, Vitis vinifera
MADVKLEEEECCVENKQLVTASSSSLSEGSGSVTVKSPGICSPATTSPSHRRTTGPIRRAKGGWTPQEDDTLRTAVAYFKGKSWKKIAEFFPDRSEVQCLHRWQKVLNPELVKGPWTQEEDDKITELVSKYGPTKWSVIAKSLPGRIGKQCRERWHNHLNPDIKKDAWTLDEELALMNAHSKHGNKWAEIAKVLPGRTDNSIKNHWNSSLKKKLDFYLATGKLPPVVKSGFQNGAKDTNRTNAPGKLLGCSNKGSESTAQTSSGTTDLCKLEEDSKDQLESSAPLQDAGVSLSVPPNESADSEDAQCKPYLSKIDCSCGNSESILRFEKCRINGNIDESKVVGTPLQLGIPTYDSLYYEPPRLESCVPLDSDLISKCWMQYECDTSPFMSPISFFTPPCVKGSSLSMQSPQSILKNAARTFPNTPSILRKRKTEAQTPLLPTKIGKADQEAVNDSFHASDEQERTGNSLEKSVSRDGSSCDSPACHGDNSIGLCNGKAFNASPPYRLRSKRTAVFKSVEKQLEFAFDREKCDGNTKSTEKGNSPVAEDCLRATKMGVT

SEQ ID NO: 2274 - protein, 238 aa, Stylosanthes hamata
MAPREKTPAVKVNGKSNAGVKEVHFRGVRKRPWGRYAAEIRDPGKKSRVWLGTFDTAEDAARAYDAAAREFRGPKAKTNFPFPDSDDINNNNIVVVKNNNRSPSQSSTVESSSRDRDSYSAAAATAVADSSPLDLNLAPQELDSPDPFGSHSTQPFAVFPGGMPAAKQALYLDAVLRASMASHGQFGFGYNRPAAAGAQSDSDSSSVIDLNQNEGDVAKNNGRGLVLDLNEPPPQEMA

SEQ ID NO: 2275 - protein, 395 aa, Arabidopsis thaliana
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKRHVTSYFAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQVSDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 2276 - protein, 282 aa, Glycine max
  misc_feature (253)..(253): Xaa can be any naturally occurring amino acid
  misc_feature (260)..(260): Xaa can be any naturally occurring amino acid
  misc_feature (273)..(273): Xaa can be any naturally occurring amino acid
MPSQAELSMMDYKPYSYSTLLKSFLDQTETDQTYKLEEFLSRLEEERVKIDAFKRELPLCMQLLTNAVEASRQQLQAFRSNQGTRPVLEEFMPILKHPNSQESAEKTSNISDKANWMTSAQLWSQASEGTKPQSTITSLPKEGADIGFSVSPKLALDNKHRNGGAFLPFSKERNSCQGLRGLPELALASPEKEIEENKCELEAEKCSKRENPGKGGSCEGVNVDQGKSASVASEAQTANTTTTTTNTSGQTHXKARRCWXSPDLHRRFVNALXMLGGSQVAT

SEQ ID NO: 2277 - protein, 172 aa, Oryza sativa Japonica Group
MQSQIVCHGCRNILLYPRGAPSVCCAVCHAVSSTAPSPGMDIAHLICGGCRTLLMYTRNATSVRCSCCDTVNLVRPVSSIAHLNCGQCQTVLMYPYGAPSVKCAICNFITNTGMNTMRHLPPNGTSYTAPSTSAPTTQSQNVTVVVENPMTVDAKGKLVSNVVVGVTTGGKK

SEQ ID NO: 2278 - protein, 318 aa, Oryza sativa Indica Group
MDFPGDAEDFALEFIREHLLGGDAPVLPPAAVPAAAAYPPTSTMFLPQQQRGYAGLTPQEYVVDSAPAADQAAFRDDQPDPAADVMIMFGGERFPAVKPSSSSSPSLTVTVPPSSFGSWAPAAVPAAAATAAAVEDFRKYRGVRQRPWGKFAAEIRDPKRRGSRVWLGTYDTPVEAARAYDRAAFRMRGAKAILNFPNEVGTRGAELWATPPPTNKRKRQPEDDTAAADDVEVIGVANKAVKTEAPTSAYSSSSLSSMSRDTTATTSSAGTSTGSSEPTSFPVVTPSSWSWDQYWDGLPPLSPLSPHPALGFPQLTVS

SEQ ID NO: 2279 - protein, 372 aa, Physcomitrella patens subsp. patens
GERRSLNSELWHACAGPLVSLPPVGSRVVYFPQGHIEQVAASTQKDADAHIPNYPSLPSKIICLLDNVTLHADPETDEVYAQMILLPIQISEKEALLSPDLEVVNKQPTEYFCKTLTASDTSTHGGFSIPRRAAEKVFPPLDFTRVPPAQELVARDLHDQEWHFRHIYRGQPRRHLLTTGWSVFVSAKRLQAGDSVLFIRDDKGNLLLGIRRANRQQTVMPSSVLSSDSMHFGVLAAASHAAATSSRFKIFYNPRQSPSEFVIPLTKYHKALYNTQFTVGMRFRMVFETEESSVRRYVGTITGLGDLDPIRWPKSHWRSLKVGWDESTAGERQHRVSLWEIEPLTTPFLLCPPPLALRSKRPRGMPGKGVQL

SEQ ID NO: 2280 - protein, 328 aa, Oryza sativa Indica Group
MDFHHGDADDFALEFIREHLLGVDGATATATEPADLEVVEPAAAYPPMSWQEQRQQEQHGCHVELTDEHLESAPAAEAAAAFRTAPAQPAAEVMIKFGGEPSPVRPSSSLTISLPPSSFGSWASAAAPAAAAVEDFRKYRGVRQRPWGKFAAEIRDPKRRGSRVWLGTYDTPVEAARAYDRAAFRMRGAKAILNFPNEVGTRGTELWAPPPPPPAHSAAASTTNKRKRQPSEDPDDGVEVIGVVSKAVKTEAPTSNSSSLSSSLTSRDTTPATSSAGAEHAGAAAESSPATPSSWSWEQYWEALLGGLPPLSPLSPHPALGFPQLTVN

SEQ ID NO: 2281 - protein, 237 aa, Arabidopsis lyrata
RYLKPAQNLLDEVVSVKKELNQMGKKKMKVNDFNNGSKEIEGGGSGELSNDLNGKSMELSTVEREELQNKKNKLLTMVDEVDKRYNQYYHQMEALASSFEIVAGLGSAKAYTSVALNRISRHFRALRDAIKEQIQIIREKLGEKGGESLDEQQGERIPRLRYLDQRLRQQRALHQQLGMVRPAWRPQRGLPENSVSVLRAWLFEHFLHPYPKESEKIMLAKQTGLSKNQVANWFINA

SEQ ID NO: 2282 - protein, 249 aa, Oryza sativa
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 2283 - protein, 886 aa, Oryza sativa Japonica Group
MGEGFGFSQLLFLLLVTTTTAGVEASTNQVAEQQGAPLYNLPWKIPCKVMNVELKAEPDTDEVYAQLTLLPEKQQDGNGSGNGNVSKDKVEEEEVVPPAATERPRVHSFCKTLTASDTSTHGGFSVLRRHADECLPPLYSFFDRLIVAMPLTSLLDQDMSQHPPTQELVAKDLHGVEWRFRHIFRGQPRRHLLQSGWSVFVSAKRLVAGDAFIFLRGENGELRVGVRRAMRQQANIPSSVISSHSMHLGVLATAWHAVNTGTMFTVYYKPRTSPSEFVVPRDLYKESLKRNHSIGMRFKMTFEGEEAAEQRFTGTIVGVGDSDPSGWADSKWRSLKVRWDEAASVPRPDRVSPWQIEPANSPSPVNPLPAPRTKRARPNVLASSPDLSAVNKEVASKVMANSQQNGLPRAFHSQENMNLRSRFGDSNELNTSQKLTMWSSGSNQEKNNVSVQRELGSQSWMQMRRPDGSSEILSGFQPLKDTRNPLSSFPSQISGNRSNTWNTINVHYPDQNANHNMYPGTWSLMPPNTGFGVNQQNYLMTPDITLPQRSLNAKFGGNGAFTSLRAHGIDQRSSGWLGHIEPSSHIDDASSSLIKPQPLVIDHNVQKAKGSSCMLFGISLDSPAKPELLISPPSVAFDGKLQQDALEEDECSDPSKTVKPLDGAQHDSAREKHQSCPDGTKNIQSKQQNGSSRSCKKVHKQGIALGRSIDLTKFTCYDELIAELDQMFDFNGELNSSSKNWMVVYTDNEGDMMLVGDDPWNEFCNMVHKIFIYTREEVQKMNPGALNSRSFVVCKNRRRHIHGRKESFRGVVVVAGALYVSGKPRSTPFVDGACPGISCPLFVFDKFWVCFVEVLSYCMICPVVVKGAEAKLPRPVRLLACALPPS

SEQ ID NO: 2284 - protein, 472 aa, Oryza sativa Indica Group
MQFTHTAPPPPPLHPNGHGLGLGLYLDVGATRGGGGARPWSSSSSTTTLGGSGYFPSSAAASKISLGNLNSTGCMEQLLVHCANAIEANDATLTQQILWVLNNIAPADGDSNQRLTAAFLCALVSRASRTGACKAVTAAVADAVESAALHVHRFTAVELASFIDLTPWHRFGYTAANAAIVEAVEGFPVVHIVDLSTTHCMQIPTLIDMLAGRAEGPPILRLTVADVAPSAPPPALDMPYEELGAKLVNFARSRNMSMDFRVVPTSPADALTSLVDQLRVQQLVSDGGEALVVNCHMLLHTVPDETAGSVSLTTAQPPVSLRTMLLKSLRALDPTLVVVVDEDADFTAGDVVGRLRAAFNFLWIPYDAVDTFLLKGSEQRRWYEAEVGWKVENVLAQEGVERVERQEDRARWGQRMRAAGFRAAAFGEEAAGEVKAMLNDHAAGWGMKREDDDLVLTWKGHNVVFASAWAPS

SEQ ID NO: 2285 - protein, 232 aa, Zea mays
LATPSSAPTARPSAIPPPRRDQRFKMSNRATHWCYACRRPIRLRGQDIICPNCNDGFIQEISETRGALNNYGMFGPRFDDRLDGRFGMMDAMSALMRRRMAEMGSNPVFDPNAAWASTTQGRPSPIGPRLIFGSNMPAQGSDDSGVNVLVRGGRRIGADRPNFSGFLVGGPSLEALFEQLLLQTGNRQGPAPAPQSVIDSMPVVRITRRHLSDDPVCPVCTERFEIGSEARE

SEQ ID NO: 2286 - protein, 48 aa, Betula pendula
AVKNSPYPRSYYRCTTAGCVVKKRVERSCDDPSIVVTTYEGQHSNIRA

SEQ ID NO: 2287 - protein, 338 aa, Oryza sativa Indica Group
METDEPATKAAGGEPKPSPATKAAGEQEEDDEEESSGGGGTEPEVSTTPAVVVSSSSHMFTREEKETVGERGILNRVFLWTNFELVKEHAAVFVASGDSGPSFFRRKDTGFRVFRETVAHPSSVEKAPVSEYSLFRRDVMEQGGGAADGGDLISLCLMALAAAARGESTALALALAPPPPKLHFRCSLCGRAFASYQALGGHKASHRKPSAAAAAPPAHRDVVVAAAPASSGGVAADADAASEADGRRRRHVCSLCRRGFATGQALGGHKRFHYLHGPSVSATVSSAATAASVGAAFDLNVAPIKEIAGEQRRCGEEADDDDEAESPSPAKKPRRRPG

SEQ ID NO: 2288 - protein, 256 aa, Zea mays
MKVQCDVCAAEAASVFCCADEAALCDACDDRVHRANKLAGKHRRFSLLHPCSSSAQKPPLCDICQERRGFLFCKEDRAILCRECDAPVHSANDMTRRHSRFLLTGVRLSSAPVDSADPSEGEEEEEQENSSRPGNGESCSGGAGAGATTATASDGSSISEYLTKTLPGWHVEDFLVDDAYASDVGACSDGLYQGQDGQISGVLQEAYMPWTGRELVPSDVADERDNWERWVPQMHAEFAGDSKRPRASPSPPCSYW

SEQ ID NO: 2289 - protein, 239 aa, Stylosanthes hamata
MAPREKTPAVKVNAGVKEVHFRGVRKRPWGRYAAEIRDPGKKSRVWLGTFDTAEDAARAYDAAAREFRGPKAKTNFPFPDSDDINSNNNNIVVVKNNNRSPSQSSTVESSSRDRDSYSAAAAATAVADSSPLDLNLAPAGAGFAGSIRFPFQQPFAVFPGGMPAAKQALYLDAVLRASMASHGQFGFGYNRPAAAAAGAQSDSDSSSVIDLNQNEGDVAKNNGRGLVLDLNEPPPQEMA

SEQ ID NO: 2290 - protein, 219 aa, Vitis vinifera
MASSVISNPVTNSDRSRESSKRKKKKKNQIQSQVRDQQNQNHTKWKSQVQQQLYSSKLLQALRQVRLGSSNETPRRGRAVREAADRALAVAAKGRTRWSRAILTNRLKLKFMKHKRQRVTVTGQNRSKKPKVSILRLKGKNLPAVQRKVRVLGRLVPGCRKLPLPDILEEATDYIAALEMQVRAMTALTELLSGAGAGASTTSSNSPADTLGSSRPPTS

SEQ ID NO: 2291 - protein, 92 aa, Brassica napus
MGAPKQKWTPEEEAALKAGVLKHGTGKWRTILSDPQFSSVLKSRSNVDLKDKWRNISVTALWGSRKKAKLALRRNLPAPKQDDNNNTTPLSI

SEQ ID NO: 2292 - protein, 326 aa, Vitis vinifera
MDGSCIDESTTSDSISTSLPALSALPATKSPESLCRVGSGTSVILDSESSIEAESRKLPSSRFKGVVPQPNGRWGAQIYEKHQRVWLGTFNEEEEAAKAYDIAAQRFRGRDAVTNFKPLRTISKPRGDPKQAKLRRSRAEGLMTPFGSDRVTKSREQLFEKTVTPSDVGKLNRLVIPKQHAEKHFPLQTGTTSKGVLLNFEDMGGKVWRFRYSYWNSSQSYVLTKGWSRFVKEKNLKAGDIVSFQRSTGGDKQLYIDWKARNGPTNQINPVEPVEMVRLFGVNIFKVPVNSSVVVANNGSWTGKRMIEMELLSFECSKKQRVIGAV

SEQ ID NO: 2293 - protein, 733 aa, Cucumis sativus
MEIDLNQTASEVGKNAYCYGNCEEGLCNCCLSSSTSSCSSNSSSTPVSSSTYLELWHACAGPLTSLPKKGNVVVYFPQGHLEQIASASPFSPMEMRTFDLQPHILCRVINVHLLANKENDEVYTQLTLRPLPELLGTGVAGKELEELALNGADGDGSGGSPTKSTPHMFCKTLTASDTSTHGGFSVPRRAAEDCFPPLDYTQLRPSQELIAKDLHGVEWRFRHIYRGQPRRHLLTTGWSIFVSQKNLISGDAVLFLRGENGELRLGIRRAVRPRNGLPDSIVGNQNSCANDLARVVKAISTKSTFDVFYNPRAYHAQFIISCQKYVKSINNPVSVGTRFKMRFEMDDSPERKFNGVVVGISDMDSFRWPNSKWRCLTVRWDKDSDHQERVSPWEIDPSVSLPPLSVQSSPRLKKLRTSLQAAPPNNAFTGRGGFMDFEDSVRSSKVLQGQEICSLRPPTSKPEYSLGVWGKFNLSDNSFNTFQSPNSNFYHMASNSAQKMYFPRSEMHSTGQAAMMLSNDSNFPRESALFNPSAVGANVIRTKMERTSRSLDRESLHLASAPPTLGSNMRNSKDEHVNDNATGCKLFGFSLTTETATNVQSSGKRSCTKVHKQGSLVGRAIDLSRLNGYTDLISELERLFSMEGLLKDPDKGWRVLYTDNENDVMVVGDYPWHDFCDAVSKIHIYTQEEVEKMTNGVISDDTQSCLDQAPLCMEASKSSSVGQPDSPPTAVRG

SEQ ID NO: 2294 - protein, 303 aa, Populus trichocarpa x Populus deltoides
MTPVYLNPASSSFPFVDLKEEQHLQLFLSPHQAATSLSGPTNFFNTTHDQRESKLAESRQHDDHEVDKYSISLGRSSDHKLFPSSSFQPVVNDDDDDSNFHKLFSSKTEDGTEGSGDSSVNWMPSRMTTMQEMSNSNRSETDHQPMKFMLKFHNQQCQNNDINSSSNSNIRVCSDCNTTSTPLWRSGPRGPKSLCNACGIRQRKARRAMAAAENGAVISVEASSSTKSKVNSKVKKLRTSHVVQGKKLSNKPPNPPLQSQKKLCFKNLALSLSKNPALRQVLPHDVEEAAILLMELSCGFIHS

SEQ ID NO: 2295 - protein, 237 aa, Vitis vinifera
MTAELQLPPGFRFHPTDEELVMHYLCRKCASQSIAVPIIAEIDLYKFDPWQLPEMALYGEKEWYFFSPRDRKYPNGSRPNRAAGTGYWKATGADKPIGHPKPVGIKKALVFYAGKAPRGEKTNWIMHEYRLADVDRSARKKNNSLRLDDWVLCRIYNKKGIVEKQHTAARKSDCSDEGRCDASTSAAIRHWTIWSRGVAGVHWENPMDFSYNYMDATFPNNQMSPLQDMFMYLQKPF

SEQ ID NO: 2296 - protein, 199 aa, Oryza sativa
  misc_feature (138)..(138): Xaa can be any naturally occurring amino acid
  misc_feature (172)..(172): Xaa can be any naturally occurring amino acid
MGRAPCCEKMGLKKGPWTPEEDKVLVAHIQRHGHGNWRALPKQAGLLRCGKSCRLRWINYLRPDIKRGNFSKEEEDTIIHLHELLGNRWSAIAARLPGRTDNEIKNVWHTHLKKRLDAPAQGGHVAASGGKKHKKPKXAKKPAAAAAGPRGCRAVRSSSVTESSMASSWRRXHGNAGITRRPVVCARRKLLPRLRGVPN

SEQ ID NO: 2297 - protein, 41 aa, Aegilops longissima
KGKLPKDARLALVDWWNTHYRWPYPTINNWFVNQRKRHWKP

SEQ ID NO: 2298 - protein, 58 aa, Avena vaviloviana
KGKLPKEARLKLLHWWELHSKWPYPSETEKIALAETTGLDQKQINNWFINQRKRHWKP

SEQ ID NO: 2299 - protein, 366 aa, Oryza sativa Indica Group
MHPNGAPLAVPPGFRFHPTDEELLYYYLRKKVAYEAIDLDVIREIDLNKLEPWDLKDRCRIGTGPQEEWYFFSHKDKKYPTGTRTNRATAAGFWKATGRDKAIFLGGGGGTRIGLRKTLVFYTGRAPHGKKTDWIMHEYRLDDDNVDVPEEGWVVCRVFKKKSIHQRGFDQPDMAAAADEDELRYQLLHGVGMSSSPVDQKHVLLQEQLVAHGAHGGGFVVPAFDASMHLPQLASADAAPCGGGGGGGGGHVAFASMNPLDAAGCGSQNMMTMKMAATSGGEMLLMRSGGVDGGRFGAAADWSILDKLLASHQNLDQLFHGKVAGAHQQQQQQQQQMAMDAASSLQRLPFHHYLGLEAADLLKFSM

SEQ ID NO: 2300 - protein, 431 aa, Oryza sativa
MEASAAKEKDKDGKKMSRVGSWGSMAFYSSSSSSRSQPVSAAEGKNGGKKEKRRSSISRSITCAGSICSTKESSVSSRGRGRRRRSGGGGGGDGGGGGSTSSRSLMGPGYHGDSAAAVSASSSFNSVITAATSATATTTTTTTSSSATSPPSALSSPLSSIGGSFRAMQIRKLSGCYLHCHSVLDPRTLAAVVFSCPDCDEVFVKPDSLELHRSTRHAVSELGADDTSRNIVEIIFQSSWLKKNAPVCRIERILKVQSSDKTIKRFEQHKEAVKEKARSAGDEAGRNPRCVADGNELLRFHCTTFACSLGLAGGTALCCASSSPPPLHCKLCSIIKDGFRVDGNGRITTMATSGRAHDTAEVSPDGEKRAMLVCRVVAGRVKKLHSSNSSEDHDCDSVSPCSEGVYSDLDELFVFSPRAILPCFVVIYSGY

SEQ ID NO: 2301 - protein, 82 aa, Brassica napus
  misc_feature (6)..(6): Xaa can be any naturally occurring amino acid
  misc_feature (22)..(22): Xaa can be any naturally occurring amino acid
  misc_feature (35)..(36): Xaa can be any naturally occurring amino acid
QQHNNXNVFQGNNINGFNYDTXHNNNFEAAQNNSXXNRFQDVYDSAPFDMASFVYRDDMSMPGAAGTMDGMHQKQHDASLWF

SEQ ID NO: 2302 - protein, 310 aa, Arabidopsis thaliana
MVKDLVGYRFYPTGEELINHYLKNKILALSKIKSDDPVWYFFCPKEYTSAKKKVTKRTTSSGYWKATGVDRKIKDKRGNRGEIGIKKTLVYYEGRVPKGVWTPWVMHEYHITCLPQDQRNYVICQVMYKGEDGDVPSGGNNSSEPSQSLVSDSNTVRATSPTALEFEKPGQENFFGMSVDDLGTPKNEQEDFSLWDVLDPDMLFSDNNNPTVHPQAPHLTPNDDEFLGGLRHVNREQVEYLFANEDFISRPTLSMTENRNDHRPKKALSGIIVDYSSDSNSDAESISATVKQITRFLYRYFCAVISILTF

SEQ ID NO: 2303 - protein, 329 aa, Oryza sativa Indica Group
MALEAVVFPQGHFGYGCGRDSPAYGMPWCDVLAAAGGGGGFGEFYGVDEWDDQLQVASVDEWEVASKDNSDASTEGKAAAAERAAPVAAGRRKRRRTKVVKNKEEIECQRMTHIAVERNRRRQMNEYLAVLRSLMPASYSQRGDQASIVGGAINYVKELEQLLQSLEVQKSLKNRSGAMDAAGDSPFAGFFSFPQYSTSPRTGCSAAASAGSSGSASSVVMDDTAGSAESGRQSAAIADIEVTMVEGHASLKVLARRRPKQLLKLVVGLQQLRIPPLHLNVTTVDAMVLYSFSLKVEDDSKLGSVEDIATAVHQILGSIQQQEAVLSIS

SEQ ID NO: 2304 - protein, 692 aa, Zea mays
MGHRPTENLDTDGLQQASVYTQLTASNVGFRLLQKMGWKTGKGLGKNEQGILEPIRADMRDAKLGVGKQEEDDFFTSEENVQRKKLNIELEETEEHIKKREVIAEREHKIRSEVKEIQKVFFCNLCNKQYKLAHEFESHLSSYDHNHRKRFKEMREMQSSSGSRDDRQKREQQREEKELAKIAQLLDFLNEASVRMLIGSSRRISKKSMPLATLLLPSVSTPTAGDHRTHSRRHDHHHGSKRKKKPPPPPSPQPSLPLAPRTPPPPGAPSPKVRAAGKNNHAQYQYQQRRGQPTKNRAAAASSSWEQVKSLLSCRTATAAARVHDPSALARLRGASLCAMRDVVLSSASGDRDTAPLNRRRAPSSSAASGAGSSSHHSSLRGLSGCYECRAIDVEPMSRSVRFRPINLFLKQITMINARLTITRRRYPRPRELCACPQCGEVFTMADSLEHHQAIRHAVSELGPEDSGRNIVDIIFNSSWQKRGRPICHIDRILKVHNAPRTVARFEAYRDAVRSRSRCRAAARVAADGNELLRFHSAPLACALGLGGATALCCAGGASSPCGVCTAIRHGFAPWAGAHPLGVRTTASSARAHDCGCSASPSSVQQTQQPANDAAACRAMLVCRVIAGRVRRGGGGGATSNAADEDQEGPFDSVAVEDAVSSSMYGNLEELFVANPRAILPCFVVIYRVLDA

SEQ ID NO: 2305 - protein, 359 aa, Oryza sativa Indica Group
MENDVHHHRQMMQQQQQQEMDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKQDQEWVLCRVFKKSLELAPAAAAAVGRRGAGAGTDVGPSSMPMADDVVGLAPCALPPLMDVSGGGGGAGTASLSATAGAAAAPPPAHVTCFSNALEGQFLDTPYLLPAAEPADHLAMSSASPFLEALQMQYVQDAAAAGGAGMVHELLMGGGWYFNKGERERLSGASQDTGLTSSEVNPGEISSSSRQQRMDHHDASLWAY

SEQ ID NO: 2306 - protein, 245 aa, Petunia x hybrida
MAREKIKIKKIDNITARQVTFSKRRRGLMKKAAELSVLCDAEVALIIFSATGKLFEYASSSMEDILGKYKFHSASLEKDDQPSLDLQLENSLNMRLSKEIADKNRELRQMRGEELEGLSLNELQKIEKKLEAGLTRVLQIKGTRIMDEITNLQKKGADLMEENKQLKQKMVIMSEGKLPLHSELECMVMEEGQSSESITTHVCSCSSGPPEDDYSNASLKLGCSNGPTVEDDCSDTFLKLGLPFN

SEQ ID NO: 2307 - protein, 543 aa, Oryza sativa Japonica Group
MGEVKENEVVEIFEHDHDNKIRSPENSVPPAMVLDLNEGFGEGSEEGGVGEDGDEEDDDEDDDDDDDDDGGSTSEVAGGGRSSSNNSSTNHNSGSDKDHDMNSSSSKADGGGDRVPTVRQYNRSKLPRLRWTPDLHMAFVHAVERLGGQERATPKLVLQMMNVRGLSIAHVKSHLQMYRSKKLDHESGHERGAISSVFSPMEFHMRRGDHRFHHHDMFFQRAAAAGVSPFSSRMLHENGGGFFASRNPGLPESSRLYGLFQRRQQAPMQKFDFKNCNSFSRNQEWAFNQQHAAARAAGAVNGHGPAKGLIHEMIFRKEGKPTSHLFDVRDAIASTRVTSATTAAAADHRLDGAGKAGNFDWIGSSSSRPLTRTMSAAAAATMGDHHHLRWRGGAAGSGNTTASSDPVVASEAALGSLLERAKTKATEAMRLETPVKMTAAAVAAEEINGRTPDLQLSLSPNAGDHRSAGEKRKFLSEQEVDSDKQQLPLTLSLSLRGGGDNGGGGGAEAAGRLEEEMTGSSSSKKAALGLSTLDLTMSIKALE

SEQ ID NO: 2308 - protein, 278 aa, Oryza sativa Indica Group
MAEAEAEEEMMMRMMCGSGGNEMMKTKMKKKNREGEEEEEVSGGGRMRKGPWTEQEDVQLVWFVRLFGERRWDFLAKVSGLKRTGKSCRLRWVNYLHPGLKRGRITADEERLILHLHSQWGSRWSRIARSLPGRTDNEIKNFWRTHMRKIAHHAKKKTNSPSPAPTTSSGSLSSSLTTATTTMATAAALQESSSCGGDDEAVDQLVAAATTPASQLLTMDYTMDQLWNDIAAAEADTSCYDAAAMASPPSPVWEFCTDYSLWRIDDEEYYKKMLDASQ

SEQ ID NO: 2309 - protein, 283 aa, Oryza sativa Japonica Group
MSGGRQSYWCYQCRQRVRPRGQDMECPYCDSGFVSEMDDVDALMRHFVGMDPDFHRDPRFGIMEAISAVMRHGMAGTNREVDVRGRPNIFSDLEMEFGSGPWLLFRGQLPGHLSEDNGFDVFINGRRGVGMRRANIADYFVGPGLDDLIEQLTQNDRRGPPPATQSSIDAMPTVKITQRHLSGDSHCPVCKDKFELGSEAREMPCKHLYHSDCIVPWLEQHNSCPVCRYELPPQSSTGASCSRTRSTNQSQSSSSNGRTNGRQRRRNPFSFLWPFRSSSSSSR

SEQ ID NO: 2310 - protein, 203 aa, Datura metel
MSEEIISVSDRFLLSLIEEHLLSDNSDDSGSELTSTEENWEEIFADFLNWSGSEIQKRGSPSSESCQSNSMAESCQEDSVVGTPPEAAAGGGCSKDWNRYKGVRRRPWGKFAAEIRDPKKKGSRIWLGTYETPEDAALAYDAAAFNMRGAKARLNFPHLIGSNISGPVRVNPRKRFPAEPSTTSSSSSSSSSENSGGRKKRRY

SEQ ID NO: 2311 - protein, 373 aa, Oryza sativa Japonica Group
MEEGFVALKRTEHVEVTSLAVAVEATPSAKGGKGKVVVGGGGAGGGVGPTRVRVFCDDFDATDSSSDEDEEEVTARRRVKRYVQEIRLQRAAAVAVPPVKVKGEEVFPAAVSAKMAEAAKARVVLAAGRKRKAGGVDGAEPRFRGVRRRPWGKYAAEIRDPWRRVRVWLGTFDTAEEAAKVYDTAAIQLRGRDATTNFNQSGDSASLDVPPEVAERVPQPPGASKNASPATSYDSGEESHAAAASPTSVLRSFPPSAVVATADTANKKQPPPPPLVVRETDESVDVFGCSFSDDGGFAGELPPLYTDFDLLADFPEPPLDFLSNLPVEPFSLAPFSSNNGSPDLHLDDAPSPAAAQVDDFFQDITDLFQIPVV

SEQ ID NO: 2312 - protein, 539 aa, Triticum aestivum
MMGGGVAMMDRRMAFPADGGAAASKGRPRRPPSQQDQQARRKKMSRAQDGILKYMLKMMEACSAQGFVYGIVPENGKPVGGASDNLRAWWKEKVRFDRNAPAAIAKHRSDNAAPLCGGEDGAGAAAGPRSLHELQDTTLGSLLSSLMQHCDPPQRRFPLEKGVPPPWWPQGPSEAWWPEAGVPDDLGPPPYKKPHDLKKAWKVAVLTAVIKHMSPDVDKVRRLVRQSKCLQDKMTAREIVTWLAVLKAEEELSHKLHPGACLPPRPSAGALSFDASSGEYDVDFFGEEAANQIKARSEAAPFVDLTMDASSSNEFMVMPPALMKEETTTDVDFTHAQKRSAADAEPELMLNGSARVYTCENVQCPHAGHALGFLDRNARSAHQYTCRYNNPAVAAAQSKPPSSFFPGAPYSPQSQALGGFDFGLPVADQRCLSGLMSMYETGVAAHRGATNDADAPGMQLGGGNVLAPRSLAGANNVMQQQQQQQQQSAAFFMGDDAPFGMAAPELGRFGPGFDLSAADYAGAMQQPQPQKHVGPNWFY

SEQ ID NO: 2313 - protein, 227 aa, Eucalyptus grandis
MAREKIQIKKITNATARQVTFSKRRRGLFKKAEELSVLCDADVALIVFSSSGKLFEYCSSSMKEILERHHSHSENLGKLDQPSLKLQLVENGDYSRLSKEVAEKGHQLRQMRGEELQGLNIDELQQLEKSLEAGLNRVIEKKGEKIMKEITDLQQKGAKLMEETKRLKQQVTEISGRKTTATDSETIINEEGLSSESITNVCSSSSGPPQEDDSSDISLKLGLPYNG

SEQ ID NO: 2314 - protein, 294 aa, Zea mays
MVNRLDITNDLPGVANHESGMMFSDSTVPLGYHATQSHMLKDLYHSLPQNYGLFTSDDERDGMVGVPGVSGNIFQEIDGRQFDSPILGSRKQKGGFGKGKGKANFATERERREQFNVKYGALRSLFPNPTKIKELKILLEKKRNSADRRKILKLDEEAADDGESSSMQPVSDDQNNQMNGTIRSSWVQRRSKECDVDVRIVDDEINIKFTEKKRANSLLCAAKVLEEFHLELIHVVGGIIGDHHIFMFNTKTLVMILHILILQIPKGSSVYACAVAKKLLEAVEIKKQAYNIFN

SEQ ID NO: 2315 - protein, 276 aa, Arabidopsis thaliana
  misc_feature (171)..(171): Xaa can be any naturally occurring amino acid
MPTLYKKPALIMQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDXESSSDQSRYLVNEDAGFVDGLLCETEEEKNGMRLPQETQTQPMFSEEDQSFWENLDVDDVFGLFKDDNNLEVPLQDHSSTNEDDELLIDISEYLSEEAMECPCFS

SEQ ID NO: 2316 - protein, 201 aa, Saccharum officinarum
MAPKRSTSPTGSSSGGVRAAATEQPRLRGVRKRPWGRYAAEIRDPVLKARVWLGTFDTPEQAARAYDAAARRLRGPGATTNYPAASEPMVPAVSGSAVLSESSSSSSWSLLPESVTAAVAAPPPSLDLSLALPASAAAANTYQVFMDPTPALLQFLPPKSEEEQSCSGSLSSSSGVFDAAPPVGLGLDLNLALLPPAEMVM

SEQ ID NO: 2317 - protein, 283 aa, Glycine max
MKNKKGEALSETSLPPSTMSSSSSSLVTTLVDNNNPTQPSQLRAARRRFTSDHHLPEISLKTPMVRPYVRSKMPRLRWTPDLHRCFVHAVQRLGGEDRATPKLVLQLMNVKGLTISHVKSHLQMYRSMRHEQMSQGAKKNNMAPDFPASTLATLGPRQQKPHKRSCTEELVPTQAQWNHDEQECYNGNQGGESIIICNGNEQKVHSYIIFEGLLRGQSVQENKTTTTEKVSLGDAGYESDHQRFQDTTLSLSMSSRPSSHSFLNRSHSTGPDANDVSLELTLS

SEQ ID NO: 2318 - protein, 363 aa, Oryza sativa Indica Group
MWEGGSHDAAAQLLPWFVGEPAAAAVGGYGGCVDVVGQGGVFGFGFEAAAAPVVTRQQRGGAAAAEGSSRGGGGKPAVVSGLLGSLQAELGRVTAREIMDAKALAASRSHSEAERRRRQRINGHLARLRSLLPNTTKTDKASLLAEVIEHVKELKRQTTAIAAAAAAGDYHGNDEDDDDAVVGRRSAAAQQLLPTEADELAVDAAVDAEGRLVVRASLCCEDRPDLIPDIARALAALRLRARRAEITTLGGRVRSVLLITADEQQQQHCDDVDDDEDGHRLLLRHGIDGAGAAAGDDDECAASHRRHECIATVQEALRGVMDRRAAASSGDTSSSGGAVVAGGGGGSIKRQRMHYGVHEQCSV

SEQ ID NO: 2319 - protein, 210 aa, Zea mays
  misc_feature (95)..(95): Xaa can be any naturally occurring amino acid
  misc_feature (122)..(122): Xaa can be any naturally occurring amino acid
SPATPSPILPDGAPGSRNKMSNRATHWCYACRRPIRLRGQDIVCPNCNDGFIQEISEMGGILNTYGLIEPDFEERRARRFGMMDAMSSLMRQLLXPTLVFGGIPSPGVDSGDVNVVLRGGRXVGAAQPNFSSLVVGPSLEALFEQLLLQNNRQGPAPAPQSAIDSMPVVKINRRHLDDDPQCAVCKDKFEVGAEAREMPCKHLYHTDCII

SEQ ID NO: 2320 - protein, 233 aa, Musa acuminata
RIENKINRQVTFSKRRNGLLKKAYELSVLCDAEVALIIFSSRGKLYEFGSVRMSKTLERYQHWCYASQDPNVVNRDNAQNWCQEMSKLKAKFESLQRSQRHLLGEDLGPLSVKELQQLERQLESALSQARQRKSQLILEQMEELRKKERHLGEINKQLRDQIEVEGATLKAFQGSWCSDAMIGSNAFAAQPSHSAGMDREPMLRIGYHQFVPADAAIPRNPIGENNFMLEWVP

SEQ ID NO: 2321 - protein, 551 aa, Glycine max
MELPQARPLGTAGRKPMHDFLSLYSNSTAQQDPRPPSQGSYLKTHDFLQPLERVETKASAKEEATDEISSVVQKPRSPSVEHLLPGGIGTYSISHISYVNNNNNNNQRGVLKPETSSLYVRQATSTDRNEENSNCSSYTSSGFTLWEESSGKRGKTGKENNAGEKPSLGVKSAAKLGQWTTTERTSQSFSNNRHGSFSSRSSSQTTGLKNQSFIEMMKSARDSNAQNEVLESEETFFLKKEPSSNTQRAELLVKVDGKSTDQKSNTPRSKHSATEQRRRSKINDRFQMLRELIPHSDQKRDKASFLLEVIEYIHFLQEKVHKYEGSFQGWSNEPERLMPWRNNDKPAESFQPRGTDNGSSPSPTIPGSTQNVESGLSTATTSKTMDHQAGKMNKAFPIPIPSQLNFFTPTQIGGPGGVVSQLTHRSASDAENTKYQPSVECQTMTATNEKLKEKELTIEGGAISISSVYSKGLLHTLTHALQSSGVDLSQASISVQIELGKQANIRSNVPVSVCGAKDGAVPSNNQKMMRSRVASSGKSDQAVKKLKTCRS

SEQ ID NO: 2322 - protein, 278 aa, Brassica napus
MADRVKGPWSQEEDEQLRLMVEKYGPRNWSAISKSIPGRSGKSCRLRWCNQLSPEVEHRPFSPEEDETIVSARAKFGNKWATIARLLNGRTDNAVKNHWNSTLKRKCLDGNPTTEEDQDRAKKRRSMSSESVPPVDTGLYMSPESPTHVASDSSAVPPQLFKPMPVSGGFTVPSPVEMTSSSEEDPATTLSLSLSLPVSQESRNTGSSDNSLPFPKFESQMKINVEERGEARRAEFMTVVHEMVKAEVRSYMAEMQRNNGGGFVVGGFYDSGITPKVE

SEQ ID NO: 2323 - protein, 202 aa, Cicer arietinum
MLVKSHHKGDGSKSLADTLARWKELNARLESSGEAEKSTRKVPAKGSKKGCMKGKGGPENSRCNYRGVRQRTWGKWVAEIREPNRGSRLWLGTFPNAVGAALAYDEAARAMYGSCARLNFPNAEVSNFSQLESMKDSPTSDRSGSVKTTIENTESMISLNNARVDAAEDVDMKNLSLSLSVTVNHEAGEVVSGNSSSQPSLS

SEQ ID NO: 2324 - protein, 219 aa, Petunia x hybrida
MVRQKIQIKKIDNLTAGQVTFSKRRRGLFKKAQELSTLCDADIGLIVFSATGKLFEYSGSSMMQLIEKHKIHSERDMDNPEQLQSSNLQCQKKTYGMLSKEFLEKNRELRQIKGEELQGLGLEELMKLEKLVEGGIGRVMKMKGDKFMKEISSLKKKEAQLQEENSQLKQQSEARLSQNATEPGHSANSITNCPSFVYGDHQDYNDSDTSLKLGLPFPY

SEQ ID NO: 2325 - protein, 268 aa, Oryza sativa
MDGEEDSEWMMMDVGGKGGKGGGGGGAADRKKRFSEEQIKSLESMFATQTKLEPRQKLQLARELGLQPRQVAIWFQNKRARWKSKQLEREYSALRDDYDALLCSYESLKKEKLALIKQARTSSSSSILDRFLSCLPFASILTRDRCEPRGKYGDNAGDDARSGGVAGMKKEEFVGAGGAATLYSSAEGGGTTTTTTAKLMPHFGSDDVDAGLFLRPSSQHHPPPPHAGAGFTSSEPAADHQSFNFHSSWPSSTEQTCSSTPWWEFESE

SEQ ID NO: 2326 - protein, 188 aa, Oryza sativa Indica Group
MERSPEVVQHKAANRAAEDDHTTSIPWLKLGVVDALTAEAGKLPESNPKPAVAAPHRTFSCNYCMRKFFSSQALGGHQNAHKRERCAARKSHGFQQQHLMVGLSPTAPSSFLHHMRVNPHATILKVNRGDSSADGVVVAKFHGGQMSSSWVPFAVEHGRGSVWPGSFKASSQEQKKRTEEDLDLSLRL

SEQ ID NO: 2327 - protein, 225 aa, Zea mays
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQMPQVLTAGTMVVAAAAENILTEDGQSSESVMTALHSGSSLDCDDGSDISLKLSLP

SEQ ID NO: 2328 - protein, 249 aa, Triticum aestivum
MEQGEEDGDWMMEPAAGKKGGVMIDRKKRFSEEQIKSLESMFATQTKLEPRQKLQLARELGLQPRQVAIWFQNKRARWKSKQLERQYAALRDDYDALLSSYDQLKKDKQALLNQLEKLAEMLREPGGAKCGDNAGAAARDDERLAVAGMSMKDEFVDAGGASKLYSASEGCGGSGKLSLFGEDDDDAGLFLRPSLQLPTAHDGGFTASGPAEYQQQSPSSFPFHSSWPSSAAEQTCSSSQWWEFESPSE

SEQ ID NO: 2329 - protein, 245 aa, Houttuynia cordata
MGRGRVQMKRIENKINRQVTFSKRRMGLLKKAHEISVLCDADVALIVFSTKGKLYEYATDSSMTKILERYERYSFAEREFALADNESEGAWSLEFGKLKARVEALQKTHRHYLGEDLDSLKVKELQHLEQQLDSALKHVRLRKNQVIQETISELQKKEKALQEQNNMLEKKVQEKQKAKAQQTRWENQSQNQNSAPFLFSLPLPNLNMGTYHQENGTEIREQEAARPLAHSNSQMPAWMLRHASE

SEQ ID NO: 2330 - protein, 177 aa, Brassica napus
VKPVVGFSQPRPVNSVSQPIDLTGIGVPEDGQKMISELMSMYDRNVQSNQNPTSMVTESQLLQPTVQNHQEHLQFQGNMVEGSFFEDLNLPNRVNNQMFFQGNNNNSGFKYDTAPPNNNNFEAAHNNASSNRFQLVFDSPPFDMASFGYRGDMSMPGVVGTMDGMQPPKPPDVSLWF

SEQ ID NO: 2331 - protein, 348 aa, Populus trichocarpa
MNAVEASKDVSMSVNHMATEGSPLKNETKSESLARSRDEAKQGMGGSGNDSDEAEFSGGGGQDEPSMLEGNCRELSAKSLGSNKRKRNGQDAELDQAKGTPQSAEPAKGSPETQQKGDQKPTSTTSKDAGKQGKQGSLGSDQPKEEYIHVRARRGQATNSHSLAERVRREKISERMKFLQDLVPGCSKVTGKAVMLDEIINYVQSLQRQVEFLSMKLATVNPRLDLNIEGLLAKDVFDPKILQLHAVPPSSLAFSLEMPMAYPPSHPSQAGLIPTAFPGMNNHSDIICRTINSQLTPMTAGFKEPAQLPNVWDDELRNVVQMSYETSAPHDSQDVNKPLPPGHLKVEL

SEQ ID NO: 2332 - protein, 258 aa, Jatropha curcas
MESKNRKWLQERSNSTGNNLNQNSNTAETRYRGVRKRPWGRYAAEIRDPGKKTRVWLGTFDTAEEAARAYDAAAREFRGSKAKTNFPTVTELNNAAAAAVAAGAVTVARSPSQSSTVESSSPTPPRAASPPPPLDLTLNIPSHQHHHLRHGHFPTGVIFPGGAWISLAAEAHPVFFFDAFSVQGESNNNNKNNIINNNKIHSKNINLCRLDRTVMVSSGVHSDSDSSSVVVDYDHDRSPCNKGLSLDLDLNFPPAEVA

SEQ ID NO: 2333 - protein, 419 aa, Glycine max
  misc_feature (264)..(264): Xaa can be any naturally occurring amino acid
MGSSDMDKTPKEESKTPPATSQEQSSTTGMPTTNPDWSNFQTYSPIPPHGFLASSPQAHPYMWGVQHIMPPYGTPPHPYVAMYPHGGIYAHPSIPPGSYPFSPSVLSSPSKSNLQFYMQGNAPGRIEVGGKPPEVKEKLPIKRSKGSASGGNLNMWITGKNNEPGKIPGESANGIHSKSGESASDGTSEGSDENSQNDSQLKSRERQDSFEDEPSQNGSSVHAPQNGVHNRPQTVVNQTMSILPISTTSAPGAVPGPTTNLNIXMDYWGTPTSSTIPALHGKVPSTAVAGGMIAAGSRDGVQSQVWLQDERELKRQRRKQSNRESARRSRLRKQAECDELAQRAEALKEENATLRSEVSQIRSEYEQLRSENAALKERLGDIPGVATPGKEDFRSGQNDQHVSNDTQQSGQTEVVQGVH

SEQ ID NO: 2334 - protein, 272 aa, Arabidopsis thaliana
MKMMQEEGNRKGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHMRKKAQEKKRPVSPTSSFSNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSECLYVQHIYVVKRRL

SEQ ID NO: 2335 - protein, 98 aa, Secale cereale
PELVKGPWSKEEDDVIIQMVKKYGPTKWSTIAQALPGRIGKQCRERWHNHLNPGINKDAWTQEEEIRLIQAHRIYGNKWAELSKFLPGRTDNAIKNHW

SEQ ID NO: 2336 - protein, 381 aa, Triticum aestivum
MGKGDVATRSKSQKSSTAQNEQSTPTNPPTAYPDWSQFQAYYNVPGTTQMTPPAYFHSTVAPSPQGHPYMWGPQMMPPYGTPPPYATMYAQGTPYQQAPMPPGSHPYSPYPVQAPNGTVQTPTSGAGGSETDKSNKNKRKTPLKRSKGSLGSLDVVTVKDKTPPAKPLVSSSNEGSSQSESGSGSYSGGSSTNSKSGSHTKDGSEHGPANDASNKGVTAQGTAVEPTQVSSGPVVLNPMMPYWPVPPPMPGQATGVSMGVDYWGAPTSVPMHGKAVAAPTSAPSSNSRDIVLSDPVIQDEREVKKQKRKQSNRESARRSRLRKQAEWEEVASRADLLKQENSSLKEELKQLQEKCDNLTSENTSLHEKLKALDSEKPNGNL

SEQ ID NO: 2337 - protein, 298 aa, Oryza sativa Indica Group
MATTVDWCGRGSNLPAAMYDMVVDSKELMGALAPSMVSFSYPCSEQSASSLLAGANYLTPAQVLHVQAQLQRLRRPGAASGCLAAAPPLPMKRHGAVAVAAAAAAARAPVKLYRGVRQRHWGKWVAEIRLPRNRTRLWLGTFDTAEEAALAYDSAAFRLRGESARLNFPELRRGGAHLGPPLHAAVDAKLHAICHGMDLPQPQPQTQSNATTTTMSTTATNTPSPFFSSESPVVKSEPVCSASESSSSADGDVSSTGSSDVVPEMQLLDFSEAPWDESESFLLHKYPSLEIDWDAILS

SEQ ID NO: 2338 - protein, 254 aa, Adiantum raddianum
DLLKDRSDVQCLHRWQKVLNPNLVKGPWTKEEDEKIAELVNKNGPKKWSVVARSLPGRIGKQCRERWHNHLDPHIKKDAWTPEEEQALIEAHQRNGNKWAEIAKSLPGRTDNAIKNHWNSSLKKKLEFTNLHRPVLDRLKELEGVSSGVGSTIGVSRSDCHTELAERVGASAGFSKPGQSEKAGENSFNRIRDTNRNRHLAGPGALGGSNCLSPFRTESVMLSNQRCSSIRNGSTLLVAARLNQVAAENDVAST

SEQ ID NO: 2339 - protein, 456 aa, Vitis vinifera
MYMYEENACFDGTKSVAEGDDEGFSQSVAPPPTNNSFEDSTNMRVSMEDASATMEIELHQQLAFDMDQQCYNSNNDGNDSNQVFSYEMQEMGFNHHHQQQDDPLLLQQHQAEMQNAQQNFSAAYPPTPDLLNLFHLPRCTPSSLLPNSSISFTNPDSSATAASGILYDPLFHLNLPPQPPVFRELFQSLPHGYNLPASRVGSLFGGGMDEREASGGGYGDGDDHRQFDNGVLKFTRDMACIGRGREGKGTKSFATEKQRREHLNDKYNALRSLVPNPTKSDRASVVGDAIEYIRELLRTVNELKLLVEKKRCGRERSKRHKTEDESTGDVKSSSSIKPEPDQSYNESLRSSWLQRKSKDTEVDVRIIDDEVTIKLVQRKKINCLLFVSKILDELQLDLHHVAGGHVGDYYSFLFNTKIYEGSSVYASAIANKLIEVVDRQYAAIPIPIPIPPTSSF

SEQ ID NO: 2340 - protein, 268 aa, Oryza sativa
MMGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 2341 - protein, 466 aa, Arabidopsis thaliana
MEDQVGFGFRPNDEELVGHYLRNKIEGNTSRDVEVAISEVNICSYDPWNLRFQSKYKSRDAMWYFFSRRENNKGNRQSRTTVSGKWKLTGESVEVKDQWGFCSEGFRGKIGHKRVLVFLDGRYPDKTKSDWVIHEFHYDLLPEHQKLCNVTLFRFSSYFRLSLLSPMFYTDELMCLPPEILQRTYVICRLEYKGDDADILSAYAIDPTPAFVPNMTSSAGSVVNQSRQRNSGSYNTYSEYDSANHGQQFNENSNIMQQQPLQGSFNPLLEYDFANHGGQWLSDYIDLQQQVPYLAPYENESEMIWKHVIEENFEFLVDERTSMQQHYSDHRPKKPVSGVLPDDSSDTETGSMIFEDTSSSTDSVGSSDEPGHTRIDDIPSLNIIEPLHNYKAQEQPKQQSKEKVISSQKSECEWKMAEDSIKIPPSTNTVKQSWIVLENAQWNYLKNMIIGVLLFISVISWIILVG

SEQ ID NO: 2342 - protein, 241 aa, Theobroma cacao
MVYPNESCETSPQKKMGRGKIEIKRIENTTNRQVTFCKRRNGLLKKAYELSVLCDAEVALIVFSSRGRLYEYANNSVKATIERYKKTCADSSNTGSVSEANAQFYQQEAAKLRVQIGNLQNSNRHMLGESLSALPMKDLRSLENRLEKGISRIRSKKNELLFAEIEYMQKREIDLHNNNQLLRAKIAENERKQQNINLMPGGSNFEIMHSQPFDSRNYFQVNALQPANHYPHQDQMALQLV

SEQ ID NO: 2343 - protein, 235 aa, Oryza sativa Japonica Group
MAPRAATVEKVAVAPPTGLGLGVGGGVGAGGPHYRGVRKRPWGRYAAEIRDPAKKSRVWLGTYDTAEEAARAYDAAAREFRGAKAKTNFPFASQSMVGCGGSPSSNSTVDTGGGGVQTPMRAMPLPPTLDLDLFHRAAAVTAVAGTGVRFPFRGYPVARPATHPYFFYEQAAAAAAAEAGYRMMKLAPPVTVAAVAQSDSDSSSVVDLAPSPPAVTANKAAAFDLDLNRPPPVEN

SEQ ID NO: 2344 - protein, 342 aa, Arabidopsis thaliana
MENPVGLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGDVREISSSSASYGSEIEQSRDSLIPLLVNDSEEEAQIEDAIPIEEWETWLTDDGVDEQVNHIMNMKDDRNNHRPQKPLTGVLIDDSSDDDDDSDLLSPTTNSIENSSTCDSFGSSDQINLVSLTQEVSQALITSIDTPEKIKSPYDDAQGTGAGGQKLGQETREKKRAGFFHRMIQIFVKKIHQCSSISRT

SEQ ID NO: 2345 - protein, 245 aa, Zea mays
MGRGKVQLKRIENKINRQVTFSKRRSGLLKKAHEISVLCDAEVALIIFSTKGKLYEYSTDSCMDKILDRYERYSYAEKVLISAESETQGNWCHEYRKLKAKVETIQKCQKHLMGEDLETLNLKELQQLEQQLESSLKHIRTRKNQLMLESISELQRKEKSLQEENKVLQKELAEKQKAQRKQVQWGQTQQQTSSSSSCFVIREAAPTTNISIFPVAAGGRLVEGAAAQPQARVGLPPWMLSHLSS

SEQ ID NO: 2346 - protein, 186 aa, Oryza sativa Japonica Group
MQSQIVCHGCRSVLRYPSGAPSVCCALCQAITTVPPPAPVMEMAHLICGGCRTLLMYTRNADTVRCSCCSTVNLVRPVNNIAHVSCGQCRTTLMYPYGAPSVKCAICHYITNTGMNTVAPTPSPMPTSSGSSYNAPPSGSSYNAPPPTSAPTSRPQNVTVVVENPMTVDEKGKLVSNVVVGVTTGK

SEQ ID NO: 2347 - protein, 333 aa, Arabidopsis thaliana
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRVL

SEQ ID NO: 2348 - protein, 123 aa, Eschscholzia californica
FFDLQEMLGFDKASKTVEWLMIHSKEAIKELARSRRGDGGGSKSVDSSISESCEVVSEVDICNPSAVTTDQDHDQQVGNNNTSSVHKKEKRVTRPSRKPMFLPQAKESREKARARARERTKEK

SEQ ID NO: 2349 - protein, 218 aa, Gossypium hirsutum
MSMKKEGEILYKKGLWAMEEDKLLIDYVNVHGKGQWNKIANRTGLKRSGKSCRLRWMNYLSPNVKKGDFSEEEEDLVIRLHKLLGNRWSLIAKRVPGRTDNQVKNYWNSHLRKKLGIIDQNKTRIDFCQSSKQVKVCHVDEAATDPSPGHGTTTETTGITVDQSNQHEVIDHRVLNNTTQESMTTEKYINTFWIPDHDYELSTLAMIDHFHEWVSFSP

SEQ ID NO: 2350 - protein, 331 aa, Zea mays
MAGAAGDRSEEDVGADWPFGGVDAFTEYSSFFAEPGWPGGLAGELIPVLDLPEAAAPLPAQLSTEPSEEPAPARSGDAGASSSSSGDGAAPGNGDGDDDRKAAPAAEAAGRKPAAKKGQKRARQPRFAFMTKTELDHLDDGYRWRKYGQKAVKNSPFPRSYYRCTNSKCTVKKRVERSSDDPSVVITTYEGQHCHSIGPFQRGGGGGAAAARYHSAAAVALAEQMYSSSTTSSFIPAARQQLFSLPPLHPQSSPPSSETTPPPVVSSVTTTSFQRANDGDELWRTGTGYGSGVSVGQSPSTPPSVPPPVVSVQKAGLLDDMVPHGVRHGTP

SEQ ID NO: 2351 - protein, 190 aa, Oryza sativa Japonica Group
MVGGEVMCEAAAPRYRGVRKRPWGRFAAEIRDPAKRARVWLGTYDSAEAAARAYDVAARNLRGPLARTNFPLVSSLPLPSPHYHLPGKAAAAAPPVAGPACSASSTVESSSGPRGPRPAATAAAVPRRRVPRPAPPAPDAGCHSDCASSASVVDDADDASTVRSRVAAFDLNLPPPLDRDHVDLCTDLRL

SEQ ID NO: 2352 - protein, 337 aa, Medicago truncatula
MFYYLSPLSLKSFDYLEEGITKLEFERKSLSLKKQEDENLDLVKIDKIRSNVEKLESDLISLRQCISETTSSILELIDEELLPQLVALTAGLSQMWRIMHGCHQSQALISQQLSNLGDNHNTILNSEYHHQATIQFESEASYWYNSFCKLVKSQQEYVRTLSKWIQLTNCLRDGHESSNHSSIRTICEQWELGLDGLPDKEVADAIKNLLLSIRSIIAQQAEEDNILKKLEKLERKLQRCSTSLAEMQRKIELNFEDDGDEGNISPRHPLFHKKAETEALKKQVESVKADYLDSVQYSRTMTLDNLRTRLPHLFVSLMEFSSASSQAIEAINSQSSQ

SEQ ID NO: 2353 - protein, 324 aa, Thlaspi caerulescens
MEGKDMLSWEQKTLLNELLLGFVAAKKLQARLGEGPSPSPSSSSSSPVAVAPETNEILVKQILSSYEKSLLMLNWSSSPPVQLIPTPFTVLPVANSGGVPESPGSINGSPRSEDFADGGGSSESHRQDYIFNSKKRKMLPKWSEKVRISPERGLEGPQDDVFNWRKYGQKDILGAKFPRSYYRCTHRSSHNCWATKQVQRSDSDPTVFEVTYRGTHTCRQAITPPPPPASPEKQDTRPTPTIAQKPNDLLESLKTNLTVQTVGLDNADDVFSFPNTPPFYDYGTINGDFGHVESSSFLDVVDWFNPTVGIDTSFPTFLPESIYY

SEQ ID NO: 2354 - protein, 317 aa, Medicago truncatula
MGCVLSSIDEDGRVGICKERKKVIKQLVCNREEFSDALLAYLKALRNTGATLRQFTESDTLELDFASTGLPEAPPSPPPDLLPPPLPPFLAEKSSMHIGEAEILENDGTGNFVHMLQIDQGLSSSLLFQPVDKVEAVESFEEENWEETKTEFEDEVQDSEADVSVGRSRSGKQPVKEPVDDSSSAITLFRKETHVTKAMPVVIGRSGRSLEGIVKELDDHFLKASACIKEIAVLIDISSGDTLLRQNSGRHPSKRTNSARVFSVLSWSRHTKSSTFTKDDAEFSSPSEPCRPGAHCATLKKLYAAEKKLYKAVKVSQ

SEQ ID NO: 2355 - protein, 477 aa, Oryza sativa Japonica Group
MVEPGRARETKVTASASSSAGSDAAVMKKKKKKKKKLVVASRKVDEKDKKQVDYKCSRSSGRDECCKVESRHQQCTEPESPSYRLALRSLFSCRNSSSSSHAGHHHHRAADGKKLGCNSASICKVKQDNPMQQHMRRAEDELKVKDKPPVAEPYCKRRASVSACNISSERSVKKSVKQQQQEASSSLQSSASISASSCSSTAGGGGSFRGMQQLSLRRLSGCYECHMVVDPISGVFRDSSSMRATICSCPDCGEIFVRPDSLHLHQSIRHAVSELGAEDTSRNIISIIFQSSWLKKQSPVCAIDRILKVHNAARTLARFDDYRAAVKAKAMAHRHPRCTADGNELLRFHCATLSCDLGLHGATHLCDHLSCAACAIIRHGFRPPAPGAGIRTMATSGRAHDAVVSSGSEGDRRAMLVCRVIAGRVRREEAAAAAAEEEEEEYDSVAGTTPGLYSNLDELDVFNPTAILPCFVVVYRA

SEQ ID NO: 2356 - protein, 300 aa, Glycine max
MSRTCSQCGNNGHNSRTCTDGGAAASCGGSPRENGIMLFGVRVMTEANSSFRKSASMNNLSQYDAESNAADAGYASDDVVHASGRTRERKRGVPWTEEEHRLFLLGLHKVGKGDWRGISRNFVKTRTPTQVASHAQKYFLRRHNQNRRRRRSSLFDITTDTVMESSTIMEEEQVPQETMAAPIPAAYPPFPGAGFPMSLSPVVLPVSGERLTKPIRPTPIVPVPPSSKMANLNLKGKASRTNLIEPLPLSLNLPSPTPRSQDQSPANSGHSSPSSSSAAAFQAMSAAKFGGGGDSIISVA

SEQ ID NO: 2357 - protein, 361 aa, Arabidopsis thaliana
MDTAQWPQAKVFVLTFGRDVFFYFDDQEIVVKPLEEIVTNTCPKPQPQPLQPQQPPSVGGERKARPEKDQAVNCPRCNSTNTKFCYYNNYSLTQPRYFCKGCRRYWTEGGSLRNIPVGGGSRKNKRSHSSSSDISNNHSDSTQPATKKHLSDHHHHLMSMSQQGLTGQNPKFLETTQQDLNLGFSPHGMIRTNFTDLIHNIGNNTNKSNNNNNPLIVSSCSAMATSSLDLIRNNSNNGNSSNSSFMGFPVHNQDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 2358 - protein, 253 aa, Arabidopsis thaliana
MGRGRVELKRIENKINRQVTFSKRRTGLLKKAQEISVLCDAEVSLIVFSHKGKLFEYSSESCMEKVLERYERYSYAERQLIAPDSHVNTNWSMEYSRLKAKIELLERNQRHYLGEELEPMSLKDLQNLEQQLETALKHIRSRKNQLMNESLNHLQRKEKEIQEENSMLTKQIKERENILRTKQTQCEQLNRSVDDVPQPQPFQHPHLYMIAHQTSPFLNMGGLYQGEDQTAMRRNNLDLTLEPIYNYLGCYAA

SEQ ID NO: 2359 - protein, 314 aa, Hordeum vulgare subsp. vulgare
MTRRCSHCSYNGHNSRTCPNRGVKIFGVRLTDGSIRKSASMGNLSLLGGSTSGGGGASPADVGHDAAAEGYASDDFVQGSSSANRERKKGVPWTEEEHRRFLLGLQKLGKGDWRGISRNFVVSRTPTQVASHAQKYFIRQANMSRRKRRSSLFDLVPDESDLPPLPGNHEPEAQILNHPPLPPPMEEEEVESMESDTSVIAESSSASAIMPENLQPSYPVLVPAYFSPFLQFSVPFWQNQNDGDDLGQGTHEIVKPVPVHSKSPINVDELVGMSKLSIGDPKQDTVSTSLSLKMVGGQNRQSAFQANLPTRAQA

SEQ ID NO: 2360 - protein, 355 aa, Arabidopsis thaliana
MADTSSRTDVSTDGDTDHRDLGFYYLYNVTPGRLVPESLGKTWGILPSDRGHMHAAASDSSDRSKDKLDQKTLRRLAQNREAARKSRLRKKAYVQQLENSRLKLTQLEQELQRARQQGVFISSSGDQAHSTGGNGALAFDAEHSRWLEEKNRQMNELRSALNAHAGDTELRIIVDGVMAHYEELFRIKSNAAKNDVFHLLSGMWKTPAERCFLWLGGFRSSELLKLLANQLEPMTERQVMGINSLQQTSQQAEDALSQGMESLQQSLADTLSSGTLGSSSSDNVASYMGQMAMAMGQLGTLEGFIRQADNLRLQTLQQMLRVLTTRQSARALLAIHDYSSRLRALSSLWLARPRE

SEQ ID NO: 2361 - protein, 211 aa, Arabidopsis thaliana
MSQSFELYPWLGSASDGKKKQSSRYKGIRRRPWGRWAAEIRDPIKGVRVWLGTFNTAEEAARAYDLEAKRIRGAKAKLNFPNESSGKRKAKAKTVQQVEENHEADLDVAVVSSAPSSSCLDFLWEENNPDTLLIDTQWLEDIIMGDANKKHEPNDSEEANNVDASLLSEELLAFENQTEYFSQMPFTEGNCDSSTSLSSLFDGGNDMGLWS

SEQ ID NO: 2362 - protein, 84 aa, Hyacinthus orientalis
PRAAAGRCLPCPRCKSKETKFCYFNNYNVNQPRHFCRNCHRYWTAGGTLRRVPVGAGRRKNRTPPPCGADGVGEADQAVWPAGS

SEQ ID NO: 2363 - protein, 215 aa, Medicago truncatula
MFTTNNSSYSHSISSEASSSYYNSLPESEIRLAASNPKKRAGRKIFKETRHPVYRGVRKRNLDKWVCEMREPNTKTRIWLGTFPTAEMAARAHDVAAMALRGRYACLNFADSVWRLPIPATSSIKDIQKAATKAAEAFRPDNTIMITNIETVVAVVATKELNMFCVEEEEEMLNMPEFWRNMALMSPTHSFEYHDQYEDFHFQDFQDDEVSLWNF

SEQ ID NO: 2364 - protein, 354 aa, Triticum aestivum
  misc_feature (202)..(202): Xaa can be any naturally occurring amino acid
  misc_feature (257)..(257): Xaa can be any naturally occurring amino acid
MEHGEQEQHAMDLPPGFRFHPTDEELITHYLAKKVADARFAALAVSVADLNKCEPWDLPSLARMGEKEWYFFCLKDRKYPTGLRTNRATESGYWKATGKDKDIFRGKALVGMKKTLVFYTGRAPKGDKSGWVMHEYRLNAKLHAASTSRGSLSGGRAASSKNEWVLCRVFKKSLVGGVVSSAPGVVSSKEKRRGDDRGDRVXSVAAVTPLPPLLDMSGSGASFDPAAHVTCFSHNALEAGQFFNPTATGGCAHGHGXHGLASSYSPLASFTQYGGQLHHGVSLSLVQLLESSGYHRGLADDMAPCGNQQQPAACKGERERLSASQDTGLTSDVNPEISSSFGQKFDHEPAPWGY

SEQ ID NO: 2365 - protein, 417 aa, Glycine max
MGSSDMDKTPKEKESKTPPATSQEQSSTTAMPTTNPDWSNFQTYSPIPPHGFLASSPQAHPYMWGVQHYMPPYGTPPHPYVAMYPHGGIYAHPSIPPGSYPFSPFAMASPNGIADASGNAPGRIEVGGKPPEVKEKLPIKRSKGSASGGNLNMWITGKNNEPGKIPGESANGIHSKSGESASDGTSEGSDENSQNDSQLKSRERQDSFEDEPSQNGSSVHAPQNGVHNRPQTVVNQTMSILPISTTSAPGAVPGPTTNLNIGMDYWGTPTSSTIPALHGKVPSTAVAGGMIAAGSRDGVQSQVWLQDERELKRQRRKQSNRESARRSRLRKQAECDELAQRAEALKEENATLRSEVSQIRSEYEQLRSENAALKERLGDIPGVATPGKEDLRSGQNDQHVSNDTQQSGQTEVVQGVH

SEQ ID NO: 2366 - protein, 302 aa, Ostreococcus tauri
MSARLEEQVREAADAAADGRNGRVDRGSRRGRVVVLASAGDESSRDSKKAVKIEGDGNARGGFGADAILSGAREAAEGLDDDGMDLPSTSDPENANSRGISQQWRKHEDEELLQLIAKHGAKRWSYIASLMPGGRRGKQCRDRYLNHLRPGIVIGEWTTEEEQILVEGHKALGTKWAALAKLLPGRPENAIKNHWHATMRCKWTKLAATEPWKLTVLQKYQMFLRGDDPNAFLDAGQENASDANGAEATKFENPSAVGMSRSAQNSRYSRAQREEIEEGLKRIGKRLAEAKETSEVGAEKSA

SEQ ID NO: 2367 - protein, 568 aa, Arabidopsis thaliana
MVSHKCVEEFGYASYLVPSNARAPRSARKRRSIEKRISKEDDNMCAIDLLATVAGHLSFESGSSLMSIDKLIEDHRVKEEFPEEEKPLMPVALSPYRGSLSPCGFSSVINGKVENEVDGFSYSGGSDACQVGNFSQDVKPDIDGDAVVLDARPNVVVSLGSSSRTEVPSIGNCVSHGVRDDVNLFSRDDDENFSKYIHPRVTKHSPRTVPRIGDRRIRKILASRHWKGGSRHSDTKPWRNYYLHQQRSYPIKKRKNFDHISDSVTDDYRMRTKMHRGSRKGQGASFVASDSHVKLRIKSFRVPELFIEIPETATVGSLKRMVMEAVSTLLSDGHRVGLMVQGKKVRDDNKTLHQTGISQDNSHLDSLDFSLEPSSEMPQLLTSHPLGHACEELLPVCQATKIDNVLESDHHDSALFPSDSLGNNNVTEDSKAMISVALNELSSQSQPPSRKSRRSEQQQQQAAQRRIRRPFSVAEVEALVQAVEKLGTGRWRDVKLCAFEDADHRTYVDLKDKWKTLVHTAKISPQQRRGEPVPQELLNRVLNAHGYWTQQQMQHLGGRLSFVYYYYY

SEQ ID NO: 2368 - protein, 275 aa, Arabidopsis thaliana
MVEDEEHIDLPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRVFQKRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFDGRDSSGTEELDCVWNF

SEQ ID NO: 2369 - protein, 131 aa, Triticum aestivum
MEQPNSEKDEHELSLDLTLRVSSAAEAEQGGFFLCVYCDRKFRSSQALGGHQNAHKHERSLAHRRREMAAATGAHGAAGTRAPAAQDERPRYVSAGDFVEPSAGKAGRTEASPWKVAAAPMTDDVDLSLRL

SEQ ID NO: 2370 - protein, 322 aa, Zea mays
EKPALPKHAGNSNIESNEVSQGLKTSAPTFDKPADDGYNWRKYGQKAVKGGEYPRSYYKCTHTSCPVKKKVERSAEGHITQIIYRGQHNHQRPPKRRSKDGGGPLNEADVLHENEDISTRSEPGSQEHSGKHEGSNDGILGPSVSRRGGGDEQLSGSSDSDEEQDDEQRAGDEDPGYANANKRHVPTPAQRIIVQTNSEVDLLDDGYRWRKYGQKVVKGNPYPRSYYRCTYQGCDVKKHIERSSQDPKAVITTYEGKHSHDVPAVRNGSHAAANANGSSSTSLPVPHRGKLYLFSDPFPPRCAASRSAPQQKLGTASPHHWF

SEQ ID NO: 2371 - protein, 373 aa, Arabidopsis thaliana
MQKVFLAMDTCALVIHQSLSRIKLSPPKSSSSSSSAFSPESLPIRRIELCFRGAICAAVQRNYEETTSSVEEVEEDDESSSSYGEVNKIIGSRTAGEGAMEYLIEWKDGHSPSWVPSSYIAADVVSEYETPWWTAARKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 2372 - protein, 320 aa, Vitis vinifera
MPEPRRQPMIQDMPFKRAKEICSDFKMRKIRVICYDPEATDSSSSEDEGGISKREKRGKRIVREINLPVAGSPQSNAIETESSCQDSNNGGKNPKKRFLRKPPSSKYRGVRQRKWGKWAAEIRDPFRGVRVWLGTYNTPEEAAKAYESKRLEFEAMAASANKSQNVSSSVAVSQSQSHNPAVSDDSDSLLSHTSPSSVLELETSTSHYNGGGHGTDTTKEGVGTNLIHANGAEQQKPISDFAEEPLMAPPIGQELNMEAEFESFFDDNNWGRILDDFNCLDDLRIFGFDNEEPSDLPDFDFDLGNDEFAWMDEPLNISCP

SEQ ID NO: 2373 - protein, 432 aa, Vitis vinifera
MISEKNVANAVGGKTARACDSCIRKRARFYCAADDAFLCQACDMSVHSANPLARRHERVRLKTASLKLPGADSLENSMPSWHQGFTRKARTPRHGKPAAHPAFKSDELTRNPLPFVPEIGADETSYDDNEEQLLYRVPIFDPFVAELCASTNSNEAVTTVANDTETADVTGSETKALVAGRGHDVDSLHGFLPSDMDLAEFAADVESLLGKGLDNESFGMEGLGLIDCKEKESVEYSLHSGRVKLEEEEDIGGVMACQADAEIDMTREPFELNFDYGSPATCEEEEEKVAVGAMDMNNKVDDPKKKNKILLRLDYEAIITAWASQGSPWTNGHRPELDPDDCWPDCLGTCGIQVHHPYGEFGGMGEQQAAMGDGGREARVSRYREKRRTRLFSKKIRYEVRKLNAEKRPRMKGRFVKRASFGGPAAFPLLNK

SEQ ID NO: 2374 - protein, 106 aa, Physcomitrella patens subsp. patens
MSRALDNGKRRVRRPFSVSEVEALVHAVEKLGTGRWRDVKLRAFEQAKHRTYVDLKDKWKTLVHTARIAPHQRRGEPVPQELLERVTRAHAFWTAHAAKQQAELDL

SEQ ID NO: 2375 - protein, 69 aa, Physcomitrella patens subsp. patens
RALQERRLKPPDQVIACPRCQSLNTKFCYYNNYSLTQPRHFCKSCRRYWTAGGTLRNVPVGGGCRKNKR

SEQ ID NO: 2376 - protein, 255 aa, Zea mays
MAMSEPSSDTSCTSSCSSGPSTSTSPRAAPSAAAAAASGGGKKRPRSDDGGSSSSSAPAYRGVRMRAWGKWVSEIREPRKKSRIWLGTFPCPEMAARAHDAAALSVKGARAVLNFPGLARHLPRPASLAPRDVQAAAARAALMHHSSAGCCCCGGGGGGGSTATATSSSSSSSAAADVGGCGQRRDGAAAHDEPEPERQPLEVAAELVFDELAPLWVEDVVELGPSADHPWPWTPCDGLDIAAGFHPLPLLWDDY

SEQ ID NO: 2377 - protein, 386 aa, Oryza sativa Japonica Group
MDGDAWWYPGGGGGGGSNNWDLGAVVRFGCGGGRVSPAAALLGEAWEYDDDPFSSFLAPPMTAQQAALPAVWEEGDDGDAAWMAPLPGLQTGGGWGDQAPMVVDELCGALVVAPPPPPKQQEVLQVQQQPPPADNTQPTTYQQGSGGDGESTRAGGSRSARRKYAASAIYIVSVCFSDSCIMWIRSLADDRGVRHACRKKQTRKEVVRVAASGPAPDLWAWRKYGQKPIKGSPYPRGYYRCSSNKNCAARKQVERCRFDPSFLLLTYTGAHSGHDVPLHRNSLAGTTRHKPPPPPPLPSAADKSPATAAEAATASQSPGLSPTTPLRASSMELHGEDDAEAELQVEEDDMAIDDEDDDDVADETISTVPWGTPISDAIIAASYEWR

SEQ ID NO: 2378 - protein, 352 aa, Zea mays
CRRPTGGWRRCATRARRRSSPSNSSTVELDGDGGGARKAGASPSSSVRPYVRSKNPRLRWTPELHLCFLRAVDRLGGQDRATPKLVLQLMNVKGLSIGHVKSHLQMYRSKKIDGSGQVIGGGGSWRGRLHRQLQDGGQAAYSLGHLSLHHGAGQTTAASSAILSARSGAWPHWNSFHDDPSYSMLLHGGHHHLLGSKPYCYYYYSSTTAEAAAAAASLTTCAALPLIRAPAPPPPTAHQRCLLPHRQNQNDLNHHHHHRRRLLLLRNDEDDDTQRQRDPLVDLELALDIGPRRPDKRVIDQRSSACDQQEAEKNVGDQQVDSATDDDVRLSLFLFPSPPCARTGNGGRHKKS

SEQ ID NO: 2379 - protein, 356 aa, Triticum aestivum
  misc_feature (231)..(231): Xaa can be any naturally occurring amino acid
MSDVTAVMDLEAEERQLALPPGFRFHPTDEEVVTHYLTRKVLRESFSCQVITDVDLNKNEPWELPGLAKMGEKEWFFFVHKGRKYPTGTRTNRATKKGYWKATGKDKEIFRGKGRDAVLVGMKKTLVFYTGRAPSGGKTPWVMHEYRLEGQLPHRLPRTAKDDWAVCRVFNKDLAARNAPPQMAPAADGGMEDPLASLDDLLIDTDLFDDADLPMLMDSPSGADDFAGASXSSTCKRGPSRLSPDTEHLTIKMEPPQQMQSPNSFMPATANGNLGGVGYSPYQAMGDQQVAIRRYSKPKAEVASSSALLSPSLGLDTAALAGADTSFLMASSRSYFDLEELFRGEPLMDYSNMWKI

SEQ ID NO: 2380 - protein, 412 aa, Oryza sativa Japonica Group
AIAASSLVLPLPPHPGEHILRHRCLLRSPFIARASTASSLVLPLPPHPGEHILRHRRLLRSPSIARASEGRRRSSCCFRRIDKMPNRATHWCYACRRPIRVSGQDITCPNCNDGFIQEISEIGGSLNTYGIFDPSFDERRDRSFGMVEAMSDLMRQRMAEMGRNRVLDFHGTRGASSHQGRQPTVRPMLIFGSNAPDRVSSSSEEADILLRQGRRIGADRPNFSRFLVGPSLEALFEQLLLHNNRQGPPPAPQSAIDSMPVVKINLRHLRDDPHCPVCTDKFEVGTEAREMPCKHLYHAECIIPWLVQHNSCPVCRHPLPSSSHRSGSTRSSSTHSNEAISHGVARSDADPVPVARSDDSRNHEMHGSFSFLWPFDSPTPDSSSYTHEGGVGEPTVHDDAGQMTYSEWHYDY

SEQ ID NO: 2381 - protein, 390 aa, Oryza sativa Indica Group
MGSSGADAPTKTSKASAPQEQQPPASSSTATPAVYPDWANFQGYPPIPPHGFFPSPVASSPQGHPYMWGAQPMIPPYGTPPPPYVMYPPGVYAHPSMPPGAHPFTPYAMASPNGNADPTGTTTTAAAAAGGETGGKSSEGKEKSPIKRSKGSLGSLNMITGKNSTEHGKTSGASANGAISQSGESGSESSSEGSEANSQNDSHHKESGQEQDGEVRSSQNGVSRSPSQAKLNQTMAIMPMTSSGPVPAPTTNLNIGMDYWANTASSTPAIHGKATPTAAPGSMVPGEQWVQDERELKRQRRKQSNRESARRSRLRKQAECEELAQRAEVLKQENASLRDEVNRIRKEYDELLSKNSSLKEKLEDKQHKTDEAGVDNKLQHSGDDSQKKGN

SEQ ID NO: 2382 - protein, 93 aa, Kluyveromyces lactis NRRL Y-1140
MAAPRKKTQRKKKDPNAPKRALSAYMFFANENRDIVRAENPGITFGQVGRILGEKWKALNEDEKAPYEAKAEADKKRYESEKELYIATKAQSE

SEQ ID NO: 2383 - protein, 569 aa, Debaryomyces hansenii CBS767
MMTDNKSDSDSIEIHLAKEMTNIPRTSSTPTPVVGIPGGTKPQTIFIHKLYDMLEDGNISHLIWWTENSESFGLLPGEEFSKVLAQYFKHTNIASFIRQLNMYGFHKVNDAGQSENGGDNNVARWEFRHLANHFRKGDIESLKLIKRRSSKNINHTREAAKTAGGTEDDIHEAVNEDDTKGIHTGDQHDVRAHEQQQHYHQTLQLQQQDQIPQPPSAIQHHHLTQIDGAPSPSVLPPLSKLPQIYKLSSDKSLETRLNEATSNLGTLRHEHHQLQTQFDLVFNEQKKSQFDLIQLVEIMQRHAVKSEDDKKLDYELTNFKQVLLNKFNNLHVLLSQAQGHQTPTIHPQHLSHAHPSMKPQYNSSHLHYSYSQSSADSNTDSSNIETQKLSKNGSKQPVSDGPMAKDVQPPYTYAEKFLEKNNIPTSLHSPHTSEVRRGYQQYPFPNMNSDPRASAPSTPDQFGQSVPPRVSLPSTNTYEQRPQSIPTPNSSLSLSRLALSNSSVSSGSSYSSNISVETPPKLVPLPSVSELDKLIKNGGGGLPLYRMLNSYGPMKRKNSTEEETRKRQA

SEQ ID NO: 2384 - protein, 577 aa, Arabidopsis thaliana
MVSHKCVEEFGYASYLVPSNARAPRSARRRSIEKRISKEDDNMCAIDLLATVAGHLSFESGSSLMSIDKLIEDHRVKEEFPEEEKPLMPVALSPYRGSLSPCGFSSVINGKVENEVDGFSYSGGSDACQVGNFSQDVKPDIDGDAVVLDARPNVVVSLGSSSRTEVPSIGNCVSHGVRDDVNLFSRDDDENFSKYIHPRVTKHSPRTVPRIGDRRIRKILASRHWKGGSRHSDTKPWRNYYLHQQRSYPIKKRKNFDHISDSVTDDYRMRTKMHRGSRKGQGASFVASDSHVKLRIKSFRVPELFIEIPETATVGSLKRMVMEAVSTLLSDGHRVGLMVQGKKVRDDNKTLHQTGISQDNSHLDSLDFSLEPSSEMPQLLTSHPLGHACEELLPVCQATKIDNVLESDHHDSALFPSDSLGNNNVTEDSKAMISVALNELSSQSQPPSRKSRRSEQQQQQAAQRRIRRPFSVAEVEALVQAVEKLGTGRWRDVKLCAFEDADHRTYVDLKDKWKTLVHTAKISPQQRRGEPVPQELLNRVLNAHGYWTQQQMQQLQQNVNKLEQETQSQTTEGLLLL

SEQ ID NO: 2385 - protein, 322 aa, Ipomoea batatas
MESGGGSIASLCPMMMMMPSSTDQDNNNNNNSNQNNEGSAGYFVDNNNNGGGGGGGEEGKCSSSSSTSVKAKIMAHPHYHRLLAAYLNCQKIGAPPEVVARLEEACASMAAMGRAGGTCLGEDPALDQFMEAYCEMLTKYEQELSKPFKEAMLFLSRIESQFKALTIPCSSESAGADAMDRNVSSEEEVDVTTGFIDPQVEDRELKGQLLRKYSGYLGSLKQEFMKKRKKGKLPKEARQQLLDWWTRHYKWPYPSESQKLALAESTGLDQKQINNWFINQRKRHWKPSEDMQFVVMDTAHPHYYMDNVLGNPFSMDITPTLL

SEQ ID NO: 2386 - protein, 382 aa, Ipomoea batatas
MESYGQLGEETAAAAARQRGSGAGFMYGGSVLGPPSYGRTGGEGNHVATGFHLQPGGGGECYGQSEGPPHTTVKSEGGSSGSHHHHHHHQMFQYPLMIRDHLHPRQQESAGDNSLSEGDAMKAKIIAHPQYSNLLEAYVDCQKVGAPPEMAARLSAARQELEGKQRASFIGSRDSSKDPELDQFMEAYYDMLMKYRDELTRPFQEAMEFMRRIESQLNMLSDGPVRIFNSDDKCEGVGSSEEDQDNSGGETELREIDPRVQDRELKNHLLKKYSGYLSSLKQELSKKKKKGKLPKDARQKLLSWWELHYKWPYPSETEKVALAEATGLDQKQINNWFINQRKRHWKPSEDMQFMVMDGLHHQNAALYMEGHYMGDAPYRLGP

SEQ ID NO: 2387 - protein, 416 aa, Oryza sativa Japonica Group
MSRVGSWGSMAFYSSSSSSRSQPVSAAEGKNGGKKEKRRSSISRSITCAGSICSTKESSVSSRGRGRRRRSGGGGGGDGGGGGSTSSRSLMGPGYHGDSAAAVSASSSFNSVMTAATSATATTTTTTTSSSATSPPSALSSPLSSIGGSFRAMQIRKLSGCYLHCHSVLDPRTLAAVVFSCPDCDEVFVKPDSLELHRSTRHAVSELGADDTSRNIVEIIFQSSWLKKNAPVCRIERILKVQSSDKTIKRFEQHKEAVKEKARSAGDEAGRNPRCVADGNELLRFHCTTFACSLGLAGGTALCCASSSPPPLHCKLCSIIKDGFRVDGNGRITTMATSGRAHDTAEVSPDGEKRAMLVCRVVAGRVKKLHSSNSSEDHDCDSVSPCSEGVYSDLDELFVFSPRAILPCFVVIYSGY

SEQ ID NO: 2388 - protein, 266 aa, Ipomoea batatas
MEAIKAKIIAHPQYSNLLEAYMDCQKVGAPPEVVARLAAVRQEFEARQRAAGLGGRDISSKDPELDQFMEAYYDMLVKYREELTRPLQEAMEFMRRIESQLNMLSNAPVRVFTSDDKCEGVGSSEDDQDNSGGETELPEIDPRAEDRELKNHLLRKYSGYLSSLKQELSKKKKKGKLPKEARQKLLNWWELHYKWPYPSETEKVALAESTGLDQKQINNWFINQRKRHWKPSEDMQFMVMDGLHPQNAALYMDGHYMGDGPYRLGP

SEQ ID NO: 2389 - protein, 426 aa, Vitis vinifera
MENYQGDLADIVRASGSGGARTSDEPVADWQFPSEPMIFSPVVDEPLDDFGDPFSNMRDPLFHELGIAGSGFFGSSNSSELTQTSGEDISSNLVGGGGMFGQKILDEDMKRPCNIFSRMLQISPNARMPISPCESQIVAASPTGIKTSALAPNDMISGNSSKGCLMDSTALQISSPRNPGIKRRKSQAKKVVCIPAPAAANSRPSGEVVPSDLWAWRKYGQKPIKGSPYPRLLGRFDSSDEIFVNQCRVKLSRGYYRCSSSKGCSARKQVERSRTDPNMLPSKNNGASKNSGSCQSTQKATGLKEENKESYNNDDMSPIVGGSSTTGASVKEEMGNVEKQLEMDDSEFSEGFPRSYKPAMPDSNQSEDFFADLGEIEVDPLNLLFAQGFSSGDHEERESKALDPFSLFDWTGNNSNTSFGEDKRGL

SEQ ID NO: 2390 - protein, 282 aa, Arabidopsis thaliana
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTVVEKVLKTEESYDVSGGENVESGLTAIDDWDLTEFLSMPLLSPLSPHPPFGYPQLTVV

SEQ ID NO: 2391 - protein, 437 aa, Populus trichocarpa
MATNRFVCEICNKGFQRDQNLQLHRRGHNLPWKLKQRTTAEIRKRVYVCPEPSCVHHNPARALGDLTGIKKHFCRKHGEKKWKCDKCSKKYAVQSDWKAHVKTCGTKEYKCDCGTIFSRRDSFITHRAFCDALAEENTKANQGLMPNMEPNLQGQVSNLIPSMAINNNPNQSTMMSSFNHLDAKNPLSLPQELMPTPPKPSSGSMFSNGTTGLFGGSRSMSPSLQLNANSSTIFEGNGLHNLSGSASMSATALLQKAAQMGATASSNNVSSPMMQKSFVTSMAPPTFGTMHTQNDQSHVIGGDDGYANQFFSANGGVENSVLNDMGIFSAVLDQNNSLFKTMEHASSNNENVFQGANSNPGLSSPTSGANPSGLSRFSTGDVMTVDFLGLGGSRQRNLHQQHNHQEMEFTRGISHPRMQGLNHFEQATALKKPMWDV

SEQ ID NO: 2392 - protein, 566 aa, Debaryomyces hansenii CBS767
MANRRIPKSEDSLSNLPSTASSNQSGSNDFVKKLFQMLQEDTYKDVVKWTSSGDSFVVINTTEFTKEILPRHFKHSNFASFVRQLNKYDFHKVKIPNEEKQSYEYGEDAWEFKHPDFRINDRESLENIKRKSSKKSTQNYNPNVANSGSSVDSFGYQNLKDEMDNLRLENKSLKQDISVLHTKYKTLVENIVSLKSFDEKYYRSMSVLINCLVQAGIKMPPLDFPNPNALYPQKPNVAAHQHSHSHSNSSSLPQLSPPLLSPNGGTGQQGGIGVPLGSGLPAQRFDHNTISQAHTLQHQTPLQTIHSQPNNQQSTKQTPPTNDNLNSKPQSPHLMGESTSGSPLVGNLGLDAASTTAPVNSRTSSISTNRVPQPANGASTDQPQVTTTNLTNPKFHVLLVEDDNVCIQLCRKFLVKYGCQVTIATDGLNAISTVEHTKYDLVLMDIVMPNLDGATATSVIRSFDTKTPIIAMTGNIEDNDLVTYLQNGMSDILAKPFTKDDLYSILSKHLLTSTDSASVTTDEPSETMSSLQGPAQQTLVLPQEVQQQDSNGEPMPEPHSKKPRLI

SEQ ID NO: 2393 - protein, 258 aa, Oryza sativa Japonica Group
MDGGSGGPYTSRTAEEVFRDFRGRRAGMIKALTTDVEKFYQLCDPEKENLCLYGYPNETWEVTLPAEEVPPEIPEPALGINFARDGMNEKDWLALVAVHSDSWLLAVAFYFAARFGFDKEARRRLFNMINNLPTIFEVVTGAAKKQTKEKAPNSTNKPNKPSSKMQPRPESHSKAPKPPAPPKDDDESGDEYADEEEEERDNTLCGSCGTNDGKDEFWICCDSCERWYHGKCVKITPARAEHIKHYKCPDCGNKRARA

SEQ ID NO: 2394 - protein, 347 aa, Oryza sativa
MDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKQDQEWVLCRVFKKSLELAPAAAAAVGRRGAGAGTDVGPSSMPMADDVVGLAPCALPPLMDVSGGGGGAGTTSLSATAGAAAAPPAAHVTCFSNALEGQFLDTPYLLPAADPADHLAMSSASPFLEALQMQYVQDAAAAGGAGMVHELLMGGGWYCNKGERERLSGASQDTGLTSSEVNPGEISSSSRHNAWIITTRPSGPIEIFIHHH

SEQ ID NO: 2395 - protein, 166 aa, Arabidopsis thaliana
MAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 2396 - protein, 329 aa, Zea mays
  misc_feature (50)..(50): Xaa can be any naturally occurring amino acid
MSPLNQQQVLLKKALAKKPNAKKMSEFGLKPSAALLKSRTQQLPAPVQPXRRVRVLFEDPDATDSDSDSDDEEAGGTPSRTKRFSFEAFIGKAPAKPVLPAAAAVAACTSGGAPERYRGVRLRKWGKWAAEIRNPFTGKRQWLGTFDTAGAASAAYLSASRSFADEKRRRRGLPVAASSADTPASGSTPTASSSSSASTAPFAHPSPSSVLEPSKEARNTQSPEATPARPSTDSAQLPEDPEFYQDLLRGLQLPDIDPLDFRAGLDALDLSDADFGLDDEHDLLLGDFGDEEMEIDLDLDDINDVFPEMPGCDLGRGMDDFLQTVDFCV

SEQ ID NO: 2397 - protein, 383 aa, Brassica oleracea
MESGSNSTSCPMAFAGDNSDGPMCPMMMMMMPVITSHQQHHGHDQQHQHQQQHDGYAYQSHHQHSSLLFLQSLTPPSQEAKNKVRSSCSPSSGAPAYSFMEINHQNELLAGGLQSPVLSSLLVKAKIMAHPHYHRLLLAYVNCQKVGAPPEVQARLEETCSSAAAAAASMGPTGSLGEDPGLDQFMEAYCEMLVKYEQELSKPFKEAMVFLQHVECQFKSLSLSSPSSLGYGEAAIERNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPLHYFMGNVLGNPFPIDHISGTML

SEQ ID NO: 2398 - protein, 177 aa, Oryza sativa Japonica Group
MASSPTSTAPHDRKLDPAASPAARWRTRREQESYSSKLLDALRLVRAASGRPSPASSREVRHAADRALAVAARGRSRWSRAILASRARACALRRVRLGAPPPPPAARPAPRSRPPLASKAKVLGRLVPGCRKLAFPALLAEASDYIAALEMQVRAMAALAQALQSVAPAPPPPPSSS

SEQ ID NO: 2399 - protein, 196 aa, Beta vulgaris
MVGSLMAAWPVQGQTGWRKGPWTPEEDKLLIEYVNLHGEGRWSSVSRCAGLNRSGKSCRLRWVNYLRPGLKRGQITPQEEGIIIELHAIWGNKWSTIARYLPGRTDNEIKNYWRTHFKKKERTRKASEKRKSQTLKPKPLVQPQLQPQPKDEPLLHTQELISGSRNEPNNKIAPSTNNIEEQNLMAMIMASSSSSS

SEQ ID NO: 2400 - protein, 204 aa, Medicago truncatula
MATQEVNKPLSLPPYPEMIMKALEALNEPNGSNKSSISNYIESIYGELPEGHSIVLANHLNQMKDNGDLVFAKNNYMKPDPNAPPKRGRGRPPKPKDPLAPPPAAVLSPPRPRGRPPKDPNAPPKTPKPASSGRGRGRPKKVQRTENVSNPSGGDGDGAGAGAEVDDDDAAPSVAAVAVPTTSGRGRGRPPKVKPQMTEVSVES

SEQ ID NO: 2401 - protein, 167 aa, Physcomitrella patens subsp. patens
MNQLTAKVPVGFRFHPTDEELVGYYLPMRVTARKVELDLIRDLDLYKLEPWDLQDLCKIQADSNEKQTDYYFFSRKDKKYPTGNRANRATTQGFWKATGRDKPIHTKLQTLIGMRKTLVFYQGRAPHGVKTDWIMHEFRLDDGPGQPAHVNDGWVVCRVFKKNKNQK

SEQ ID NO: 2402 - protein, 278 aa, Hordeum vulgare subsp. vulgare
MVKAEAMTAEAEGSSGRRDAEAELNLPPGFRFHPTDDELVVHYLCRKVAGQPQPVPIIAEVDLYKFNPWDLPERALFGSREWYFFTPRDRKYPNGSRPNRSAGTGYWKATGADKPVAPRESGGRTVGIKKALVFYSGRAPRGVKTDWIMHEYRIAQADRTPGKKGSLKLDEWVLCRLYNKKNNWDKVKVEQDMAVVQGQNGEVMDALATDAMSDSFQTHDSSEIDNASGLQQQHHGFMDMAQRQAREGMVTVKEDSDWFTRPEYGRPADLLHEPWGRW

SEQ ID NO: 2403 - protein, 314 aa, Arabidopsis thaliana
MADLFGGGHGGELMEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 2404 - protein, 304 aa, Hordeum vulgare subsp. vulgare
MSGGQELNLPPGFRFHPTDEELVMHYLCRRCAGAPIAVPIITEIDLYKLDPWQLPKMAMYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGMEKPASVDRKPVTMGGYGVGPGAMASSPQEQKPVMGMNANGGGSGGVQPFPDFAAYYDRPSDSMPRLHADSRCSEQVLSPDFPGERGGGEVQSQPKISELERSFASGGDPVNPAAGSILEPHGGFGGDPLLQDILMYWGKPF

SEQ ID NO: 2405 - protein, 304 aa, Hordeum vulgare subsp. vulgare
MSMSFLSMVETELPPGFRFHPRDDELICDYLAPKVTGKVGFSGRRPPMVDVDLNKVEPWDLPVTASVGGKEWYFYSLKDRKYATGQRTNRATVSGYWKATGKDRVVARRGALVGMRKTLVFYQGRAPKGRKTEWVMHEYRLEGAHEQASKEDWVLCRVICKKKSGVGATPRPRNLTNIVHGTSTDTSSPPLPPLMDTTLAQLHATMNTSAAATAALEQVPCFSSFSNNSASNSSYLPMVTGNGNGMSYLDHGLPDFGSYLDPSTNCDKKVLKAVLSQLSSMGGEVVPSMSAQMAAAVSSTWNHF

SEQ ID NO: 2406 - protein, 377 aa, Triticum aestivum
  misc_feature (242)..(242): Xaa can be any naturally occurring amino acid
PLLLLKKKQVIIACGKAVAANDMYATELLISELGQLVSVSGDPMQRLGAYMLEGLVARLSFSGSKLYKSLKCKEPTSSELMSYMHLLCEICPFYKFGYMSANGAIAEAIKGENFVHIIDFQIAQGSQWITIIQALAARPGGPPFLRITGIDDSNSAYARGGGLDMVGTRLHSISASCGLPFEFNAVHAASHEVYIQHLDTRPGEAIVVNFAYQLHHTPDESVSVENHRDRIIRMIKSLSPRXVTLVEQESNTNTSAFLPRYLETLDYYTAMFESIDVALPRDDKRRISTEQHCVARDIVNLIACEGAERVERHEVFGKWKARFAMAGFRPYPLSSVVNNTIKTLLDSYHSCYRLEERDGVLYLGWKGRVLVVSSAWC

SEQ ID NO: 2407 - protein, 276 aa, Oryza sativa Japonica Group
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTR

SEQ ID NO: 2408 - protein, 101 aa, Pisum sativum
AQVVGWPPIRSFRKNSLTTASKNTEEADGKLGLGGAVFVKVSMDGAPYLRKVDLKNYTAYSELSSSLEKMFSCFTIGQCESHGNQMLNETKLRDLLHGSEY

SEQ ID NO: 2409 - protein, 337 aa, Oryza sativa Japonica Group
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRPRSSTCSGSTPTPTSSARGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 2410 - protein, 266 aa, Oryza sativa Japonica Group
MGLPEQPSGSSGPKAELPVAKEPEASPTGGAAADHADENNESGGGEPREGAVVAAPNRRPRGRPPGSKNKPKPPIFVTRDSPNALRSHVMEVAGGADVADAIAQFSRRRQRGVCVLSGAGTVANVALRQPSAPGAVVALHGRFEILSLTGTFLPGPAPPGSTGLTVYLAGGQGQVVGGSVVGSLIAAGPVMVIASTFANATYERLPLEEEEEGSGPPMPGGAEPLMAGGHGIADPSALPMFNLPPSNGLGGGGDGFPWAAHPRPPY

SEQ ID NO: 2411 - protein, 376 aa, Oryza sativa Japonica Group
MEVEARIHLLLIKLVFYRSAEERESASVHINLLPVRELYFDPRKKMDAFSHVPPGFRFHPTDEELVDYYLRKKVALKKIDLDVIKDIDLYKIEPWDLQEQCKIGNEEQNEWYFFSHKDKKYPTGTRTNRATTAGFWKATGRDKPIYVKNCLVGMRKTLVFYRGRAPNGQKSDWIMHEYRLETNEYGAPQEEGWVVCRVFKKRVAAVQRAAGDGGDSPFWFNEHVAFMAPAPGLDSPYHGHRQSHPCKLEVEYHHHLLPQEAAPFMHLPRLESPKLPAADIIVATAASSALQPCGHTTAQQLQLQIEPVYVTADASAADWRDLDKLVASQFGHGDSTAKEPSYCNPVQVFQVEGKQEDSLDYVSTSASCGGEEDLWK

SEQ ID NO: 2412 - protein, 188 aa, Triticum aestivum
MEQADEASSVNKGSPERLTIDQDDGASWLSLTVGANGSAEAAANCSEPEPDPEPKPSAAPHKVFSCNFCMRKFFSSQALGGHQNAHKRERSAAKRSYHAQRMVMGLPLEAHAAFVQSLRVSQSSVIQKSSQPTQIRTAPRFHEDGMTWATIPCEEVLNSTWPGSFRARTQPSEQQPSEQSKIDLNLRL

SEQ ID NO: 2413 - protein, 334 aa, Oryza sativa
MDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 2414 - protein, 249 aa, Arabidopsis lyrata subsp. petraea
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGWEGGEQNVTYAHHQAQSQGLYQPLECNPTLQMGYDNPVCSEQITATTQAQAQQGNGYIPGWML

SEQ ID NO: 2415 - protein, 366 aa, Oryza sativa
  misc_feature (261)..(261): Xaa can be any naturally occurring amino acid
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSXRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 2416 - protein, 228 aa, Zea mays
MAMDDSSSGSEPTSSSSAEAPASPGTTASSSSDSSSSSSATAASSKKRRRTTDGQHHPTYRGVRMRAWGKWVSEIREPRKKSRIWLGTFATAEMAARAHDVAALAIKGRAAHLNFPELADELPRPATAAPKDVQAAAALAAAADFPAPAANNNAAGARDPDGGASPAVAPLDDDALFDLLPDLLLDLRHGASSCQLSCAPSWPYDDVSFSGTAAAGAFRLEEPLLWDY

SEQ ID NO: 2417 - protein, 190 aa, Lupinus microcarpus
SSGPYPYFPSSSSSASYHPFAFFNPENSSSNNTFSHDLLSFPYNIPTTHHYHAPIPETVSNFADCAAASAVMFKNDVTGSNFGLSNFLAKKPASKKDRHSKIHTSQGLRDRRVRLSIEIARKFFDLQDMLGFDKASNTLEWLFNKSKKAMKELARSKNSSSGVVANSFSSSDSEFEVVSMINQDSIDATP

SEQ ID NO: 2418 - protein, 396 aa, Cardamine hirsuta
MEEYQHNTSSTPHRVSFLYSPISSSNKNDNSSDTNNNNNNNTNYGPGYNNTNNNNNNHQHHQHMLFPHMSSLLPQTTETCFRSDHDQSNNHPSVKSEASSSRINHYSMLMRAIHNTQEANNNNDNVSDVEAMKAKIIAHPHYSTLLQAYLDCQKIGAPPEVVDKITAARQEFEAHQLRSTPSVTESSRDPELDQFMEAYCDMLVKYREELTRPIQEAMEFIRRIESQLSMLCQGPIHILNNPDGKSEGMVSSDEEQENNSGGETELAEIDPRAEDRELKNHLLKKYSGYLSSLKQELSKKKKKGKLPKEARQKLLTWWELHYKWPYPSESEKVALAESTGLDQKQINNWFINQRKRHWKPSEDMQFMVMDGLQHQHHAALYMDGHYMGDGPYRLGP

SEQ ID NO: 2419 - protein, 232 aa, Brassica napus
  misc_feature (197)..(197): Xaa can be any naturally occurring amino acid
  misc_feature (202)..(202): Xaa can be any naturally occurring amino acid
  misc_feature (212)..(212): Xaa can be any naturally occurring amino acid
MGYMCDFCNEQRSMVYCRSDAACLCLSCDRNVHSANALSKRHSRTLICERCNAQPASVRCSDERVSLCQNCDWSGHNNDATSQHKRQSINCYSGCPSSEELASIWSFCLDLNFSSAGQSACEQEMGLMTIDEGTGEDKPGVQNVNLDQPGTSSALAKDIGVSEDDFCGNLMMDEVDLAFEKYDELFGTAYNSSKESXEHGEXGSLFENMRAXKGMQQPAGKHAASEDSFMTC

SEQ ID NO: 2420 - protein, 215 aa, Oryza sativa
  misc_feature (20)..(20): Xaa can be any naturally occurring amino acid
  misc_feature (171)..(171): Xaa can be any naturally occurring amino acid
AAPRRATATATAKKGQKRAXHPFAFMTKSEIDHLEDGYRWRKYGQKAVKNSPFPRSYYRCTNSKCTVKKRVERSSDDPSVVITTYEGQHCHHTASFQRGVGGAAVAAHIHGAAAVALAEQMSAFVSPPPQPHMLYGLPRLHPPSSETAVSCSMPTTTSLQELNNSEGLQRXPGYNNSPQAAVTIAQRPPSPSVPPAVSFDKGLLDDIVPPGVRLG

SEQ ID NO: 2421 - protein, 197 aa, Pisum sativum
MATREVNKPLSLPPYPELILKAIDSLNEPNGSNKSAISNYIESVYGELPEGHSVVLLYHLNQMKESGDLVFAKNNYLRPDPNAPPKRGRGRPPKAKDPLASPPSGAVSTPRPRGRPPKDPNAPPKTPKASGSGRPRGRPKKIARTEDVDASTPSPVSVAAVNVDVVVPCVAAVPTSSGRPRGRPPKVKPQLTQVSVS

SEQ ID NO: 2422 - protein, 172 aa, Lupinus concinnus
SSGPYPYFSSSSSSSYHPFAFFNPENSSSNNTFSHDLLSFPYNIPTTHHYHAPTQETLSNFADCAASAAMFKNDVNGSNFGFSNFMAKKPASKKDRHSKIHTSQGLRDRRVRLSIEIARKFFDLQDMLGFDKASNTLEWLFNKSKKAMKELARSKNSSSGAVANSFSSSDSE

SEQ ID NO: 2423 - protein, 305 aa, Glycine max
MDRIKGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRKCTSTMIDDDNTPPLKRSLSAGAAIPVSTGLYMNPPTPGSPSGSDVSESSVLVASSSHVFRPVPRTGAVLPPVETTTTLSSNDPPTSLSLSLPGVDSSEVSNRTTEPIHAAPPPPPQPQPQPLNTIPLLPMMTVPSVSPTGMAPFNFSAEFLAVMQEMIRKEVRSYMELHNQKNGMCFQAAVNDGFRNASVKRIGISRVDS

SEQ ID NO: 2424 - protein, 62 aa, Physcomitrella patens subsp. patens
VRARRGQATDSHSLAERVRREKISERMKYLQDLVPGCRKVTGKAVMLDEIINYVQSLQRQVE

SEQ ID NO: 2425 - protein, 189 aa, Brassica napus
MTRRCSHCNHNGHNSRTCPNRGVKLFGVRLTEGSIRKSASMGNLSHYTGSGSGGHGSGSPGDVPDHVAGGDGYASEDFVAGSSSSSRERKKGTPWTEEEHRMFLLGLQKLGKGDWRGISRNYVNTRTPTQVASHAQKYFIRQSNVSRRKRRSSLFDMIPDEGEDVPMDQQEPEAEDTPVETLMQSSDSV

SEQ ID NO: 2426 - protein, 660 aa, Triticum aestivum
MGIDLNAADEPGKAAAVSVCRDLWHACAGPVVALPRRGSAVVYLPQAHLAAAGGGGDVPVALPPHVACRVVDVELCADPATDEVYARLAMVAEGEIFEKNMGGGRFEGEDDMEDGDGERKSRMLHMFCKTLTASDTSTHGGFSVPRRAAEDCFPPLDYQQIRPSQELVAKDLHGAKWRFRHIYRGQPRRHLLTTGWSSFVNKKKLVSGDAVLFLRGDDGELRLGVRRAIQLKNEALLKAFNSNSSKIHTLSAVANSLKHRSVFHICYNPRAAASEFIVPYWKFLKSLNRPFCIGMRFKIQYGSEDVNERRSGMITGINEVDPIRWTGSKWKSLQVRWEDGTDCNSQNRLSPWDIEIVGGSVSIAQSLSASSSKRTKLCPQGNVDVPTLYGNVRPDSVGADKLPRVLQGQELMGSGTHRFTCPPQPGGATEFRRSDGTGFLTDTRSCLLSGPASRLPPQSSYFAYQPVGFGESVGFPEVLQGQEVCQTVPLYQGMVSDTCSAKAGYGMYNYMRTSSAMNGGFSSAPQGYPLSLSTPPRAVAASPSSAAVPPQLWLASKSNEEAANGSQLNPFGIRKVPGDGAAKLGDGAAKLGSDGRKVARTSCMLFGFSLTEKMLPTEEDSAKEGNHEVDCQNPRMLDLFGYNRATPGTLHALCAAPLGI

SEQ ID NO: 2427 - protein, 776 aa, Arabidopsis thaliana
MKREMKAPTTPLESLQGDLKGKQGRTSGPARRSTKGQWTPEEDEVLCKAVERFQGKNWKKIAECFKDRTDVQCLHRWQKVLNPELVRGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSSGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDSGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCNLVPSNSDLRQEYSPFGIRQLVISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNVSPSLSLHIIWYQL

SEQ ID NO: 2428 - protein, 270 aa, Medicago truncatula
MHNNNVSVGSPQQLVTTNTLPQEMNMNISVGNSIVTTIGTSIVALEAPTVTPTTTTPGSLDLFGKKKRGRPRKYDADGNLNPSYKKIVKTTTPILTSPPGFTLSTNEFASKKGRGKSTGFVNYQTFSSFGEVFPSTAAVDFAPHVVTVYAGEDVGGKILSFAQKSPRGICILSANGAISKVALGQPGSTGVNSKKQCNGKAYHRQCPLAREVVTQGRFEILSLSGSYTASDNSGIRTREGGLSVSLAGPDGRVIGGAVAGVLIAAGPIQV

SEQ ID NO: 2429 - protein, 257 aa, Vicia faba var. minor
MVTGKNNELSKTPGASANGIHSKSGESASEGSSEGSDENSHNVLQDSQLKSGERQDSFEDEPSQNGSSAQAPQNGGLNTPHTVVNQTMSVVPMSVAGPIAAVAGPTTNLNIGMDYWGTPASSTIPAMHGKVPSTAVAGGMVNAGPRDGVHSQPWLQDERELKRQRRKQSNRESARRSRLRKQAECDELAQRADVLSEENASLRAELSRIKSEHAKALAENAALKVKQGEILRNEEIVPGQNDQLVEHVGGGETKQSG

SEQ ID NO: 2430 - protein, 494 aa, Cryptococcus neoformans var. neoformans JEC21
MLEDEDIAKTGLIYWSANGTTFTCPNPTEFSKVVLPRYFKHNNWQSFVRQLNMYSYVNDIYSTSTDPQAWEFRHSLFRRGEAHLLPSIKRKSSRPSAPDGSNTVTSPTDELPPSTSNPIKPVAGWMRDAVPVPYRMPSPPHIHGQPQRSATYPYSDGFATRKDDGRSPTRGMAWDPLPAVQRMPPPPDNQIPIRYHPDPNRPVLTTQRFYHPGYPESPLYGPAHSPSAETLLNQMSVLEDKVQKLTDVLNNDRIEHVRNNLDFTSYLLQMIGWAAGDQHTLSRQNADMRHKYEAFMASDALAIMASGGGRERSDSRDSTRERNARLGFEIPPFPGHPHPSITDLRLPQTAQSSSSAILSQRAAPRTSPRNSTSSDLLLTRPSTSESIREREIYPTYFPPQTSHGIGPASSIPSRGPETITPSLYGGGPSVPPPLYRPAPIVEKHREIEKGEEHKDMNGPSTVELGREERDNEDSRMTMAGEEAESKTGLRNLLN

SEQ ID NO: 2431 - protein, 583 aa, Ostreococcus tauri
MTDAGAYTLSARALGRGGGQSGEFGGKAKTEFAPSAVSSARWSETPTGGVLRIRSTTGETLTLGGIGVDEARRAAAFCAETFGCSTGEREVNVNGRNWGDVAIEGASTVFEVDGKTQFELEGKYISEATVVGKNEVVMQFHTDDTAAEKDSLVEMSFFVPPGSETWAGEDPENPEDSAAHRLRAAILSIAAADAEAGEPVTMDLHHTYMKMQSSTLDFKVQYSSIVRVYLLPKPHSNQSHAVIALDPPIRKGQTFYPHILAMFNDDEHLTVVPNLEPAMKEKFPTLEASYDGSVGEVFVRVLKNLAGVKLTRQSAFTASAGGHAIRVSHKADVGLLYPLEKAFFYVPKPPLLLHYSEVDEVEFERHAAAGHSSAKTFDLTITMKGGSSYDFHGIQRSEFQNLVNFLTAKEVRISNVDTNARADALIAEAAKRTKISLPGANPTGESPLIVIQTREAARTRRKRRRNHLRRSVPRRIRTRQRGLSAYMFFSAAKRAEIAEANPEFGITDIAKALGERWKTVSDEKSVYQQQAEEDKARYEREMAEYNARGADADADADAMDTDVKPKVEIKDDDDDDDDAMGED

SEQ ID NO: 2432 - protein, 281 aa, Oryza sativa Japonica Group
MDHYASRGNWFMARKWSPEENKQFERALAGLDLRCPDWDRVARAIPGRSALEVMNHFRDLELDVQQIENGMVPFPVYGAAAAGGAFTLQWDGAHGVGDFRNAYRFGGGGGGKRHFGRTPEQERKKGVPWTEEEHKLFLLGLKKYGKGDWRNISRNFVQTRTPTQVASHAQKYFIRLNSGGKDKRRSSIHDITTVNLTDDRPPSPSQSSLISNQSNTSTLTAAVAPFSSTADVKPQNAANASFNSPSRTLGMAGYGMGLQDQGLQCGGPLHDQLAASRSILF

SEQ ID NO: 2433 - protein, 320 aa, Vitis vinifera
MRNPASASTSKTPCCTKVGLKRGPWTPEEDELLANYVKREGEGRWRTLPKRAGLLRCGKSCRLRWMNYLRPSVKRGQIAPDEEDLILRLHRLLGNRWSLIAGRIPGRTDNEIKNYWNTHLSKKLISQGIDPRTHKPLNPKPNPSPDVNAPVSKSIPNANPNPSSSRVGEIGSNHEVKEIESNENHKEPPNLDQYHSPLAADSNENWQSADGLVTGLQSTHGTSNDDEDDIGFCNDDTFSSFLNSLINEDVFGNHNHHHQQQQQQQLQQLQQPSNVIAPLPHPAISVQATFSSSPRTVWEPAALTSTSAPLVHDQKDSMSP

SEQ ID NO: 2434 - protein, 515 aa, Pimpinella brachycarpa
MTSSLGDLLAQPNNDDFGSNWGFENQKTKSFANPSQPFSPPPVSPSSYFSFLDSPIQINNYNIVSSSGNGTMNAQSFNEENQNFSDFSFPTQSRPASSTSSSSFVPANTNSVEESLKRKQGGWNFEEAAKNNEFQRFSPEMTMNQANMLSPEMTMNQANMQSNAAVLQSNSINYAQSSQSSQTNRDQSKLDDGYNWRKYGQKQVKGSENPRSYYKCTYLNCPTKKKVETTFDGHITEIVYKGNHNHPKPQSTKRSSSQSYQNSIPTMPETSLLENGHLEPVTTPENSSLSFGEDDLFEQGSMNKQGDDDENEPDAKRWKGEYENNETMSSLGSRTVREPRIVVQTTSDIDILDDGYRWRKYGQKVVKGNPNPRSYYKCTQVGCPVRKHVERASHDLRAVITTYEGKHNHDVPAPRGSGSYAVNRPSDNTATTSAPTAIRPTTNYLNPLQNTRAQPANGQAPFTLEMLQRPRSYEFSGFGNSTNTYTINQNQQASGQFSTAKDEPDVDSFFDSFLA

SEQ ID NO: 2435 - protein, 118 aa, Physcomitrella patens subsp. patens
RGKKVKNKEQPPKQGFIHVRARRGQATNSHSLAERARREKISNRMKFLQALVPGCSEVTGKAVMLEEIINYVKSLQRQIEFLSMKLAAVDPRLDTNVEGLLKMEVCAVRLVSVPMGVQ

SEQ ID NO: 2436 - protein, 189 aa, Lupinus concinnus
SGPYPYFSSSSSSSYHPFAFFNPENSSSNNTFSHDLLSFPYNIPTTHHYHAPTQETLSNFADCAASAAMFKNDVNGSNFGFSNFMAKKPASKKDRHSKIHTSQGLRDRRVRLSIEIARKFFDLQDMLGFDKASNTLEWLFNKSKKAMKELARSKNSSSGAVANSFSSSDSEFEVVSMINQDSIECYSRR

SEQ ID NO: 2437 - protein, 710 aa, Physcomitrella patens subsp. patens
MSLAMMHEVGLPLREYSRRGGDPAAAVEMRLFATASDGALVGLSPARLVCNDASPPSLPFLDWFYILGAAWALFAQSVSTPALQSSREVENLHHTHKKREIPCCPCRCVTGIISRGLSRAPPVGSSSLMEVSRTQLTASAGASPEGRVVRRIAQISAETHDLLGTLDQLADSGTKLVEAAGVDLQSSVPEIHGTGDSAQPVAEVVKILKAGSYLSRRVSQVCQPGFVHGKTSLSLPPHQPPLTSYSAVHQAHAAWLKNQTTDVLHITAIRNSKAVSCLATMPMAQQTSSPSSHKHALPCTVDRNSKRVCVGLDDRRFKRAADERRPNRLGREASPNLNFRNTECGDIPIAIAANTHVQPAALIRNTGKPKPSMILNSKFLAPIRSLLRFHYFQGHPKKRRRTAAGQHGSTPASETREIPASRHTGQSAEVHDGHPEPLNHGLKPPQVPGSLVGTNLNAAAALDTQRVEETAFDIDEAEDLAESQSRKEKLEVLLRSVESNYEAYRANVLEMRNNFDQFGGREGSLLYTALGLQAMSRRFRICKDGITRQLRVATREMDLSSQLRQARCKVHPERQLLKPNHRGPDLHARLPDSATDILRRWLFEHFLKPSAAHFLQQSVGDPKHKVTNWFINARVRLWKPMVEELYEQIQREDEAEQAARESSANSRQSSQDGIYSSGSHHNVEHDFMLQAGTIRGTRSSALHPVIIRTS

SEQ ID NO: 2438 - protein, 369 aa, Glycine max
MRDMKDAGALGGKTARACDSCVSRRARWFCAADDAFLCHGCDTLVHSANQLASRHERVRLQTASSKVTTTHAWHSGFTRKARTPRHNSKHFALQQRLKDEVLFNNTSVLPLVPELGGEEQEPVVVDNDETEEQMLCRVPVFDPFDVRTDDLDSFSDMDFAEFAADVESLLDKEDDEISACVGGGEGEGEGVQGAMVKVKDEEEIDGDVACYLESVFDDAFHWNNIESVLSDAREEKEGVVACDVGVGDEEGGTKRDIFLRLNYDEVITAWSSQGSSPWTTSNPPKFNSDYDFSLGLSGVGGEVRSLRGHLDGGREARVSRYREKRRTRLFAKKIRYEVRKLNAEKRPRMKGRFVKRTCFVGANAFPAYH

SEQ ID NO: 2439 - protein, 268 aa, Glycine max
MLEGTSGEPSSKGLNSKKRKRSGRDGDNDKANGAQELPSEGAKGNSENQQKGDQQPISTANKACGKNAKLGSQASDPPKEEYIHVRARRGQATNSHSLAERVRREKISERMKFLQDLVPGCSKVTGKAVMLDEIINYVQSLQRQVEFLSMKLATVNPRLDFNIEGLLAKDILQQRPDPSTALGFPLDMSMAFPPLHPPQPGLIHPVIPNMTNSSDILQRTIHPQLAPLNGGFKEPNQVLIHCNCKHFNSYAHYFFVHVSKHFGCYTIY

SEQ ID NO: 2440 - protein, 639 aa, Oryza sativa Indica Group
MEEELCGNNWDLDAVVRLGCCRRRISPAAVAQQVDPFASFLQQGVAMEVAAEKEVGVEAAWSFPELTVRDGGGGGLGRDADELLKAFCAAFPSSSSSKSSPLPTPPPPPPTQPQPEQQKPVTVQENLPAPTTAPARASQPAAARQVPAGGVPRSKRRKNQQKKVVRHVPADGVSADVWAWRKYGQKPIKGSPYPRGYYRCSSSKGCPARKQVERSRSDPNTFILTYTGEHNHSAPTHRNSLAGTTRNKLPSSSSASAASAQPQPPPPSVVVVGAGGGGAEAAGLSPTTPLRTPSMEEDEEEEEEEELLVEDMEMAGEDELLFLNGGDDNAALDGTPIRGALLFLALPFSVQQPNLSACSSLGMFDWDLNSHHSSLFLHPQLLMVGDGGGVADVASLGDGDAITTEDDGGGADPVRGDGGGGSCSDAVRGGGGDSDAARGGGGCTDAARGCAVAASGGDDCTVMAYVGVGGVSLVLLLHLVQVRFSPTLCYREQFIRRWLCSSLHQGGWIWDPSSSLSPGSGIHAGCAIRVELKLLRFNGELRGEVWLSPVKLPLKSTAQQQISNLCSFCGGDRRGLTVRQAVCMLKETQGCNRHGFAAAPCRFAPSALSSFRRLFVFLFQFSILCILLSLLTMFGGLPS

SEQ ID NO: 2441 - protein, 261 aa, Arabidopsis thaliana
MSRSCSQCGNNGHNSRTCPTDITTTGDNNDKGGGEKAIMLFGVRVTEASSSCFRKSVSMNNLSQFDQTPDPNPTDDGGYASDDVVHASGRNRERKRGTPWTEEEHRLFLTGLHKVGKGDWRGISRNFVKTRTPTQVASHAQKYFLRRTNQNRRRRRSSLFDITPDSFIGSSKEENQLQTPLELIRPVPIPIPIPPSRKMADLNLNKKKTPATTEMFPLSLNLQRPSSSTSSSSNEQKARGSRASSGFEAMSSNGDSIMGVA

SEQ ID NO: 2442 - protein, 187 aa, Lupinus bicolor
SSGPYPYFSSSSSPYHPFAFFNPENSSNNTFSHDLLSFPYNIQPTHHYHAPTQETLSNFADCAASAAMFKNDVSGNSNFGFSNFLAKKPASKKDRHSKIHTSQGLRDRRVRLSIEIARKFFDLQDMLGFDKASNTLEWLFNKSKKAMKELARSKNSSSGIVANSFSSSDSEFEVVSMINQDSIDATP

SEQ ID NO: 2443 - protein, 219 aa, Populus trichocarpa
MGRTRTTTKQAVDPNGSATQNMLVIAKEPRYRGVRKRPWGRFAAEIRDPWKKTRVWLGTFDSAEDAARAYDAAARTLRGAKAKTNFPISTTNQLFNHQNQNQSPTDPFLDHHSINPQRPTSSSLSSTVESFSGPRPPQPTTTTKSGNGPRRSHPRIPPVVPEDCHSDCDSSSSVVDDRDVASAASSLCRKPLPFDLNFPPLDQVDLGSGDDLHCTALCL

SEQ ID NO: 2444 - protein, 324 aa, Arabidopsis thaliana
MYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 2445 - protein, 527 aa, Oryza sativa Indica Group
MAMVEQEGCVENRQPLAASSSSVSDGSSYGGGGGGLAQMSPPVRKFFARFPSVGILLWEGSRKADKRANKESKGWLDTRGVTQSLLLIGLNLSQQDETLRKAVEAYKEIRKDAWTTEEEQALINAHRIYGNKWAEIAKVLPGRTDNSIKNHWNSSLRKKQDMYNTSNNMVVPKLLVHDKFKDKPKLMAMEGHLDLNKAPIINSKDQAGTAHRSNCSGFLSRSSLPTAQPLTSREASVVDGSAVTLVAQALESDSVRGKGLEIDSVHEKGLEVNSAPDHTGNSWTIQLEAAPSKGEAELSLKNEARSLGPLCYQIPNMEDVVPVSSSLFSDHLTGNHTSEHCGDDILSPAGCTTPPPTKGKLTSQLSVDSILKSAANSFPGTPSILKRRKRDKSTPVSASEMKISGSNTDRFYTPMGMEPATATPESFKTTSFLSLGSLDGSVKSFDVSPQYRARSKRMALTKTVEKQLDFSSDGLDTCGSEILNSSCNNSQSTLSITEAPKLKEKEHAVQLENLTKNFAHTTNLDVT

SEQ ID NO: 2446 - protein, 243 aa, Lotus japonicus
LDCQKIGAPPEVVARLVAARQEFEARRRSSVSSRENSKDPELDQFMEAYYDMLVKYREELTRPIQEAMGFMRRIETQLNMLCSGPVRIFNDDKCEGVGSSEEDQDNSGGETELPEIDPRAEDRELKTHLLKKYSGYLSSLKQELSEKKKKGKLPKDARQKLLNWWELHYKWPYPSESEKVALAESTGLDQKQINNWFINQRKRHWKPSEDMQFMVMDGLHPQNATLYMDGHYMAADGHYRLGP

SEQ ID NO: 2447 - protein, 83 aa, Physcomitrella patens subsp. patens
QDYIHVRARRGQATDSHSLAERVRREKISERMKFLQDLVPGCSKITGKAVMLEEIINYVQSLQRQIEFLSMKLAAVDPRLDIN

SEQ ID NO: 2448 - protein, 227 aa, Lotus japonicus
IKAKIVSHPQYPRLLQAYIECQKVGAPPEIARLLEEIRRENDLCKRDVVSTRFGADPELDEFMESYCDMLVKYKSDLARPFDEASNFLNKIEMQLSNLCTGASVPTLSDEGGVSSDEEFSTGDGDAQDGQQLRGEDRELKDRLLRKFGSHIGTLKLEFSKKKKKGKLPKEARQTLLQWWNVHYKWPYPTESDKIELAKATGLDQKQINNWFINQRKRHWKPSENMQS

SEQ ID NO: 2449 - protein, 374 aa, Zea mays
MDAAQWHQGLGLGKPMEEMLMAGNANLNQNPNPPPAAPSAPGAQRAGAPAAVAAAPPSAGATGGAGPERRARPQKEKALNCPRCNSTNTKFCYYNNYSLQQPRYFCKTCRRYWTEGGSLRNVPVGGGSRKNKRSSSAVSSAAAAAAASTSAAMSGTVPVGLAAKNPKLMHEGAHDLNLAFPHHNGRALQPPEFPAFPSLESSSVCNPGAAMLGNGAAGRGMGALSGLELLRSTGCYVPLQHFQLGMPAEYAAAGFSLGEFRVPPPPQSQSVFGFSLDTHGTGGVGGAGGYSAGLQESAAGRMLFPFEDLKPAVSAAGGGASNGADHHHYEHSKDQAAGDGGGASGVTGGHEAPAGFWSNSMIGNGSSNGGGGSW

SEQ ID NO: 2450 - protein, 470 aa, Glycine max
MEVVVTPTLENDTITTLYEASLNGSVSTLNTLIQRNPLILHRVSLSPFSETPLHIASLLGHLEFCEALLKRKPSLASEVDSERRSPLHLACAEGHTEVVKALLHTNPDVCLAMDKDEMLPLHLAVMRGHTGVIKELTRARPGSIQQNTIDDGSVLHLCVRYNHLEALIFLVQSATRNQQQFLLAKDKEGDTVLHLAVRLKQIKTIKHLLMLPEMRTAISALNKAGLTALEMLERCPRDFISLKIEKMLLEAEVQTGTAQQGSPSPRIATQPSNQSKRSKIWETLWLKYLQYQSNWIEEKRGTLMVVATVIATMTFQSAISPPGGVWQEDTITGGHNCTTYGICKAGTAVLAYDWPHGFLKFMTFNTTSFFSSLAVVLLLISGFRLENKLMMWILTMGMTLALTFMGLTYFWAQSLVTPDHIVDKVNRMGIPLSIVWVIMLLVAVLVHGVNLFLWVKKYVKKWKKQKLLQS

SEQ ID NO: 2451 - protein, 1155 aa, Arabidopsis thaliana
MNSNSVGVFREKEIDGKPFHTYTLSSQTDTTTPSSSGETAIDGDDHLSLQQPLFLCPSLRLKADEINYSYSEILPFNISPYFPSIRGADQQVQHLLDSDSQQVHDLLHSDNSHDDDGDEICKLPVVPIYWCNSKEIEFDQFNCGACERSKIGTDYYICLTCDLMFHKECVESPLEIKHPSYPFLSLKLYTRHEQLMSCMCCKHPSNLIFYYCPTYKLSLHPDCAMKPISIFIDHPKRHPHLLTFFPKQASLLCDVCSLIKEAFPTYVCLRCIFVAHRDCIYFPYVIKICRHQHRISFTSSLPSGKWSCGVCRKKVDNNCGAYTCNKCSHYFVHTRCALREDLWDGKDLEGVPEEPEIILEPFETIADGIILHFSHGHHLKLKTSGVYNENIICQACILPIYEGNYYSCMDQCNFILHEACANASRKKDHALHSHPLTLKVVSDIQNEYFKGYFRCSACDRESCGFIYEEDQYSIDIRCASVSEPFDYQGHEHPLFQALDRKEEREAICQICRKNCATLPYKAKYKLDKHFLTFREGEEGSDQLDWCEVCEKKLEYSREGGFYACDDCCTTLHVDCLLGKEMYMLNPGHTVMAYRSNIYILPNNTMTRPFCQLHKEDRCPHKEERSEMKIEIQCMENKQPLAASCSSASEGSGCFFLKSPEIATPATVSSFPRRTSGPMRRAKGGWTPEEDETLRRAVEKYKGKRWKKIAEFFPERTEVQCLHRWQKVLNPELVKGPWTQEEDDKIVELVKKYGPAKWSVIAKSLPGRIGKQCRERWHNHLNPGIRKDAWTVEEESALMNSHRMYGNKWAEIAKVLPGRTDNAIKNHWNSSLKKKLEFYLATGNLPPPASKFIVLKDIADGDRDSKQSSATKPFKDSDSLTQTSSGNTDSNEVGRDHFDSSSALLEEVAASRRIGVNEYACSPVEYKPQLPNLEPISEEVRINSKAYFERSIQRKVENGFGTPKHGNLYYKSPLDYYFPSEADLQHMYGYECGCSPGAASPVSLMTTPCNKDSGLTATRSPESFLREAARTFPNTPSIFRKRRKVVLAAKTDAVVVVNGVVKEVDRKEESKDMRKSLLLETTDNCSDDEELGLNGNAFNLSPPYRLRAKRTAVIKSRQLEFTSEKEKQPDNEIEFTSAKEKQPDNEIKTSEEDKPV

SEQ ID NO: 2452 - protein, 231 aa, Zea mays
  misc_feature (21)..(21): Xaa can be any naturally occurring amino acid
MVTVREETRKGPWTEQEDLQXGLNRTGKSCRLRWVNYLHPGLKRGRMSPHEERLILELHARWGNRWSRIARRLPGRTDNEIKNYWRTHMRKKAQERKRNMSPSSSSSSLTYQSGYPDTPSIIGVKGQELHGGSGCITSILKGTHPDMDGYPMDQIWMEIEAPEVPSEVGFVGGNENVCSSLATPLPPPTVWEYYPEVCWKLDDEIKMAPQFGYIVKELTPASDTIYIGSDY

SEQ ID NO: 2453 - protein, 296 aa, Brassica napus
  misc_feature (127)..(127): Xaa can be any naturally occurring amino acid
  misc_feature (134)..(134): Xaa can be any naturally occurring amino acid
MEEAALGMIGATVGGGDGGDAVLVAEQNRQMKGEIVTNPLYEQLLAAHVACLRVATPIDQLPTIEAQLSHSEHLLRSYASTAVGFSHHDRHELDNFLAQYVMVLCSFKEQLQQHVRVHAVEAVMACXREIENKXSHSLTGATLGEGSGATMSEDEDDLHMDFSSDNSGVDFNGGHDMTGFGPLLPTESERSLMERVRQELKIELKQGFKSRIEDVREEIMRKRRAGKLPGDTTTVLKNWWQQHCKWPYPTEDDKAKLVEETGLQLKQINNWFINQRKRNWHSNSHSLTSLKSKRKH

SEQ ID NO: 2454 - protein, 277 aa, Physcomitrella patens subsp. patens
MAPRMEMTIGGSPLQRSLLPLKRKRGRPRKYATGDTPQVTASGLGNISLFSALAKQIAAPYTPPPNKSEKRGRGRPVGSTKKQQLANLGVVLAGTGKSFTPHILTVSTGEDASSKIMQFAQHGPRAMCVLSANGAVSNVMLRQDSSSGGTVTYEVQTGYSEECLALETLQWSNFKGRYEILSLSGSYLPTDGEDGEKQRTGSVSVSLAGSDGRVFGGRVAGVLMAASPIQVVVGSFLLGSLKMDSKVDSPLRLTQGDSSSIRTPPAVQRIPAPKSSG

SEQ ID NO: 2455 - protein, 481 aa, Oryza sativa Japonica Group
MATDENGADDRAGGESTVDHLRSHMNYGDMDLSGEEHVPKARKPYTITKQREKWTDEEHRLFLEALQLHGRAWRRIQEHIGTKTAVQIRSHAQKFFSKVVRESSGSNTGSGGASAAAAAAAIQIPPPRPKRKPAHPYPRKVDGAAKKHVPALRQLEKPPLWMQSLSEQEEGSPTSVLTAAQIGTEALGGGFSNNSSGSGSLAPSAAGTDEHVDGGGSPASSVDREDGCLSPSIPTAELAMQAPNTKMSIATTDAKEASSEASVFRLFGKSVVVKDSDQLHLLNGSNIATSGSVERATRNILVPSFAAAPEGSSSNPWPSSMQQFLYFLPRSDGFAAQPVMPWLSYNGSLPCALFYPAAAAAANQQCHRDSEGVEFRVSQREGSLTGSNTASSVVLGSSAAVPAAAAAAQNSDVAESRGQGNSREAAASPRLTKCESSASVTLLQRGFMPYKRCAAESELLRSEAAGGEEAVADGELTRLCL

SEQ ID NO: 2456 - protein, 125 aa, Vitis vinifera
MMDLSKKESLSEEMNEIKKCCTDCKTTKTPLWRGGPAGPKSLCNACGIRYRKRRSSMVGVNKKKERMNSGSHDLSETLKQSLMALGNEVMMQRQRSSVKKQRRKLGEEEQAAVLLMALSCGSVFA

SEQ ID NO: 2457 - protein, 188 aa, Cucumis sativus
MTQVAAKGLDLEITELRLGLPGDCCSLISTSKNNEKKRVFSEVEVEDKSRSKGEDEGRRKQVVGWPPVCSYRRRNSFKGKGEQCESEEIMNMGMKKQMYVKVSFEGTPFLRKVDLGMVKGYGDLVGAMEKLFGSPIGCYEYTVTYEDRDGDWMLVGDVPWKMFIESCKRLRIMKKTEGKGSEMNSLSQ

SEQ ID NO: 2458 - protein, 320 aa, Oryza sativa Japonica Group
MEHDVHHHRQMMQQQQQQEMDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKQDQEWVLCRVFKKSLELAPAAAAAVGRRGAGAGTDVGPSSMPMADDVVGLAPCALPPLMDVSGGGGGAGTTSLSATAGRGGGAAASARDLLLQRAGGPVPGHTVPPPRRRSRGSPRHVLRLAVLGGPADAMLMFGAPNTDANPVKSHSCLMQNSWYAADLSE

SEQ ID NO: 2459 - protein, 194 aa, Brassica napus
MTRRCSHCSYNGHNSRTCPTRGGGGGGTCGGNGGESASSSSSAAVKLFGVRLTDGSIIKKSASMGNLSALAVHHRLSPLATGNHNDSPLSDHGRYSSQENGGYLSDDPGHGSGSIHHRRVERKRGVPWTEEEHRLFLVGLQKLGKGDWRGISRNYVTSRTPTQVASHAQKYFIRHTCSTRRKRRSSLFDMVTDE

SEQ ID NO: 2460 - protein, 355 aa, Cucumis sativus
MSPPLLDVGEVEESRSNVTLLASSNSMESVSPNNLEFEERNYMGLSDSSSEDSCMTATKSDGNKPSLNLKATELRLGLPGSESPERDPDNCLRSSSQLDEKPLFPLHPSSDGLYSSPQKTVVSGNKRGFSDAMNEFSEEKYHANIGLKAGSLLENLGSQMGKVKEPTTQKAVQERPQENSESRPSHNETANNNTSTPVSKAQVVGWPPIRSFRKNTLATTSKNNDEVDGKAMAGALFIKVSMDGAPYLRKVDLRNYSAYQELSSALEKMFSCFTIGQYGAHGALGMEKMSESKLKDLLHGSEYVLTYEDKDGDWMLVGDVPWEMFIDSCKRLRIMKSSDAIGLAPRAVEKCRNRS

SEQ ID NO: 2461 - protein, 340 aa, Glycine max
  misc_feature (101)..(101): Xaa can be any naturally occurring amino acid
MGVPERDPLAQLSLPPGFRFYPTDEELLVQYLCRKVAGHHFSLPIIAEVDLYKFDPWVLPGKAAFGEKEWYFFSPRDRKYPNGSRPNRVAGSGYWKATGTXQIITTEGRKVGIKKALVFYIGKAPKGSKTNWIMHEYRLLDSSRKHNLGTAKLDDWVLCRIYKKNSSAQKVEANLLAMECSNGSSPSSSSHVDDMLESLPEIDDRCFTLPRVNSVRTMQQQDEKFGFQNMGSRFFPDWVTPTDLDSVSEFGSGCQTQGMVNYDCNDLFVPSVPPFGHSHVNYMVGAPPSEEEVQSGVRTQQADGAACFQQNPNARLLPGSGDPFGFGFIMGQQVEFGFRD

SEQ ID NO: 2462 - protein, 505 aa, Antirrhinum majus
MWDLNDSPDQRKPEEPEGKWVGSVSNSSSSAVVVEDGSEEEDAEKCGIKRSSKIFGFSVAHNDDDEDETGNISSPVTRQFFPAGESPEIMLGGGGPPRAHWVGVKFCQSDPNGAVLGKAVAAHPLKKSRRGPRSRSSQYRGVTFYRRTGRWESHIWDCGKQVYLGGFDTAHAAARAYDRAAIKFRGVEADINFSLEDYEEDLKQMRNLTKEEFVHVLRRQSTGFPRGSSKYRGVTLHKCGRWEARMGQFLGKKYVYLGLFDTEVEAARAYDKAAIKCNGKEAVTNFDPSIYEEELKAAAEPSNKAADHDLDLSLGNSASKSSGQRPGFVDQPSSSMTFEVDWRRHGLKPENHMTSTDIDNPRRRDNGYSETETLQLLSQTHLNSPGMLKANDERHRFGQLGKTHEPHMIQMFNTPFTSQNYHQIYHNFPAAGASVSGSRNVNGGEFNNYVARNEQQWQMNHHQLFASAAASSGFPHAPPLLSSSRPRDWPLQKNGFHSSYNIRPS

SEQ ID NO: 2463 - protein, 505 aa, Antirrhinum majus
MWDLNDSPDQIRTFDDLSSEGRRVDYSSSSAVVIEDGNSEEELDAAGKKRNSSKIFGFSVHSCCDHDTCTCSSSSPVTRQFFPVEDTAPDNFPRAAHWVGVKFCPNDNGLGKAAIAADVAQPMKKSRRGPRSRSSQYRGVTFYRRTGRWESHIWDCGKQVYLGGFDTAHAAARAYDRAAIKFRGVEADINFSLEDYEDDLKQMSNLTKEEFVHVLRRQSTGFPRGSSKYRGVTLHKCGRWEARMGQFLGKKYVYLGLFDTENEAARAYDKAAIKCNGKEAVTNFDPSIYEDEFKTAESSKSEGDHNLDLSLGNSSASKSSGRERDNHSSSSMQLEADWRQWKPEQQLTSNNVGNPGKQYGYNETETLQLLSQTHLHSPLKVNNEMHRFGQLGKANEPQMLQMYSKPYAPQNYHQIHHHHQQQQFQGGGGSSSSTTNVVINGKSVGGVGEASSVSRNEQQWQMNYHHQFAAASSGFPQAQAQIIKPQNWLQIKKNGIHPSTLMRPT

SEQ ID NO: 2464 - protein, 115 aa, Brassica napus
  misc_feature (76)..(76): Xaa can be any naturally occurring amino acid
MLFFRSCEKMKSLASAVGAKTARACDSCVKRRARWYCAADDAFLCQSCDTLVHSANLLARRHERVLLKSASSIATXNHNHSPSSPPHEAATWHHGFTRKPRTPRGSGKKKICRYF

SEQ ID NO: 2465 - protein, 296 aa, Glycine max
MSRTCSQCGNNGHNSRTCTDGGAAGSPRENGIMLFGVRVMTEANSSFRKSASMNNLSQYDAEFNAADAGYASDDVVHASGRTRERKRGVPWTEEEHRLFLLGLHKVGKGDWRGISRNFVKTRTPTQVASHAQKYFLRRHNQNLLPAEIYLFDITTDTVMESSTIMEEEQVPQETMAAPIPAAYPPFPGAGFPMSLSPVVLPVSGERLTKPIRPTPIVPVPPSSKMANLNLKGKASRTNLIEPLPLSLNLPSPTPRSQDQSPANSGHSSPSSSSAAAFQAMSAAKFGGGGDSIISVA

SEQ ID NO: 2466 - protein, 391 aa, Hordeum vulgare subsp. vulgare
MTRSRPTTTMGGSVPDQHHQQQQHDGEVDGGQLQHGGEHVETVMPGFRFHPTEEELIEFYLRRKVDGKRFNIDLIASVDLYRYDPWDLPALASIGDKEWFFYVPRDRKYRNGDRPNRVTPSGYWKATGADRMVKVVEGNRSIGLKKTLVFYVGKAPKGLRSSWIMNEYRLPHGETERYQKEISLCRVYKRPGIDDNLHLTGTTTRSSGSRAAATRHSTAAHRTSAVATHRQQPPVFVEGAGHHSSSALKAYNAHTTQGTNAASTMTSLSAAGVTPPAMFRSTASVASLSSTNSTEEDGTSLYHHHLKGHNNPAVMQLHSSTHAALLNTNSSAMATIPIDELSRAIGSYSQASNPNQPTAPMQGPLLNFPSLEKIWDWNPLLESPKVCTSFK

SEQ ID NO: 2467 - protein, 264 aa, Glycine max
MVQQEVRKGPWTEQEDFKLVSFVGLFGDRRWDFIAKVNRTGKSCRLRWVNYLHPGLKRGKMTPQEERLVLELHSKWGNRSPWWSRIARKLPGRTDNEIKNYWRTLMRKKAQEKKRGEAASSSPTPSSVDSSISSNNHAVDPHASKKAGEESFYDTGGDNGVIAATQDQGQKGDQQGLFSMDDIWKDIDNMSEENNTTLQPVSVYDGHSEEGCNFSCPPQVPSPSSWEYSSSDPLWVMDEESLFCPLSEEPYFSCYAQGTVFLTG

SEQ ID NO: 2468 - protein, 240 aa, Zea mays
  misc_feature (233)..(233): Xaa can be any naturally occurring amino acid
RRSCDLDTWHSDHEPFLLPVAPSPRPRVGGGGHGREVMISFPAGAASTSGMQQRASSPRRKPGARTPRPKRSKKSQLKKVVREMPVADGSSSSPDPWAWRKYGQKPIKGSPYPRGYYKCSSMKGCAARKLVERSPAKPGVLIVTYMAEHCHPVPAQLNALAGTTRHKPSSGAATELHSAASSPRSHEQGQTVEFGGEEIAAVDDEDEFWPAGMDLDELLAPVDGDFDFEHVIXEDGVLGR

SEQ ID NO: 2469 - protein, 314 aa, Oryza sativa Indica Group
MMESYMEVLPPAPAHYFVGQAAAAGGWFLPDRRGGGGAWSQEENKVFEQALAALDRNDPERWERVALLLPGKTVADVMTHYDDLENDVCFIEAGLVPFPHYGAAGGGGGSGFTLDWDGGDDPAGLGFKRSCYMVGGKRARGPDQERKKGVPWTEEEHKLFLMGLKKYGRGDWRNISRNFVTSRTPTQVASHAQKYFIRLNSGGKDKRRSSIHDITTVNLPDDDHGNPSPSPPPSVLTAHSSSAAAAVSEQFGVLVDGKPPPPPLGRGAGHHHFMPHPYAQVKIEAGNSHVAGGGRLDDSVLVQMQCGQLMQPLG

SEQ ID NO: 2470 - protein, 118 aa, Nicotiana benthamiana
DDTPPTKSHSEPRHIVQTMSEVNIVNDGHRWRKYGQKFVQGNPNPRSYYRCSIAGCPVKKHVERASHDPKMVITTYEGQHDHNMSWFRTLSQITAAPDLSLTGVSGESRLESGENKHV

SEQ ID NO: 2471 - protein, 200 aa, Arabidopsis thaliana
MAPRQANGRSIAVSEGGGGKTMTMTTMRKEVHFRGVRKRPWGRYAAEIRDPGKKTRVWLGTFDTAEEAARAYDTAAREFRGSKAKTNFPLPGESTTVNDGGENDSYVNRTTVTTAREMTRQRFPFACHRERKVVGGYASAGFFFDPSRAASLRAELSRVCPVRFDPVNIELSIGIRETVKVEPRRELNLDLNLAPPVVDV

SEQ ID NO: 2472 - protein, 189 aa, Lupinus arizonicus
SSGPYPYFSSSSSSSSYYPFAFFNPENSSSNNTFSHDLLSFPYTIPTTHHYHAPTQETLSNFADCAASAAMFKNDVNGSNFGFSNFLAKKPASKKDRHSKIHTSQGLRDRRVRLSIDIARKFFDLQDMLGFDKASNTLEWLFNKSKKAMKELARSKNSSSGIVANSFSSSDSGFEVVSMINQDSIDATP

SEQ ID NO: 2473 - protein, 203 aa, Catharanthus roseus
MSEEIISVSDRFLLSLIEEHLLSDNSDDSSSELTSTEENWEEIFADFLNWSGSEIQKRGSPSSESCQSNSMAESCQEDSVVGTPPEAAAGGGCSKDWNRYKGVRRRPWGKFAAEIRDPKKKGSRIWLGTYETPEDAALAYDAAAFNMRGAKARLNFPHLIGSNISGPVRVNPRKRFPAEPSTTSSSSSSSSSENSGGRKKRRY

SEQ ID NO: 2474 - protein, 560 aa, Physcomitrella patens subsp. patens
MGTARGSDPEWQQLTELAQKSTRGGGRADVVQKAMPLLRSEKLLLLAIAVVTLKLPGRLLRPDVAEGKEGRNRGGSDLFRRRKRKRKWRSGAGGDGVGVVSEGIMVTGLAEGRSFHPGGSDQMTSLGNTYWCHQCNRTVRPTSRDELICPSCNDGFLEEIEHGGGGGRSHFMGFGGDQAFGFGGRDVDSGERAEGIGGPMGGFRRYHQTDPRGTRFPVRVEHPAVLQVLEAMSAVLQQIQPPQGGQDSSDVDTSGYGTHSRGRSGVMEDVPGGFSPLVRLQGQMHNFLGGGGNVDVFFDNGTGNPRRLPGNFGDYFLGPGLDQLIQQLAENDPSRHGAPPASKSAVEAMPTIQISQEHLGTDAMQCAVCKDEFELGALVRQMPCKHMYHADCILPWLAQHNSCPVCRYEMPTDDHSYNQSHSNSIPAASTAASTNPEGNGGGGSGGFTFWGAPAAFRFPTVESSSGGSRDAAPTNGSSSVTQASSAPAATAAPAPAPASGGGIGRRFSFYLPWLRSSPHSSAPAPAPGSSGAGDDGAGNQGSGSRRSGGDGHPEPHPELD

SEQ ID NO: 2475 - protein, 174 aa, Oryza sativa Indica Group
MESLLDLRRLLKKEKSAMNQKGDDLSMGKRLKALLTIVMRTTGPTRRSTKGNWTPEEDAILSRAVQTYNGKNWKKIAECFPDRTDVQCLHRWQKVLNPELVKGPWSKEEDEIIVQMVNKLGPKKWSTIAQALPGRIGKQCRERWYNHLNPGINKEAWTQEEENYPHTCSSNVWK

SEQ ID NO: 2476 - protein, 522 aa, Oryza sativa Japonica Group
MDSGLGRSSETSLKALPSMASNATRNTDPDQQGVRFSSMDQPPCFARPGQSFPAFPPLFGVQSSSLYLPDDIEAKIGNQFESNPSPNNPTMDWDPQAMLSNLSFLEQKIKQVKDIVQSMSNRESQVAGGSSEAQAKQQLVTADLTCIIIQLISTAGSLLPSMKNPISSNPALRHLSNTLCAPMILGTNCNLRPSANDEATIPDISKTHDYEELMNSLNTTQAESDEMMNCQNPCGGEGSEPIPMEDHDVKESDDGGERENLPPGSYVVLQLEKEEILAPHTHFCLICGKGFKRDANLRMHMRGHGDEYKTAAALAKPSKDSSLESAPVTRYSCPYVGCKRNKEHKKFQPLKTILCVKNHYKRSHCDKSYTCSRCNTKKFSVIADLKTHEKHCGRDKWLCSCGTTFSRKDKLFGHVALFQGHTPALPMDDIKVTGASEQPQGSEAMNTMVGSAGYNFPGSSSDDIPNLDMKMADDPRYFSPLSFDPCFGGLDDFTRPGFDISENPFSFLPSGSCSFGQQNGDS

SEQ ID NO: 2477 - protein, 326 aa, Oryza sativa Japonica Group
MRCPGVIPIGKEEEEEDGGGGAPAAAANNYGSSTTSSTTEEEGSGESRRRTSSSSSVRPYVRSKNPRLRWTPELHLSFVRAVDRLGGQDRATPKLVLQLMNVRGLSIGHVKSHLQMYRSKKIDESGQVIGGESWRSDDHLQMQGGGHGGQAYNLGHLSLPALHHRSITAGSGTIFQSRFGNSWSPWRCHGSYWLPAGHHLLVGSKPYYPPAAEAEAPFRRSSARYVARANTSNHPDFVQGSSSSPDDNIMNHQRPVLKEMICSEGSNHQEGPLNLDLSLDICPRGEKRKRECSWRKQEEDHDHATVAIGADQEAESCATGLSLSLF

SEQ ID NO: 2478 - protein, 727 aa, Oryza sativa Japonica Group
MGLCQSRLERQEAVSRCKARRRYTKQLVQARRDMAAAHALYLRALRATGAALLQFASAEADHPHPHHHVSAAPPPPQTPPSPPPPPPPPPPPPPPLSPTPTTTSWTTNSSSISASPILPPPPPPPMPSSWDFWDPFAPSSSRSATEDAEWDDAATTIVDAPNAPPVVTVAAAAAPPPSVVTATTTTSTASELTVVAVPRGGGGAGKKDLAEIATELDEYFLKAADAGARVAALLEAPNCEPPETNNSSFPGKTISKSVTRLSSILLTFHLFLTNYLLHATEIDECCREGTELRQELEADGMVMGRKRVQQRFGRGDEGMGNGGSSGILSHSSTVEKLYAWEKKLFLEVKCSVASVSMICAMLLEFIEVKGSFQLYYYHGRDFLVLSMTAQLAQSYEGLKQEHDKKIGLLRKQEVKGVDYLKMEKNKMEIESLDSKMLVATQSIETTTSEIMRLRESELFPQLLELVAGLMSMWRGMYECHQVQTHMVQQLEYLNNSLSTNPTSNVHRQAALQLEIEVDRWYSAFCSLVKSQRDYVYSLTGWLRLSLFQSYHDPYNKAHQNSDIYSLCEEWQLAIDRIPDKVASEGIKTLLTVIHAVVVQQAEEQKQKKRSESAFKELEKKAEELRSLESKYGPYSGAEGYGDMSRKSPVSDKRAKVEALRCRADEEKSKYEKSIGVTRAMTLNNLQTGFPNVFQAMTGFASVCMEAFESVYNFKSSDRILDSKRLLT

SEQ ID NO: 2479 - protein, 240 aa, Zea mays
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASGAAGSASSNSTVDSSGGGSGCGIQAPMQAMPLPPALDLDLFHRAAAVNAVSTGMRFPFKGYPVACPTPQQYFFYEQAAAAAAAASGYRMLKVAPPAVTVAAVAQSDSDSSSVVDHSPSPPAVTANKVGFELDLNWPPPAEN

SEQ ID NO: 2480 - protein, 323 aa, Solanum bulbocastanum
MDRMYSGGGDMGYGYENGVVMTRDPKPRLRWTADLHDRFVDAVTKLGGPDSLEFCRSYSQVSTKVNGIEGLDIVSFEESFAGRVRLQHLYSSMFCPVENSLGGFVLFFILQKYRLGQQTKKQNAAEQNRENIGESFRQFSLHSSGPSITSSSMDGMQGCIYLNREAPISEALRCQIEVQKRLHEQLEVQQKLQMRIEAQGKYLQAILDKAQKSLSTDMNSPSAVDETRAQLTDFNIALSNLMDYMHGHNGDETSAGERTQDDTNKDLQRSTYLTEGEQKKIMNIKLEETSVSFDLNSRSSYDFIGMSSAALEAKHFSNGRLEI

SEQ ID NO: 2481 - protein, 220 aa, Vitis vinifera
MASESEASGASSSASFLERLISSRNRDLSMFIPFILGFTDTTTRQESDDPDDETTDTPTPRDRIILINPFTQGMIVIEGNSSFDSLLRELASKGGQPPATKASIEAMPSVEVGGDDGECVICLEEWKVGCVAKEMPCKHKFHENCIVKWLGIHGSCPVCRHKMPVDEEDLGKKREGSREIWVSFSFNSNSRRNDSNQTPSTASHNDSSSSPTPDDHVMEN

SEQ ID NO: 2482 - protein, 90 aa, Physcomitrella patens subsp. patens
MSRLIKQIQKNKGPKRLREPRYAIKTRTEVDVMEDGYKWRKYGQKPVKNSPHPRNYYRCTTAHCPVRKRVERSTEDPGLVITSYEGTHSH

SEQ ID NO: 2483 - protein, 483 aa, Gibberella zeae PH-1
MTTEEVSKQTPEEFFQSIGDKVKNFAPAASAEAENDDDERAVEEIESLCMNCGKNGMTRLLLTAIPYFREVVIMSFSCEHCNLQNNEIQAAGTVQPKGTHYELRLTDLADFSRQVIKSDTATVKFIELDLEIPEGRGQLTNVEGLLTTVIDDLEMGQETRKEQTPELHIKIAEIIAKGRAMLLGDSFPFRVWVDDPAGNSFIAPDLKDGVGKWEKHEYARTDEQNASLGISDTNADNHQAQNPGLTAEGDIIPNEVYSFPATCPGCMRPCTTHMKMVDIPHFKQVVLMSTVCEDCGYRSNDVKTGGEIPEKGEKITLEVKDSTDLARDILKSETCALECPELKLQVNPGTLGGRFTTVEGLLTQVRGDLHSQIFEASGPGQGGDSLANDEKNQWTAFFDGLDAAIRGDKPFTIKLTDPFASSYVQPLVDPPAPDPSIHRESYTRTDEEEEELGLKDMKLENYGENDEEEKKDGEEKTEAATES

SEQ ID NO: 2484 - protein, 208 aa, Brassica napus
  misc_feature (21)..(21): Xaa can be any naturally occurring amino acid
MCGGAVIADYITPSRSSRSSXTWRRDNDVVDLTLDDFEGDFDEFESENEDIYGFSTAKPAAPLRRSSPPQEDRRKKKKSSEYRGIRRRPWGRWAAEIRDPIKGVRVWLGTFNTAEDAARAYDLEAKRIRGAKAKLNFPNESPSRKRKASSSSSPQPQVKIEEKQEVAVASSLWEGDTIQVDTQWLEDAIKGGEKEGKRQKGCDGEGDV

SEQ ID NO: 2485 - protein, 302 aa, Pinus pinaster
MERFANDVDEHSLKETELRLGLPGVCESDTGPGQTRNGKRGFSEVMDSTKASSFNDNKWIFPSVKCQPATSAITETAEACKGSQPGLFSATPSQKIMMQGGCGAPQSWAGDNGLSRSTAPKDELHPKTPRDGPTEKTNGASQSQAATDPAMAPAPKAQVVGWPPIRSFRKNTLAANSKPNDEGSSSNALYVKVSMDGAPYLRKVDLKMYSTYHELSSALEKMFSCFNMGQCGAPGLSESKLIDLLNGSEYVPTYEDKDGDWMLVGDVPWEMFVDSCKRLRITKASEAIGLAPRAMEKSRSKN

SEQ ID NO: 2486 - protein, 429 aa, Picea sitchensis
MQPVRANGENDLSESNSLFCSVHHSKDTLAMISALSRVVSGHILHPMESRTDKLVAGKKRRRDELQTTSSTMNCVKAEDISGQHSTFSQEESSILTPLQHQQRLREDDLSSKKKDELQVPQNSSKKRRYRGVRQRPWGKWAAEIRDPKKAARVWLGTFDTAEDAARAYDDAALKFRGARAKLNFPERVHVRDEDHLGMNIIKEERAAITDFSIQVAPATYHPSPPTFVPPTYDHHLSAQTRPTHCDADYRGNPAQHFITTDSTRLSELSDVYHYAQLLQNQGFDAEQANSCPSLLQQYSAYMSYQQEKEVYNQQLASIPPIQNQPGLDYIRQLQYTGRPNLASSNYTGARLPTYNNYVLQQQQQHVLIHQQQPSISTTGYQEVSNLDGNFIDQTSGNLLPTAQSQAKYYDNSGYNSVALPANNWHCPNL

SEQ ID NO: 2487 - protein, 337 aa, Beta vulgaris
MEPKTELSLGGGIRSSGFVTTKMEDTEEKEVIELPKPLENLHEIGPPPFLSKTFEIVEDPETDTIVSWGVTFDSFIVWDISKFSDLLSKYFKHRNFNSFVRQLNTYGFRKVHLDRLEYANSGFQKGKKHLLKTIKRRNHGANNNTALLLQRETAIENIKKEQEALKLEILDLKKEQQNSNTCLAALGERVKFVEWKQREFIMLIAKAMKRTSSFQQVLQNYRHNKVLSSGEFYKKRRLASTSDSLALADQFLANSPTTTQNKEDVSTFQYEANSFVGSAGQKSNLASETSSPDLSSGSYIMWEKLMADDVICKDDREEKYVHELENLITKPSSLICK

SEQ ID NO: 2488 - protein, 249 aa, Arabidopsis thaliana
MVSNIDHKAMEALLRGQGCANNLKILLENGEISSVSTEPLIHTILDSFSLALSFMDSPNHPPYHESSSHNMASHMSRRSSKQKLCVAEGLVNYNHDSRTMCPNDGFTWRKYGQKTIKASAHKRCYYRCTYAKDQNCNATKRVQKIKDNPPVYRTTYLGKHVCKAFAVHDDTYSSTMIRFDQVVPEPIMPQLTTIDHQVITVEENSAEHIMNQECDINDYLVDDDPFWASQFPPFPSSDTMFLENISAFD

SEQ ID NO: 2489 - protein, 193 aa, Capsicum baccatum
TARQVTFSKRRRGLFKKAQELSTLCDADIGLIVFSATGKLFEYSSSSMMQLIEKHKMQSERDNNTPEQLQSSNLQSEKKTYATLSRDFVEKNRELRQLHGEELQGLGLDELMKLEKLVEGGISRVLKFKGDKFMREISSLKRKEAQLQEENSQLKQQSQARLNEEGQNAIEQGHSADSITNNRSLVNSSHQDC

SEQ ID NO: 2490 - protein, 299 aa, Solanum demissum
MDQQQQEMSSQTLESMLVCTKPDQDQKKPRPAEQQPQKCPRCDSANTKFCYYNNYSLTQPRYFCKSCRRYWTKGGTLRNVPVGGGCRKNKKLSSTTSAKRSSQDNISPNISNPIPSYDSSTDLSLAFARLQKQTNAHLEIDQEHDNNNMSMMYNTGNNCTSTTFLDALRGGFLENAPNHPGLFHHNMYNYANMGQLVENGEMGMSYDQDQMSIGTSTTMMTTIVKQEMCNMARSTEGHDLNNSNNNNKVLCGFPWQQMNGDHHVNNMNTNDFEYSTNKQSWNGFGGSSNWHGLINSPLM

SEQ ID NO: 2491 - protein, 329 aa, Nicotiana tabacum
MAANTQRKESDRIKGPWSPEEDELLQSLVEKHGPRNWSLISKSVPGRSGKSCRLRWCNQLSPQVEHRAFTSEEDETIIRAHAKFGNKWATIARLLSGRTDNAIKNHWNSTLKRKCCSMSEDLSFETPQQPLKRSSSVGPSTNFSSGMNPGSPSGSDLSDSSLSGFPQSLVYRPVPRTGGIFPLPPLVQPIETAPFIPDPPTSLCLSLPGSGTRETSIQTAQPTQLTQPPQSPPPPPLALPPVDKPVPPPTAVFMSQLPQTKQSYDFCVPALPKSGEKQFFTPEFLGVLQDMIRKEVRNYMSGVEHNGLCMQTDAIRNAVVKRIGISKIE

SEQ ID NO: 2492 - protein, 310 aa, Brassica napus
  misc_feature (224)..(224): Xaa can be any naturally occurring amino acid
  misc_feature (226)..(226): Xaa can be any naturally occurring amino acid
MSKKRNPLEDPPAASSSDEEEVESSAEEEEEEDDNSSSEEEEEDDPKPPPSSSAVTIAVPGKPTATLPADSESGSETETDSESEPEQPTNKGSGKAVLTAKKDKDTPPPPPVALALPAKSGAKRPSTEGPSKETNSKRVKKDEEKREDSKKPAAFQRLWTEEDEIAVLQGMIDFKKDTGKSPYDDTNVYYDYIKKSISFEVSKNQFMDKIRSLRKKYIGKEKPXFXKPHDQKSYRLCQYIWGPDGMGLESAVKSNGASKKSQKKTKKLDSVKQELSFGASPNGKTVDDDENDVEVGAAAKKHDWFENSFL

SEQ ID NO: 2493 - protein, 247 aa, Gossypium hirsutum
MRNPTKKDNVGTKTTPCCSKVGLKRGPWTPEEDELLSNYINKEGEGRWRTLPKRAGLLRCGKSCRLRWMNYLRPSVKRGQIAPDEEDLILRLHRLLGNRWSLIAGRIPGRTDNEIKNYWNTHLSKKLISQGIDPRTHKPLNPQQLSPSPPSLKPSPSSSSSMAKPNNPPSPLPVHVVNANKQNYYDDGSNEDHQGMIMNNDHYQQQQDHDDVFSSFLNSLINEDDDALVSNLGLSQGWESTPFDQPK

SEQ ID NO: 2494 - protein, 194 aa, Lycianthes biflora
TARQVTFSKRRRGLFKKAQELSTLCDADIGLIVFSATGKLFEYSSSSMMQLIEKHKMQSERDSMDNPEQLQSSNFQSEKKTYAVLSREFVEKNRELRHLHGEELQGLGLDELMKLEKLVEGGISRVLKIKGDKFMKEISSLKRKEAQLQEENSQLKQQSQAILNEEGQNATEQGHSADSITNNRSLVNSHQDYN

SEQ ID NO: 2495 - protein, 240 aa, Prunus avium
MDMFFSQLSDSVDQPQSSLLSDASVTTRGASCSDGDVILASSRPKKRAGRRVFKETRHPVYRGVRRRNNDKWVCEMREPNKKKSRIWLGTYPTAEMAARAHDVAALAFRGKLACINFADSAWRLPVPASMDTMDIRRAAAEAAEGFRPVEFGGVCSGSSDEKERMVVQVEEKNKKGSVNLERSRSLSLSYWDEEEVFHMPRLLHDMAEGLLLSPSQCLGGYMNLDDMGTDADVKLWSFSI

SEQ ID NO: 2496 - protein, 143 aa, Arachis hypogaea
MVRAPCCEKMGLKKGPWTAEEDQILISYIQKHGHGNWRALPKQAGLLRCGKSCRLRWINYLRPDIKRGNFTIEEEETIIKLHEMLGNRWSAIAAKLPGRTDNEIKNVWHTHLKKRLIKPNQMNSSSSDTKRVSNKSKIKRSDS

SEQ ID NO: 2497 - protein, 197 aa, Witheringia solanacea
LTARQVTFSKRRRGLFKKAQELSTLCDADIGLIVFSATGKLFEYSSSSMMQLIEKHKMQSERDNMDSLEQLQSSNLQGERKTHAMLSREFVDKNRELRQLHGEELQGLGLEELMKLEKLVEGGISRVLKLKGDKYMREISSLKKKEAQLQEENSQLIKQSQARLNEEGQNVIEQGHSADSIANNLSLVNSHQDYNDS

SEQ ID NO: 2498 - protein, 250 aa, Physcomitrella patens subsp. patens
MEGASMSTNPRTVDEVFKDFKGRRSGMLKALTTDVEEFYRQCDPEKENLCLYGFPDEAWEVNLPAEEVPPELPEPALGINFARDGMQRKDWLSLVAVHSDAWLLAVAFYYGARFDKNERKRLFTMINELPTVFDVVTGKKPVKEKPAVNSSGTKAKSATKVQQVTQAKPAKPAPPPPKDEEEPLDDEDDEEHGDTFCGSCGGPYTADEFWIGCDICEKWFHGKCVKITPARAEHIKQYKCPSCSNKRART

SEQ ID NO: 2499 - protein, 131 aa, Cicer arietinum
ERGVGLEHEDENIADLYLAVQDGIISGTTDYDILFGQLLENESGLKGSPPTAKSFVENLPLVELTEEELKGKDIVCAVCKDEVMLEEKVRKLPCSHCYHGDCILPWLSIRNTCPVCRFELPTDDADYERSK

SEQ ID NO: 2500 - protein, 197 aa, Witheringia solanacea
LTARQVTFSKRRRGLFKKAQELSTLCDADIGLIVFSATGKLFEYSSSSMMQLIEKHRMQSERDNMDSPEQLQSSNLQSEKKTYAMLSREFGEKNRELRQLHGEELQGLSLEELMKLEKLVEGGISRVLKIKGDKCMREISSLKKKEAQLQEENSLLKQQSQARLNEEGQNAIEQGHSADSITNNLSVVNSHQDHNDS

SEQ ID NO: 2501 - protein, 266 aa, Zea mays
  misc_feature (118)..(118): Xaa can be any naturally occurring amino acid
MSSMELLHAVVPEKQSEEEVAPAATTTSSSATATGGDEGAHVLQGWAKRKRSRRQRSEEENLALCLLMLSRGGHHRVQAPPTPVPSAAPAAAEFRCSVCGKSFSSYQALGGHKTSHRXVKLPTPPPPPPAAPAPTTVVVPPLPPVEVGREPATSSTAASSDGAASSRVHRCSICHKEFPTGQALGGHKRKHYDGGVGSAAASTDVPAAPAETSAEVGSSAARAFDLNLPAVPEFVFRCGKPGKMWEEDEEVQSPLAFKKPRLLMTA

SEQ ID NO: 2502 - protein, 449 aa, Caulobacter crescentus CB15
MFSFPAAMRGARNLTSVSLPTLSRGVRLGITMLGRSPRPGRAIEGSSTMKLNLLAGAALAAVFAASGVSAQETGWYGAVDLGQHWPQSISTESNQTLPDGEYAHWAWKTDKDWTGFVRLGYQFNKNWRAEVEGGYRPGDLKAVRGNAVRQQPVALCTPGVTRTSSSQRCGSPDGSIDSWSLMANVIYDFAPDSWLNPFVGAGVGVNRLDVKTLGQFSGVGAVTPGNVAVQNLTVDDDDMAVAWQAIAGASIKATDKLKVDVTYRYLTGSDHSWQSSGSGLLQPGAFSGQYTDQSLTVGLRYSFASPPPPPPPPPPPPPPPPPPPPPPPPPPPPPPPAFEAREFIVYFPFDQSVLTPEAQSVVTEAAKYSNDGKATKIIVVGHTDTSGSPKYNAKLSERRARAVADALVSQGVSQNVLGVDWKGESAPAVATGDGVKEPLNRRSTISINF

SEQ ID NO: 2503 - protein, 855 aa, Oryza sativa Indica Group
MESLLDLRWLLKKEKSATNQKGDDLSMGKRLKALLTIVMRTTGPTRRSTKGNWTPEEDAILSRAVQTYNGKNWKKIAECFPDRTDVQCLHRWQKVLNPELVKGPWSKEEDEIIVQMVNKLGPKKWSTIAQALPGRIGKQCRERWYNHLNPGINKEAWTQEEEITLIHAHRMYGNKWAELTKFLPGRTDNSIKNHWNSSVKKKVNSYMSSAMTQQNSEDSGCFAVREVENSSGCSQSSLAKVSCSQVHDNTVPLGCDLQVNTNFDKNEAHDSQSSMGSEACYTSAEAVASALPAVHCHVSSSNLDPDQHLQEDFAQGLNLDMTIDEMPTVPSFADNQTVCSIENHERSLEPYDVAMEVPLSMLSSDSGAEQKLHFMSEADFNSPNCLKSELWQDISLQGLLSGPDAVEADSFSRSNHQSDVYSSEADTHFLAPPYMPQASNSSSVMGVADDQSPQMSVPPSLICSNVMTDDAPFDNRPGRKEMPLSQAEVVTQSSSSSGDAEMFANPGCSNDRHVPSSTMESIPECGDQQVTNAEEPEASLEKEPSLTQSVTAPDEQDKGALFYEPPRFPSLDVPFFCVLSDLLLLKSLEKKLVFSDENKENLGYTTEQTKDGQSAGNDEHMDEQTTGERSSATNVATNDDLSGNLQPAGILIEHSGDDPISPDYGKNTMNQKLNTNVKSLSVCKEGVCAKSKPTELIVEKSSPCINVDYEYVNILADTPGIKRGLESPSAWKSPWFVDMHFQGSYFTSPADSYDALGLMKQINVQTAAALVEAREVLASGGQCDNISSDKENTGNPDAKKEPGTTKLQTKIMAEGRVLDFECTTPVRSSDKNAGSSLGRYLSSPIPSSHLLKSFR

SEQ ID NO: 2504 - protein, 555 aa, Kluyveromyces lactis NRRL Y-1140
MSTDFDRIYYNQSKLGGRFRLAEGGLGWKASATGGSASTQNNEPLLLAADEVSSVQWSRGCRGYELKISTKNKGLIQMDGFQQEDFNLLKNDFQRRFNMQLEHREHSLRGWNWGKLDLARNEMVFSLNGKPTFEIPYTHINNTNLTAKNEIALEFDTQNEAYNPAGDELVEMRLYVPGTVEENEDQDQIMVKDEAEAEDGVKSEVKTEEGSEEPDVQEEKTLAEYFYEELRSKADIGEISGDAIISFQDLFFTTPRGRYDIDIYKNSIRLRGKTYEYKLQHRQINRIFSLPKADDIHYLMVLSIDPPIRQGQTSYPFLVLQFQKDEETEVQLNVEDDEFEKLYKDKLKKQYDAKTHIVLSHVLKGLTGRRVIVPGEYKSKYDQCAVSCSYKVNEGHLYPLDNAFLFLTKPTLYIPFQDIAAVNISRAGQTSTSARTFDLEVVMRANRGTTTFANISKEEQQLLETFLRSKNLRVKNEDKEAEQRLQTAFGSDSDDDDVDINMGSAGEDEESVDEDFHASDEDDDVAEEFDSEASASDSEGETSKSERPSKKAKLE

SEQ ID NO: 2505 - protein, 498 aa, Triticum aestivum
  misc_feature (237)..(237): Xaa can be any naturally occurring amino acid
  misc_feature (262)..(262): Xaa can be any naturally occurring amino acid
MASSGEDRGVVVDIRSAAESAGDDGARDAPLHVVESLCMRCGENGTTRILLTLIPHFREVVLMAFECPHCSERNNEIQFAGQLQPKGCCYTLKVPKGQPEVLNRQVVKSDSATIKIPELDFEIPPEAQRGTLSTVEGSIMRAVSELQALQDERKKVDPEKAEAIEQFLVKLRSLGSGEAAFTFILDDASGNSFIENPNAPSSDPLLSLRFYERTYEQQAALGFLAEPPTRESGDSSXDASTVEGNSGGPQRIPHGSVGAGAXRRAIAQGNSDEITAALCRYSAPEEVDTLPSTCAACATECVTRFFSTKIPYFREVIVMATSCDACGYRNSELKPGGEIPAKGKKTTLIVRNVKDLSRDVIKSDSAAVSVPELELELSSGTLGGIVTTVEGLIVKICEALERVHGFQLGDSTYEWKKKKWDGFTERLAKLLNLEEPWTLILDDALAASFIAPATDSLEDDKQLTIEEYERSWEQNEELGLNDMDTSSADMAYNTTSTS

SEQ ID NO: 2506 - protein, 316 aa, Zea mays
MGRGRAPCCAKVGLNRGSWTPQEDMRLIAYIQKHGHTNWRALPKQAGLLRCGKSCRLRWINYLRPDLKRGNFTDEEEEAIIRLHGLLGNKWSKIAACLPGRTDNEIKNVWNTHLKKKVAQREKKKAGAGSGDAGTPATAPLSSATSSTTTHNSSGGSDSGDQCGTSREPDATDPMPSPSSSSSLTTCVGGVEELIELPVIDIEPEIWSIIDGESAVARHGGDAAAPCTGTGTAVSTSEAEEAAANDWWLENLEKELGLWGYAEEDTQAHPDLLDHYTGLSPLCALEGDPVSTYFQTGPAAAEPELLVVVEPSAVLL

SEQ ID NO: 2507 - protein, 215 aa, Hyacinthus orientalis
DGLRGKQFSKHNYKAADALVQQISVLAASQGGAMRKVAGFFAEALALRIYRPHPQQDCSLDSAFSDILQMHFYESCPYLKFAHFTANQAILEAFEGCRRVHVIDFGMKQGMQWPALMQALALRPGGPPLFRLTGIGPPQPDNTDALQQVGWKLAQLADQIHVEFEYRGFVANSLADLEPYLLESAPNPRNGPHEIEAVAANSIFELHTLLAREGA

SEQ ID NO: 2508 - protein, 343 aa, Chlamydomonas reinhardtii
METLWPAPYALPLQSAAMALSEQQLGQHIDSGSEEDHIAVVAQVQTGKKRRSVSAEEDPDYEDAAQGAQGITHDGTSNKAGYRGVRRRPWGSYAAEIRDAGCGKRRWIGTFKTAEEAARAYDEAAIALHGPRAKTNFTYPCQQQSAAAAPAAAHKAHKPHAAAAPQHHKPAHHSQQPAQPRKQPLHPRQPYQQHQPPQLPTHQEEEQYRRKSDDSDTSMTAALPLPLSLTGQLGLPPLTLPGLEGLDLMALQSNPALLAALLAATRQHLPGLAGPDAQPACLPEQQLSERVWVQEQPVQGCEEEEDGLEEPEPPQVLRPEQLRSLQVLAEVAHLFGRRDFCMS

SEQ ID NO: 2509 - protein, 219 aa, Oryza sativa
  misc_feature (106)..(106): Xaa can be any naturally occurring amino acid
MAKTRQPQKRVLESFTIKGPDGVIKPGDTVLMMAPDSSKKPYVARVEEIEATGPQASQVKIKVRWYYRPEESIGGRRPFHGSKEVFLSDHYDSQSADTIEGKCYVXHTFRDYTKLRSVSAEDFFCRFEYKSATGSFVPDRIAVFCKCEMPYNPDNLMIQCEDCSDWFHPSCVEITIKEAKKLEHFYCKSCIAENGKDLQKSNGATAQSEEKVQSKRRRR

SEQ ID NO: 2510 - protein, 129 aa, Brassica napus
  misc_feature (125)..(125): Xaa can be any naturally occurring amino acid
MRKGRGSSAVPPALHGSVVKEPRYRGVRKRPWGRFAAEIRDPLKKSRVWLGTFDSAVEAARAYDAAARNLRGSKAKTNFPIDCSPSSPLQPLNYQNHHRNLAPNQNQMDPFMDHRLYGEGGGSFXEQQQ

SEQ ID NO: 2511 - protein, 690 aa, Triticum aestivum
  misc_feature (74)..(74): Xaa can be any naturally occurring amino acid
VRGSLAMPIYDPSKGSCCAVLELITKKEKPDFAAEMDNLRHALQAVNLETAKDCIDQKVYSANQKAAFTEILDXLRAICHAHMLPLALTWVPSSNGSDGGYVGHDSVLDSQSGKAILRIHESACYVNDAKMQGFFHACTETHLEKGQGIAGRALKSNLPFFSPNIREYGIKDYPLAHHARKFGLHAAVAIRLRSTYTGDDDYILEFFLPINCTGSEEQQMLLNNLSSTMQRICKSLRTVSEAEVDTARACTAVMYKATSGSCLPTGQSESSSRGDQPATEEAFQDLSLIDKQRGMSEQAQSSTMRLAEKKRSTAEKNIGMDVLRKYFSGSLKDAAKSLGVCPTTLKRICRTHGISRWPSRKINKVNRSLKKIQTVINSVHGVDSSLQYDPATGSLVPAVSLPEKTSFPSCDAVSSPSVGKTVDEKSGPKSEQGYSSPEGWERDSCQLQRPDAQKGEGGEFHMQTTNYSGSGDHGSYGPNITHHISSEGTQGPLYPTGAVSALHDKETGCIEPLPCVLPSIKTTRDQIVGRNSPPMQQADIDMFDDREGREHTHPSTSGMTDSSSGSASSHPTFKKNPARPLKDKSSPALTVKATYNGDTVRFKFLPSMGWYHLLEEIAKRFKLSTGVFQLKYKDDEDEWVIMANDSDLQECVDVMDSMGTRNVKLQVRDLPCLISSSGSSSCLQLEGHNS

SEQ ID NO: 2512 - protein, 279 aa, Arabidopsis thaliana
  misc_feature (174)..(174): Xaa can be any naturally occurring amino acid
MQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDSGSSSSSSQIASDFXESSSDQSRYLVNEDSGFVDGLLCETEEENNGMRLPQETQTQPMFTEEDQSFWENLDVDDVFGLFKDDNNLEVPLQDHSSTNEDDELLIDISEYLSEEAMECPCFS

SEQ ID NO: 2513 - protein, 340 aa, Populus trichocarpa
MDPTKFRGKQPMTVDIEQMPETPYRGSHHRRAHSDTSFRFDDLLFLDASDFDLSSLDDLPTPNTTTTTTTTTHPPPAAPMAVDSLSDDSTSNGQNQKPKPVNHLRSLSMDSDFFDGLGLGAAGGADEKFDGKAVAGEKRAANPHHRHSYSMDGSFEVDSIMIDGVKKAMAPDRLAELSLIDPKRAKRILANRQSAARSKERKIRYTGELERKVQTLQTEATTLSAQVTMLQRDTTGLTVENKELKLRLQAMEQQAHLRDALNEALREEVQRLKIATGQVPAVNGNPFNRGLPPQFSSHQGLQTFGNQQAQQQLHMPQPSTTGQTHNGQPHPSFSNFSQRV

SEQ ID NO: 2514 - protein, 347 aa, Glycine max
MIQEDQGQCSSQAINNYHQAYQEQLLLQQQMQQQQQQQQQNNDIFGGGLNMYPGGEVSQIMHHHHHQPWSMTMPHHHHHHHQVHDPFLVPPQTSPYASLFNRRGPSLQFAYDHGSSSDHLRIISESFVGPVVQPGSAPFGLQTELAKMTAQEIMEAKALAASKSHSEAERRRRERINNHLAKLRSLLPSTTKTDKASLLAEVIQHVKELKRQTSLIAETSPVPTEADELTVVDEADEDGNSVIKASLCCEDRSDLFPELIKTLKALRLRTLKAEITTLGGRVKNVLFITGEETDSSSSEDHSQQQQQCCISSIQEALKAVMEKSVGDHHESASANIKRQRTNIISMS

SEQ ID NO: 2515 - protein, 285 aa, Zea mays
MAASPSPSGSGGGKAGVDRIKGPWSPEEDEALQRLVRRHGARNWSLISRSVPGRSGKSCRLRWCNQLSPRVEHRPFTPDEDDAILRAHARFGNKWATIARLLSGRTDNAIKNHWNSTLKREREREREYYADARPGPGDQRSLKRTSSDGPPGSPSGSDLSDSSHQSLPTVMPSAASTAVTSQQQLQHVYYRPVPRAGGVVLLPVAPPSPQAPPATSLSLSLSLPGLDQQPEPSPPPPPTPQAQASSPLSAEFLLMMQEMIRIEVRNYMSGSGFDARAVMGMAEID

SEQ ID NO: 2516 - protein, 187 aa, Lupinus albescens
SGPYPYFPSSSSSYHPFAFFNPENASSNNTFSHDLLSFPYNTPTTHHYHAPIPETLSNFADCAASAAMFKNDVSGSNFGFSNFLAKKPASKKDRHSKIHTSQGLRDRRVRLSIEIARKFFDLQDMLGFDKASNTLEWLFNKSKKAMKELARSKNSSSGVVANSFSSSDSECEVVSMINQDSIDATPE

SEQ ID NO: 2517 - protein, 354 aa, Oryza sativa Japonica Group
MYHHQQQLQSHNQLLPSRQSFPSERHLLMQGGSVSGESGLVLSTDAKPRLKWTPELHERFVEAVNQLGGPEKATPKTIMRLMGVPGLTLYHLKSHLQKYRLSKNLHAQANAGNVKNALVCTTATEKPSEANGSPVSHLNLGTQTNKSVHIGEALQMQIEVQRRLHEQLEVQRHLQLRIEAQGKYLQSVLEKAQETLAKQNAGSVGLETAKMELSELVSKVSTECLQHAFSGFEIESSQMLQGHTMHLGDGSVDSCLTACDGSQKDQDILSISLSAQKGKEIGCMSFDMHVKERGSEDLFLDKLNRRPSNHPERCERRGGFSMSCQTANLDLNMNDTYDGPKHCKKFDLNGFSWA

SEQ ID NO: 2518 - protein, 357 aa, Arabidopsis thaliana
MPLDVLGRTHASYISGAGDNKSNKSFAIFPKIFEDDHIKSQCSVFPRIKISQSNNIHDASTCNSPAITVSSAAVAASPWGMINVNTTNSPRNCLLVDNNNNTSSCSQVQISSSPRNLGIKRRKSQAKKVVCIPAPAAMNSRSSGEVVPSDLWAWRKYGQKPIKGSPYPRCSSSKGCSARKQVERSRTDPNMLVITYTSEHNHPWPTQRNALAGSTRSSSSSSLNPSSKSSTAAATTSPSSRVFQNNSSKDEPNNSNLPSSSTHPPFDAAAIKEENVEERQEKMEFDYNDVENTYRPELLQEFQHQPEDFFADLDELEGDSLTMLLSHSSGGGNMENKTTIPDVFSDFFDDDESSRSL

SEQ ID NO: 2519 - protein, 193 aa, Brassica oleracea
MQDQLMCHGCRNTLLYPRGATNVRCALCNTINMVPLHPPPPPPHHAHAGMDMAHIVCGGCRTMLMYTRGASSVRCSCCQTVNLVPATPPTNQPAHVNCGNCRTTLMYPYGAPSVRCAVCQFVTNVNMGNGRVPFPTNQPNGTASSPGPMPSTSTQSTPPSQTQTVVVENPMSVNESGKLVSNVVVGVTTDKKK

SEQ ID NO: 2520 - protein, 343 aa, Coccidioides immitis RS
MAPTQRRGPWVPEEDQELLQLVRTQGPNNWVRISQHMKYRSPKQCRERFHQNLKPSLNHDPITPEEGLMIERMVNEMGKRWAEIARRLGNRSDNAVKNWWNGSMNRKKRRLAPTREPASRIFNGRVEPPYPRSPVSPQFRQAQLRDGQAPWLLTDCPQSARASIYIREDWPRERSSPVAHHRSLPPLFTPDSSSHIEHPLTSPCYSEVSTRTSAGPPSMISDHTSVASASPRTITSPSIPPIPVDIHPSYDERRRGSAPVVGFTSNQHHAYSSIAGAKSMEILAGSSPIRDWRSSTSDPHPHFHPHNPVPAYQHRPQSVPDTKTHSIMTQDRDARMGLNNLLN

SEQ ID NO: 2521 - protein, 254 aa, Arabidopsis thaliana
MVSNIDHKAMEALLRGQGCANNLKILLENGEISSVSTEPLIHTILDSFSLALSFMDSPNHPPYHESSSHNMASHMSRRSSKQVQHRRKLCVAEGLVNYNHDSRTMCPNDGFTWRKYGQKTIKASAHKRCYYRCTYAKDQNCNATKRVQKIKDNPPVYRTTYLGKHVCKAFAVHDDTYSSTMIRFDQVVPEPIMPQLTTIDHQVITVEENSAEHIMNQECDINDYLVDDDPFWASQFPPFPSSDTMFLENISAFD

SEQ ID NO: 2522 - protein, 197 aa, Withania somnifera
LTARQVTFSKRRRGLFKKAQELSTLCDADIGLIVFSATGKLFDYSSSSMMQLIEKHKMQSERDNMDSTEQLLSSNLQSEKRTYAMLSREFVEKNRELRQLHGEELQGLGLDELTKLEKLVEGGISRVLKIKGDKYMREISSLKKKEAQLQEENSLLKQQSQARLNGGGQNAIEQGYSTDSVTINRNLVNSHQDYNDS

SEQ ID NO: 2523 - protein, 306 aa, Solanum tuberosum
MDPTNEGNNLNNNPSLASKQRLRWTHELHERFVDAVAQLGGPDRATPKGVLRVMGVQGLTIYHVKSHLQKYRLAKYLPDSSSDGKQSDKKESGDMLSSLDGSSTGVQINEALKLQMEVQKRLHEQLEVQRQLQLRIEAQGKYLKKIIEEQQRLSGVLSEVPVSGVTPSAAGDNGVDSDNRTDPGTPAPTSESPHIDTSVQEHARSKSLSIDQSFSSQHEPLTPDSGCRETSPINSSEGERSSKKQRVGTSATFTKADMLLPHQILESSLGSPYEQPNPVFLASDQFNLSSGLSLGNEGPNVSGSNV

SEQ ID NO: 2524 - protein, 189 aa, Genista pilosa
SSGPYPYFPSSSSSYHPFPFFNPENASASNNTFPHDPLSVSYNIPTTHHHVPIPETLLANFADCAAAAAMFKNDVNGSNFGFSNFLTKKPAPKKDRHSKIHTSQGLRDRRVRLSIEIARKFFDLQDMLGFDKASNTLEWLFNKSKKAMRELAQSKNSSSGVANSFYSSDSECEVVSMINQDSIDAAPEG

SEQ ID NO: 2525 - protein, 309 aa, Gossypium hirsutum
MGRSPCCEKVGLKKGPWTPEEDQKLLAYIEQHGHGSWRALPLKAGLQRCGKSCRLRWINYLRPDIKRGKFSLQEEQTIIQLHALLGNRWSAIATHLPKRTDNEIKNYWNTHLKKRLTKMGIDPVTHKPKTDALGSTTGNPIDAANLSHMAQWESARLEAEARLVRESKLVPSNPPQSNHFTAVAPSPTPATRPQCLDVLKAWQGVVCGLFTFNMDNNNLQSPTSTLNFMENTTTLPMSSSSSVNGMFNENFGWNSSINPCESGDILKVEYGSDQIPELKERLDHPMELHEMDCSSEGTWFQELFGFNGL

SEQ ID NO: 2526 - protein, 197 aa, Withania somnifera
LTARQVTFSKRRRGLFKKAQELSTLCDADIGLIVFSATGKLFDYSSSSMMQLIEKHKMQSERDNMDRTEQLLSSNLQSEKRTHAMLSREFVEKNRELRQLHGEELQGLGLDELTKLEKLVEGGISRVLKIKGDKYMREISSLKKKEAQLQEENSLLKQQSQARLNGGGQNAIEQGHSTDSVTINRNLVNSHQDYNDS

SEQ ID NO: 2527 - protein, 190 aa, Genista anglica
SGPYSYPYFPSSSSSYHPFPFFNPDENASGNNNIFPHDPLSVSHNIPTTHHHTPIPETLANFADCAAAAAMLKNDVNGSNFGFSNLLTKKPAPKKDRHSKIHTSQGLRDRRVRLSIEIARKFFDLQDMLGFDKASHTLEWLFNKSKKAMRELAQSKNSSSGVANSFSSSDSECEVVSIINQDSIDATPEG

SEQ ID NO: 2528 - protein, 418 aa, Zea mays
MSISVNGQSCVPPGFRFHPTEEELLNYYLRKKVASQEIDLDVIRDVDLNKLEPWDIQEKCKIGSGPQNDWYFFSHKDKKYPTGTRTNRATAAGFWKATGRDKAIYNAVKRIGMRKTLVFYKGRAPHGQKSDWIMHEYRLDDPAAAAAAGSGDAVANDDAAATAAAAAAASSDGGQEDGWVVCRVFKKKHHHKESGGGGGNKHGSSNSEHGHGGAGKASAAAAAAAHQHQHHGGLQYSSSDEALDQILQYMGRSCKQEHELVSPAPAPPGRAAASRYLRPIETVLGGHAFMKLPALESPSAAASASLTQPAQHDELYRAAGNGITDWAMMDRLVASHLNGQQAPAAADQLGGGCGFDADAGAEDADAGLAFYSAAASRLLGSGGGAGSDDDLWSFTRSSVSSTAAAAATSTERLSHVSL

SEQ ID NO: 2529 - protein, 247 aa, Arabidopsis lyrata subsp. petraea
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLEANRALSMKLEDMIGVRHHHIGGAWEGGDQHNVAYGHPQAHSQGLYQSLECDPTLQIGYSHPVCSEQMAVTAQGQSQPGNGYIPG

SEQ ID NO: 2530 - protein, 197 aa, Withania somnifera
LTARQVTFSKRRRGLFKKAQELSTLCDADIGLIVFSATGKLFEYSSSSMMQLIEKHKMQSERDNMDSPEQLQSSNLQREKKTYAMLSRDLVEKNQELRQLHGEELQGLGLEELMKLEKLVEGGKSRVLKIKGDKYMREISSLKKKEAQLQEENSHLKQQTQVRLNEEVQNVIEQGHSADSIANHRSLVNSHQDYNDS

SEQ ID NO: 2531 - protein, 362 aa, Oryza sativa
GAASPPPGAAGNPSGPRSIEVNSDSEDSALPLASDAYADQAAAAGAGAGADSDDGNTSPLPPPRPSRAEAAAIKPISSRPMDPPPRRSAGGSEPRAKRPRSAAVASSAEHSKRPSRVWSQADELVILRGLITYRTKRGVLPGSTQDIGKLHSYIRGQLSAKVSTTQLSDKVRRLKQKYQMLATRAKTGKEVFPTPHDHNIYQLAKKVWGTMSTAGEGGGSGYDNADAGESEEEQYGRESDDDMESGRDNRHRKNQRSVPVTMANGNGTGIGAVNAIVRGRSEFEKGKDVYPYLWETVEELSSQHPTGAVFKKAFELLEGSKAQVMEEKLRKFRLTEMRQQLRRMDLMKDTLSMVLDALEMAD

SEQ ID NO: 2532 - protein, 199 aa, Withania coagulans
LTARQVTFSKRRRGLFKKAQELSTLCDADIGLIVFSATGKLFEYSSSSMMQLIEKHKMQSKRDNMDSPEQLQFYNLQREKKTYAMLSRDLVEKNQELRQLHGEELQGLGLEELMKLEKLVEGGKSRVLKIKGDKYMREISSLKKKEAQLQEENSHLKQQTQVKVRLNEEVQNVIEQGHSADSIANHRSLVNSHRDYNDS

SEQ ID NO: 2533 - protein, 600 aa, Oryza sativa Indica Group
MSSAAGGGGGYGGGGGEHQHQQQHHHLLLGQAAGQLYHVPQHSRREKLRFPPDHPAESPPPPPPGSWPLPPAFYSYASSSSSYSPHSPTLAHSQLVAHGMPPGAATSGGAQIPSQNFALSLSSASSNPPPTPRRQFGGGGGGAAGPYGPFTGYAAVLGRSRFLGPAQKLLEEICDVGGRPAQLDRGSDEGLLDVDAMEAAGSVDHEMDGSDRAVADAVTVSGAEQQWRKTRLISLMEDFKALLSSLLKLAGGDPQFIYNQKVCKRYRQYYQQLQAVVSSFETVAGLSNAAPFASMALRTMSKHFKYLKGIILNQLRNTGKGATKDGLGKEDTANFGLMGGGAGLLRGNNVNSFSQPHNIWRPQRGLPERAVSVLRAWLFEHFLHPYPTDSDKQMLAKQTGLTRNQVSNWFINARVRLWKPMVEEIHNLEMRQLKNPSLDKNQLSMQHTQHSSDSSGKPCDPSNSLQGQSSSMTRNHSISASRHIEDGLSQMPHDISGQVSFAYNGLAAHHSIAMAHHHQPDLIGTGGAANAGGVSLTLGLHQNNNRAYIAEPLPAALPLNLAHRFGLEDVSDAYVMSSFGGQDRHFTKEIGGHLLHDFVG

SEQ ID NO: 2534 - protein, 344 aa, Oryza sativa
  misc_feature (121)..(121): Xaa can be any naturally occurring amino acid
MITLPIIKSVEFCRQKCQNDNVDSCKRCSCKKSKCLKLYCECFASKVYCSESCSCRGCFNDHSHEETVLSTRNRIESRNPLAFAPKVIRTCGPGLEFGVRAHSFCFSFLSLLLITFFFMAXEDSNATPASSRHKRGCNCKRSYCVKKYCECFQSGVGCSMSCRCENCKNSFGVRKGIERFETKEIERADRKMKDHPKEEQSEMDKYHALCEIWGVRSTENLFTTPSMDSRRAFALFPSECPKSSLTSSTRTSSHLHSPTRTDVLLSPFGSYTQMLLGNEASDMLLQQGDSSCTASLRIASPNKKRVSPLRTGNTLSPTCRKELGLKSIIPPFPSLTGDANSELQ

SEQ ID NO: 2535 - protein, 111 aa, Chlamydomonas reinhardtii
MRYKYDDQGQGPWTAEEDAVLKSLIAQRGPRQWTRIAENIPGRSGKSCRLRWLNQLSPALKTSPWEPQEDAVILWAHLHYRNRWCEIAKHLPGRTDNHIKNRWNCTLKKRL

SEQ ID NO: 2536 - protein, 382 aa, Arabidopsis thaliana
MPTLYKKAEISILFPMNGEISRPPELISSRNPCKSFENAIHKAVEAELAELAKSDANGGGKSKVKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKPAEQWKIPLLMSNTEIVYQLYPSMVRRISNASPKEHLPQEEETGVLSDDKMDDEAKEPPREQNSKTGVYRPVARMGAFSVCKPGYMAPCEGPLVQASRPDSLAGKFLQSLCYDPIIPSKCGHGCCNHQDSTTLSSSSVLGSEFVDYEEHSSAELDKELISISNDLNNTAWIRSGKEAEQSLKADDQFRREYAHSKFSGMVNNGVSSQMVRQDLRALS

SEQ ID NO: 2537 - protein, 140 aa, Hordeum vulgare subsp. vulgare
VTEPPCEVKDRCASKLLVLAPGRAALTTPAPNLNSGIDPLSASPSSLGQGEVNAAASSQSNASLSQMDERELKRERRKQSNRESARRSRLRKQQECEELAQKVSELTAANGTLRSELDQLKEDCKTMEVENKQLMGKILG

SEQ ID NO: 2538 - protein, 239 aa, Zea mays
MVKTAASSSSDDAAAAKRRTYKGVRMRSWGSWVSEVRAPGQKTRIWLGSHATAEAAARAHDAALLCLRGSAADLNFPLRLPFDLPPAATMSPKAIQRVAAAAASASSSSSCGGGGGLRAPPPFAPRAENNGTSACSDGDGDATPASSTTSSPTSHADDVSSPDSTVSSAGDVDYYTSLADIDAFFQSPKCVVDYALMDPCSAFFAPDSTAADDDGGCCWAWEEDGGGIALWSFSATLDC

SEQ ID NO: 2539 - protein, 172 aa, Brassica rapa subsp. pekinensis
MAPTAKTTAFKTNGADGGNKENRYRGVRKRPWGRYAAEIRDPTEKTRVWLGTFDTPEAAARAYDKAAFQFRGAKAKTNFPLPFFVADNESPSQSSTVESPSSIPDLNLGSISSVDSRFPSPKIQAKSGMIVFDEESGRSESDSSSVVVDLSSEKRPRVFLDLDLNLPPKPEN

SEQ ID NO: 2540 - protein, 575 aa, Debaryomyces hansenii CBS767
MNYPSDQPPYYSYDQYHQGYQQQRPYQTPGSQPNGHLSNMRPQGGPTGIYPHNESVDNHTTGSQGQQKLSNGTNTISIYNTSAGNSRRGFWSPEEDRKLMELISIFGASNWVKISNSLSTRTPKQCRERYHQNLNPSLNRKPISAEEGELIEQLVAKHGKKWAEIARHLNGRSDNAVKNWWNGGANRKRRATVHMKVSPEQLFSTAAGHSQDLIQDQRNVQRLPQPLPQPHPPQQISFKTSMFGDQEVANTPPLSSTSSANSTSPYRTSNQRLASLDVDNVAQLMHHHNMHANSSQSANTTASNLNSNQNIVLPPLNNVNGSLPSLILPSKKRLLDEHNPISRRHSYANTMYSVQNQNAYANNITNSNPNLSNLVNASHQPNSLNTSGQNSPYHGSPLMLSNQASRNNSISIPNFEFSTLNTSNATSLSDSRRSSYNPDFFPNPLKENAQTSHKRNISQNSFNSPLTPSYRYSVSSGGSTYNTTTNTSSSSNPNANTNINTSNTTNNSAIDADQPNASPEYVKDDKSAATGSEEKRQAGQDKNHFGSDKIDEDQDIKENTEATENTKISVSSLLD

SEQ ID NO: 2541 - protein, 192 aa, Triticum aestivum
MNLTDWLLCRCRNNKPKKKAEKRPRLPRVSFLTKSEVDHLEDGYRWRKYGQKAVKNSPYPRSYYRCTTPKCGVKKRVERSYQDPSTVITTYEGQHTHHSPASLRGSAAHLFMPPGLHGLPPPHLIPPGVFHPELMSMMRMPYPSPNMHLLSVPPPPHHHPTSHPMAGTLQQYHFTDYALLQDLSTSTMPNNP

SEQ ID NO: 2542 - protein, 305 aa, Arabidopsis thaliana
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSSSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 2543 - protein, 182 aa, Zea mays
MEATPISMKPPSPAPAAPPPATLEPGDLPTHAFGGTELEPSSMNQLAIAPDPKRRPRVEEAADGNGCKHCACKKSRCLKLYCPCFSGGGYCSDKCGCQPCFNKEAFAETVHTTRKVLLSRQKRMSMKINRRPEANTEPMEDAHHSSSSTPPKRGCNCKKSSCLKKYCDCYQDGTGCSLFCRC

SEQ ID NO: 2544 - protein, 228 aa, Triticum aestivum
  misc_feature (137)..(137): Xaa can be any naturally occurring amino acid
MSKTPGKTPRTPRRILESYTIKGSDGVIRPGDSVLMKAPDTSKPPYVAKIEEIEAAGPRGANVKVKVRWYYRPEESIGGRRPFHGEKEVFLSDHQDVQSADTIECKCNVYSFRDYTKLSAVNPEDYFCRFEYKSITXGSFVPDRIAVFCKCEMPYNPDDLMIQCEECSDWFHPACIGKTIKEAKKLENFTCEGCVAENGNGNGVKNENSHESTGESDEKQVQSKRRRR

SEQ ID NO: 2545 - protein, 385 aa, Oryza sativa
MAGAGDWPFAADEAYADSSAIFAELGWANGLAVVDAVGELLPPLDPPGELATPPPPPLDLPETPAGSSADGAASSCSTDDADGGKPAAASTEAASKSLTPGKKRARQPRFAFMTKSEIDHLEDGYRWRKYGQKAVKNSPFPRSYYRCTNSKCTVKKRVERSSDDPSVVITTYEGQHSHHTVTFPRAAATAAGFSHIHAMAALAAAPFSAHQQLYSNLQPPPPTMPLAATTPASSSSLLQLPLHCNHELQVVASCGGYPSSSSSPPASVLPVDKGLLDDMPCAAADPVVVVAREGCRRDRQAVADLVRPSVVAVGCRRTVAVVKPKVAAASSSTPSPSVDLPPLFWSPGDYDPGKVRCGGLCCARGTVTAPFREEEFYSDADGVED

SEQ ID NO: 2546 - protein, 344 aa, Zea mays
MDAFTHVPPGFRFHPTDEELVDYYLRKKVALKKIDLDVIKDVDLYKIEPWDLQEKCRIGSEEQNEWYFFSHKDKKYPTGTRTNRATTAGFWEATGRDKPIYVKNCLVGMRKTLVFYKGRAPNGQKSDWIMHEYRLETNNNGIPHEEGWVVCRVFRKRLATVQRMVGDSPYWFNDHAGFMAPELGSPRQAAHHQQNVMMYHRQQSSYSYPCKVELEYHHLLPQEHFLQQLPQLESPKLPDLIGQVDTTLQPACGLTQEHGAPRYTLQELQAEPLYLATGGDTDWRALDKFMASQLSHGDITPNKDSANNYSNPALQVIQQSEEKEEALDYVSTSASCGGDNDLWK

SEQ ID NO: 2547 - protein, 110 aa, Lolium perenne
MGRSPCCEKMGLKRGPWTAEEDKILVAHITSFGHGNWRALPKQAGLLRCGKSCRLRWINYLRPDIKRGNFSDEEEQSIIQLHQLLGNRWSAIAARLPGRTDNEIKNYWNT

SEQ ID NO: 2548 - protein, 348 aa, Brassica rapa subsp. pekinensis
MDQWFYLFPAEDSHLHHRDNALTPPSSSLMPSFSREMEMSAIVSALTHVVSGNVPPHQFVGGGEGTSNSSSSSGQKRRREVEEGGGGGKSVKAANTLTVDQYFSGGNSSSRVREASSNMSGSGPTYEYTTTTTTNTETSSLNGDQQPRRRYRGVRQRPWGKWAAEIRDPFKAARVWLGTFDNAESAARAYDEAALRFRGNKAKLNFPENVKLVRPATTQSVQQTTAVQTPTQFRNSTSTSTLLPLRPAVDSQPLIQPYNLSYSEMARHQQQFQQHNQQTMDLYDQMSFPLRFGYTGDSMMQSTSSSSSHSRPLFSPAAVQPSETGYLQDIQWSPDKTSNHNYNNSSSS

SEQ ID NO: 2549 - protein, 196 aa, Triticum aestivum
  misc_feature (97)..(97): Xaa can be any naturally occurring amino acid
QPTPSWAREPLFEKAVTPSDVGKLNRLVVPKQHAEKHFPLKRTPETTTTTGNGVLLNFEDGEGKVWRFRYSVLGTAVKSYVLTKGWSRFVREKDLRXPGDSIVFSVLPRTGKEKQLFIDCKKNTTVNSGKSASPLPVVETAKGEQVRVVRLFGVDIAGVKRGRAAMAEQGPPELLKRQCVPLPHGQRSPALGAFVL

SEQ ID NO: 2550 - protein, 580 aa, Oryza sativa Japonica Group
MGVAVHWRRAGDSLHMGGEPRARAEAAWAAALPAALVALVRDTATYTRMMHRLRMETPRGPTCQLDPCCCCCTAHVIPPPPPVSRTHATRRDAEASVPPPPASAAVSSRSDGTGQMAAGVTLACAAPPPLRAPRASDGGRRRGVVKGGAGTDTCRSPQRLNVRPRERERVRACVRARAKNHEHGQRRREAAVDPAMSGEYQFQDELAPLFARPGGGAGEMQMLPSSWFADYLQAGTPMQMDYDLMCRALELPVGEDVKREVGVVDVVAAGGGGAPPLTPNTTSSMSTSSSEGVGGGGGGGAGAGAGEEESPARCKKEEDENKEEGKGEEDEGHKNKKGSAAKGGKAGKGEKRARQPRFAFMTKSEVDHLEDGYRWRKYGQKAVKNSPYPRSYYRCTTQKCPVKKRVERSYQDPAVVITTYEGKHTHPIPATLRGSTHLLAAHAQAAAAAAAAHQLHHHHGHHGHHGMAPPLPLGSGAAAQFGRSSGIDVLSSFLPRAAAAHHGMTTMGGAAATTTTSHGLNSAISGGGGVSSETTSAVTVAASAQPSSPAALQMQHFMAQDLGLLQDMLLPSFIHGTNQP

SEQ ID NO: 2551 - protein, 370 aa, Erythrobacter sp. NAP1
MASTALTAPAMAREGQWYVQGDAGVMLVEDTTFDVDGSPGDAVADHDTGGDFGALVGYDFGAFRLEAEVSYKEAELDEVAAGTEGLALNPSAQGGFNRFFDVRDALGETSALSFMINGLFDFGSDDGIQGFAGAGVGVARVDLDGRVNTNGPGVWDDSDTGLAWQLLAGIRAPLSDSFDVGLKYRYFNAESVSIIDPLGRPLEGDFNTHSILGTLTYNFGGEAPPPPPPPPPPPPPPPPPPPPPPPPPPPPPPPCNTGPYIVFFDFDESVITADAATILDNAVTAYANCGTAAVMLAGHTDRSGSVTYNMGLAERRNASVRAYLTGRGIPDGRISSEAFGESQPRVPTADGVRELQNRRVEVTYGPGSGM

SEQ ID NO: 2552 - protein, 119 aa, Brassica napus
MAAGDYFRIRDDLMGAGDELMLLRYLKPMIDDGASWPQHFTEDADVFNKNPSKEFNPENTVFVIVNPRTEACGKTDGCEYGSWRIMARDKLIKNEVTGKLLGFKKILKFCVEKTKRGRE

SEQ ID NO: 2553 - protein, 115 aa, Brassica napus
  misc_feature (96)..(96): Xaa can be any naturally occurring amino acid
MDIAKWPQKEFIVKPMNETCLKQPNPAAAPVEEKKARPEKYHALNCPRCNSLNTKFCYYNNYSLTQPRYFCKDCKRYWTQGGSLRNIPIGGGVRKXNKRSSSSSSSNSQFRFLFK

SEQ ID NO: 2554 - protein, 332 aa, Vitis vinifera
MADASPRTDISTDVDTDDKVQRFERGQPASNMASDSSDRSKDKNDQKTLRRLAQNREAARKSRLRKKAYVQQLESSRMKLTQLEQELQRARQQGIFISSSGDQAHSMSGNGAMAFDVEYARWLEEQNRQINELRSAVNSHASDAELRVIVDNIMAHYDDIFRLKGVAAKADVFHLLSGMWKTPAERCFLWLGGFRSSELLKLLVNQLEPLTEQQLLGIGNLQQSSQQAEDALSQGMEALQQSLAETLSSGSLGSSGSSGNVANYMGQMAMAMGKLGTLEGFIRQADNLRQQTLQQMHRILTTRQSARALLAIHDYFSRLRALSSLWLARPRE

SEQ ID NO: 2555 - protein, 316 aa, Oryza sativa Indica Group
MAAGEEVMDRSTSAEDGYCSAGTDSPRAESVDEQGAAEESSPRGGQKRELPSPSASPSSPLPPAAKRSRRSVEKRVVSVPIAECGDRPKGAGEGPPPSDSWAWRKYGQKPIKGSPYPRGYYRCSSSKGCPARKQVERSRADPTVLLVTYSFEHNHPWPQPKSSSCHASKSSPRSTAPKPEPAADGQQPEPAENESSASAELEVPEPEPEQESEPVVKQEEEQKEEQKAVVEPAAVTTTVAPAPAVEEEDENFDFGWIDQYHPTWHRSYAPLLPPEEWERELQGDDALFAGLGELPECAVVFGRRRELGLAATAPCS

SEQ ID NO: 2556 - protein, 338 aa, Arabidopsis thaliana
MSPEEELQSNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLAAAPRAMEKSKMRA

SEQ ID NO: 2557 - protein, 217 aa, Oryza sativa Indica Group
MSCGGAGQSGWLLEYGLVEEEIQGSDFIYMVDDPAAVSSVLLGFDVPRKEDGSGGQDNSASKKRFNELSAILEPGKPPRADKVSILSDAARLLSQLRAEAQKLKSSNESLQDSIKSLKAEKSELRDEKTRLKAERERLEQMLKGVGAATPAAPAPFVPHHAAAVAAAPAYHPAAFAQAGGKYVPYATNYAPPAAFWQWIPPTSLDTSKDPVMWPPVA

SEQ ID NO: 2558 - protein, 71 aa, Physcomitrella patens subsp. patens
IKTRADTDVLDDGYKWRKYGQKAVKNSPHPRNYYRCATPNCPVRKRVERCIEDPGLVATAYEGTHSHQFPS

SEQ ID NO: 2559 - protein, 345 aa, Arabidopsis thaliana
MASLENPAIDSSSEFESSSEEISSSKESKPKEAPVTVPSTKTLNSPSAAVAVSDDSESEKQSFVLTRRKKKEGAAESPAVKSGKKEGAAESPAVKSGNNEGATESPAVKSGKKRASEGTTSRDMHVKRIKKEGDNKKGHAQRVWSEEDEISLLQAMIDFKAETGTSPWDHKDRFFDIAKKSISFDVSKVQFFDKIRSFKRKYFGDRKVRSVESDHDKKCLGLAVSFWGSDGVSLETPVKKKVKDESVLVKANSKEKNVKPLVKEDEQVVILGEDSEWFEESFLVPVIASLGLDEYSVKKKWSKVSVETKKRIQEKMKLVDAKKCELLLANMDVLKEVTSVLTQTN

SEQ ID NO: 2560 - protein, 336 aa, Arabidopsis thaliana
MSPEEELQSNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLAPRAMEKSKMRA

SEQ ID NO: 2561 - protein, 267 aa, Physcomitrella patens subsp. patens
MGGETQWPSAEAKEKNGIPPPAGGTASGNPTSQMDAPQSSGPPPFLTKTFEMVDDPATDAIVSWSEVGSSFVVWNTPEFAQELLPKYFKHNNFSSFVRQLNTYGFRKVDPDRWEFANEGFLRGRRDLLRSIHRRKPSSHAQQQQGAYVEGGKSGLEAEIERLKTDKNVLMLELARVRQQQQSTFRDLQLMAQRLHVSESRQQRMITFLAKAMANPSLFAQFVSQQNESNHLVRKKRRLPIQEDGDMDESMSPESSIENQIVTYQPSE

SEQ ID NO: 2562 - protein, 266 aa, Oryza sativa Indica Group
MSPPLELDYIGLSPPPPPPSSSSAAAARADDVDLKGTELRLGLPGSESPDRHPAAIAAAAATATTLELLPAKGAKRVFPDEAALTPPTAAAGKGKAAREGEEVGAEEEDKKVAAPPQPAAKAQVVGWPPIRSYRKNTMATNQIKSNKEDVDAKQGQGFLYVKVSMDGAPYLRKVDLKTYKNYKDMSLGLEKMFIGFSTGKEGAENQKDGEYVLTYEDKDGDWMLVGDVPWEMFTDSCRRLRIMKGSDAIGLGCSQLRLVPLFVPKL

SEQ ID NO: 2563 - protein, 768 aa, Castanea sativa
MDTYSSGEELVIKARKPYTITKQRERWTEDEHNRFLEALKLYGRAWQRIEEHIGTKTAVQIRSHAQKFFSKLEKEALVKGVPIGQALDIDIPPPRPKRKPSNPYPRKTSIGVPTSQVGTKDGKLFTSASSSDCKQALDLEKEPLPEKPNGDEKPENAKDNQDDNCSEVFTLHQEVHCSSVSSANRSSVPTPVALRNLNTLREFVPSMKRSITQDETNESYVTIELKGNQKLEKADAKQTIQDTGTSNGSKLGNHNVLHEKPIQGDKTQDLNCALPMDEMQATQNYPRHVPVQVVDGSLGTCTQTPSSDMSFQDSIFHPMGEVHRHHNPFTNPAASATTEHQNNVPRSVNQSFPAFHPPFTPIRHNQDDYQSFLHMSSTFSSLIVSTLMQNPAAHAAASFAATVWPYANVEASADSPASTQGVFPPRQMGSTPSMAAIAAATVAAATAWWAAHGLVPLCAPLPTAFTCNPASTAAVPPTDSGQAPAAKTEGEVNTLQTPPLQQLDPEYSEAVQAQHSDSKLPIPSSSDSEESGGAKLNSGPKATDHENAVTATELHDSNKTKGRKQVDRSSCGSNTASSSDRETDALEKQEMGKEEPKEPDANHSAADTSNRRCCSSSSRSFSYMNDSWKSVSEEGRLAFQALFSREVLPQSFSPPHDLKNMGNQKDNTTDDKQNANENDGNASLLDLNSQKSGSCSVQQGILNFEPNNNGEGLLTIGLAYGKLKARRTGFKPYKRCSVEAKENRVANASGQGEEKGPKRIRLEGEASI

SEQ ID NO: 2564 - protein, 306 aa, Glycine max
MSSGTTYWCYTCRQPIWLEGREAICPYCDGGFVQELNELRGVARQHGFSSRMEDAHQMPDIMDAVRAVMEQRGSEPRIRVRDAVDNFMRQRMAGRYTNFDVRRRSGSGSGSGSILIPDETWGVFSSGPYLIFHGQAPGFTNSNGSSRGGPRRVDFGDYFLGPRLEGLIEQHISNDRLGPPPASHSSIDAMPTIKITHEHLQSDSHCPVCKERFELGSEARKMPCNHVYHSDCIVPWLVLHNSCPVCRVELPPKEHTSSRGRRIWGNGSGSGSSNDISRGRENRQMNNGRRNLLSYLWPFRTSSSST

SEQ ID NO: 2565 - protein, 93 aa, Fragaria x ananassa
WESHIWDNGKQVYLGGFDTAHSAARAYDRAAIKFRGTEADINFSVGDYDEDIKQMSNYTKEEFVQILRRQSTGFARGSSKYRGVTLHKCGHWE

SEQ ID NO: 2566 - protein, 845 aa, Physcomitrella patens subsp. patens
MAFVATAGQKQLVPERAIRSSSSLGYSSFGELAPGDSVTQQQREFQVVHRYTMAQQHAERAQSRHFAHSEDTKPSTHDFLSLYDKGSQQAENVSSAGLSSSLTTHDFLQPLERNGARPTSRDAPVLREKHSSGENGQSRHSTPGPGEQAHPTSSPNYAAIKVPYTVPPNSMLRMVGEAEAVRQGRNYPIATLSSREDHSGSETFKGVEIAVGPEAANAQENLAHWPGVRFQFGMPPDLTFTAGNPAAKSVVENGHQLLPTMTKHWAQAAQGMIESPKRPARPPSDEDEDDDEDSSERPKVNRKEPMLRKGDGAQRMDSKNADLRGVTPRSKHSATEQRRRSKINDRFQMLRDLVPHSDQKRDKASFLLEVIEYIQVLQDKVRKYETVEQGRHQERLKSMVWDLCKRGAAGSGDETSQINALVFAKDLNSGVRSVDIKPGTEVPADRVPRSSEEAAPISEAHSTGGLNAQQASSRPACSIHSCVSSLGGEKESATAVTAVGVPLQQAIPSPHAFPIVPSKGQREQDSNRGTPASNSNAPRKEKTSDMDLVSSRENGYAHDTTPDHQFEVRPRISSGQADQNSDHQPKDHQMSATTIVGRMDGVQAGLLSSAPRQPQGGPQHKEDANKHTRHPQTNQNDHMATRDGFAVFPNIPQPFPRIQGGVINVSSVYSQGLLDTLTRALQSSGVDLSRANISVQIDLGKNATVAPGDTSAKVATTPESSAQSHQSQGRTRPAPSVPESEPARKRPKLLSSAYTKHHCLLRSGCGKIEKDRFGFRLCYDQHDAGFWHNECRSFGLSFAKISLSGLEMAIWRTALLRFVISFEPTSAGKEGVHAVVACSLITIFH

SEQ ID NO: 2567 - protein, 479 aa, Candida glabrata CBS 138
MSEDKLFKPVGEAANEVQEENDNGVSLTGASDAMGHPVQEIESLCMNCEKNGVTRLLLTSIPYFREVVLMSFECPHCGFKNSEIQPASQIQEKGSKYQLKVESKEDFNRQVVKSETATCKFVELDVEIPAKRGQLTTVEGLLSEMIEDIEQDQEMRKSIDENLYNQIAEFIKKVRSYINCEPGTLPLTFILDDPSGNSWIEYKPGEPQHKWSHVQYVRSDEQNVVVGILTEDQYEQRRRAKLEELSNKGRNPSESVKVGSANAEFLSDATDIENFNNEVQTFRASCPSCTQECETHMKPVNIPHFKEVIIMSTTCEHCGYKSNEVKTGGSIPEKGRKITLLCDDPADLSRDILKSETCSLHIPELHLDIQEGTLGGRFTTLEGLLKQVYEELESRVFTQTSDSMDEATKQRWVDFFAKLKEALDGKVHFTVIMEDPLAGSYIQNVYAPDPDPNMKIEDYERTQQQNEDLGLNDMKTDAN

SEQ ID NO: 2568 - protein, 278 aa, Chlamydomonas reinhardtii
MSGEPSPLEEQPDLDNSEDLHNSSDAANASSRKGQPWSEEEHRAFLAGLKSLGKGSWRQISQQFVPTRTPTQVASHAQKHFMRVAGATKRKSRFTALETEVLPPAKIAHVDSRQHGSEQTEQLEPQPQAQARQPAMAPQAQQAGAPAASQFGPMAAFGPMAAFPFMNPMMFGFPAPFFPPFMCPPPAFAAAAMQSMNAMQKSGAAGDQGRELGQPPGLARCELRGRRQSGREVAWRDQSVARQSKGARHNCMGNVVTNNNINTKNKKWMWTPAAEHRI

SEQ ID NO: 2569 - protein, 359 aa, Zea mays
ALWCTGVSRPSSLTPSAATPSSILPDGAPGSRNKMSNRATHWCYACRRPIRLRGQDIVCPNCNDGFIQEISEMGGILNTYGLIEPDFEERRARRFGMMDAMSSLMRQRMEEMGRDGLFDIRGRQGTGTEYGRRPTAVPTLVFGGIPSPGVDSGDVNVVLRGGRRVGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDH

SEQ ID NO: 2570 - protein, 198 aa, Brassica rapa subsp. pekinensis
MNPSQSPSPNFTFLSDENSIYSVMDNYDFSNLMFSVGEGGSNGLIQEETSSPTTIVTGESGGSGSAFTTLRKKESTSLDCKNRGSKDGETKEMGHRVAIRTRSKIDVMDDGYKWRKYGKKSVKNNTNKRNYYKCSSEGCMVKKRVERDGENAAYVITTYEGVHNHESPSHVYYSDMVFDHDNWKQHSLLQSIQTFPPC

SEQ ID NO: 2571 - protein, 253 aa, Zea mays
  misc_feature (44)..(44): Xaa can be any naturally occurring amino acid
MAAGFEALLDSTALSLALPVPVPTMTLLGLKKLNSEDYLAICLXAALAGTRGRSGLSKAAAAAAGFGRQEGGGSRKQWSCPPPAPAREEEELRFRCAVCGKAFASYQALGGHKSSHRRPPTGEQYAAALAAAQQAAGSAADHSEETTTTSGGPHRCTICWRGFATGQALGGHKRCHYWDGSSVSVSLSATASATGTGTGSSGVTVRNFDLNLMPVPESDGMRRWVEEEEEVQSPLPIKKRRISNPSLTLATCD

SEQ ID NO: 2572 - protein, 259 aa, Triticum aestivum
MSKTPGKTPRTPRRILESYTIKGSDGVIRPGDSVLMKAPDTSKPPYVAKIEEIEAAGPRGANVKVKVRWYYRPEESIGGRRPFHGEKEVFLSDHQDVQSADTIECKCNVYSFRDYTKLSAVNPEDYFCRFEYKSITGSFVPDRIAVFCKCEMPYNPDDLMIQCEECSDWFHPACIGKTIKEAKKLENFTCEGCVAENGNGNGNGVKNENSHESTGESNEKVHITALKKDGPGVVVKYSPLVPRAQEVLGSASLHCTVQG

SEQ ID NO: 2573 - protein, 409 aa, Arabidopsis thaliana
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLFPPLEGISMDNDHQEPDTNQTGAAERKVDSYKDST

SEQ ID NO: 2574 - protein, 310 aa, Triticum aestivum
MALEAVEFSQGHFGYGQAPGLGPWCDMVGAGGFFEDCWDQQLLAAPVAPNAEDQWEPVSSWDQSEASSEGKAAAPEPAMAAAATGRRKRRRTKIVKNKEEVESQRRTHIAVERNRRRQMNEYLAALRSLMPQSYAQRGDQASIVGGAINYVKELEQLLQSLEVQKSVKNRTGRSPFASSFTFPQYSTSCNATQATASDGGSGADSSGVKSEAGVADIEVTMVEGHASLKVLSRRRPKQLLRLVAGLQQLRIPPLHLNVTTVDAMVLYSFSLKVEDGSKLSSVEDIAAAVHEILARIQREEEEAGRLSSSS

SEQ ID NO: 2575 - protein, 262 aa, Zea mays
MKVQCDVCAAEAAEVFCCADEAALCDACDRRVHRANKLAGKHRRFSLLSPAPPPPPPLCDICQDKRGLLFCKEDRAILCRDCDVSVHTASDLTMRHARFLLTGVRLSAEPAAACPAPEDEEEEDDENSSGSFCCSAGDAAAHPPPLPSSAPATSHGSDSSSISEYLTKTLPGWHVEDFLVDEAAAAAATDIGVSAADASYQDGYPAWMAAQERLLCEGEGGGGGARGSRERWVPQMATYSGTGLAVAGSNKRSRAASSFPYW

SEQ ID NO: 2576 - protein, 188 aa, Oryza sativa Japonica Group
MRKSKQPQPQPSPEIRYRGVRKRPSGRYAAEIRDPAKKTPIWLGTFDSAEVAARAYDDAARSLRGPTARTNFPLAAPSAPPPRPPAAAAAAATSSHSSTVESWNRGAPRVTASALARSAAPMEATQEEDCHSYCGSSSSVLCEDGSDDAAASRTPLPFDLNMPPPEEELDMAAVADQMGIRYDTLLRL

SEQ ID NO: 2577 - protein, 334 aa, Arabidopsis thaliana
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLRPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGSHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 2578 - protein, 363 aa, Oryza sativa Japonica Group
MWEGGSHDAAAQLLPWFVGEPAAAAVGGYGGCVDVVGQGGVFGFGFEAAAAPVVTRQQRGGAAAAEGSSRGGGGKPAVVSGLLGSLQAELGRVTAREIMDAKALAASRSHSEAERRRRQRINGHLARLRSLLPNTTKTDKASLLAEVIEHVKELKRQTTAIAAAAAAGDYHGNDEDDDDAVVGRRSAAAQQLLPTEADELAVDAAVDAEGKLVVRASLCCEDRPDLIPDIARALAALRLRARRAEITTLGGRVRSVLLITADEQQQQHCDDVDDDEDGHRLLLRHGIDGAGAAADDDDECAASHRRHECIATVQEALRGVMDRRAAASSGDTSSSGGAVVAGGGGGSIKRQRMNYGVHEQCSV

SEQ ID NO: 2579 - protein, 612 aa, Oryza sativa Indica Group
MSSAAGGGGYGGGQGGGAEHHHHHHGHAGHLLLHHHPQHVAGAAVAAAAAAAGGQMYHVPQHSRREKLRFPPDAGDSPPPHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGSNGGVSLTLGLHQNNRVCIAEPLPAALPANLAHRFGLEEVSDAYVMSSFGGQDRHFGKEIGGHLLHDFVG

SEQ ID NO: 2580 - protein, 109 aa, Diervilla sessilifolia
TAQGPRDRRVRLSIEIARKFFDLQDMLGFDKASRTLDWLLNKSKTAIKDLVQSKLGCTSTALTSIYECEEMKSKTYKLVPNNGEIACGIKEKKMRKQTDKSAIDLVARE

SEQ ID NO: 2581 - protein, 351 aa, Physcomitrella patens subsp. patens
MSLKKHARPRETATCGSHPAECELSSLSSTEGAAGRSYHNREQENVAAVHHCKDSNVSGTLTTAQSRDRRRFRYDPPRPGWPATSDVSPTSQGVGFGGVWAMSEASSGPSTVRHPWAGGVRLRVNGVLPGHSGKKVKKKEQPPKQGFIHVRARRGQATDGHSLAERARREKISNRMKFLQALVPGCSEVTGKAVMLEEIINYVKSLQRQIEFLSMKLAAVDPRVDTNVEGLLKMEAEHWTGKNARCSAVQSLHTMQYQVEEEIALLTSDPSELYKLKSSNITSAKERDRDSAPVRFYPPSSIRLRQQLIGCNGCHIANHAIGDGGMNSVLTTVLPKLGRRQNVTISLYLQK

SEQ ID NO: 2582 - protein, 67 aa, Capsicum annuum
PSDPWHEFCEVVSKIHIYTQEEVEKMTIQGISDDTHSCLEEAPAATMDVSKSSSIGQPDSSLTTIRI

SEQ ID NO: 2583 - protein, 565 aa, Yarrowia lipolytica CLIB122
MNDFSPMNVSPMNVSPMNGSPAAFQQQQQQQTTTTETSRRRVWTSEEDDKLRELVKVYGDKRGKTGNWDQISAHLAGRTNKDCRKRWFHSLDPNLKRGKWTKAEDEILLRAFETHGGVWHQIAKLIPGRTDDQCSKRYNDVLDPRISDRLRKWTREEDEALLVKIRNHGTSWRIISNEMEGRTGLTCRNRWRKLMAQYIRQRDLHKDTPPMTVIQHMASDAELQHIPWGEYKNVSLKEEHLSSDEDDDEEEQTSPGWNSPGQPQQQQQANVPQPPHQNHHMMQQTQIHGGQLPHMMQQNQPQLPQQQQQQQQQQQQQQQQQQQPGAMQPSQIQQRHLQQQQHQHQQHQQQPQPPTATGSSTATSTSTTTTTTTYKTKHQRNIPGVAPSSSGVELTADAMAYLRELFLSSEKELVVEVHHVTHIHNHSHNLTLNSSVETASTSIGTGNLGSLGSNVSSSVSNSTPTITPTSTGANMGSQMMPSNDVMADQYSYQQFFNQPVQQGVQSNMNSMPQGQQQGNMHDIHEHDIDGAMAMLYGEDFGLDLEEAPKRLPGGHPFRGLPFAPS

SEQ ID NO: 2584 - protein, 97 aa, Diervilla sessilifolia
TAHGPRDRRVRLSMEIARKFFDLQDLLGFDKASKTLDWLLTNSKAAIKELVQMKISCTTGSQCDTVCENYNYNYNNNNEMPVGNEKIRDAFDSSSRE

SEQ ID NO: 2585 - protein, 394 aa, Arabidopsis thaliana
MNSFSQVPPGFRFHPTDEELVDYYLRKKVASKRIEIDIIKDVDLYKIEPCDLQELCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRVFKKKLAATVRKMGDYHSSPSQHWYDDQLSFMASEIISSSPRQFLPNHHYNRHHHQQTLPCGLNAFNNNNPNLQCKQELELHYNQMVQHQQQNHHLRESMFLQLPQLESPTSNCNSDNNNNTRNISNLQKSSNISHEEQLQQGNQSFSSLYYDQGVEQMTTDWRVLDKFVASQLSNDEEAAAVVSSSSHQNNVKIDTRNTGYHVIDEGINLPENDSERVVEMGEEYSNAHAASTSSSCQIDL

SEQ ID NO: 2586 - protein, 185 aa, Glycine max
MFLLGLHKVGKGDWRGISRNFVKTRTPTQVASHAQKYFLRRHNQNRRRRRSSLFDITTDTVMESSTIMEEEQVPPETVAAPLPAAYPPSHYGAFAGAGFPIAPVVLPVSGERLTKPIRPTPILPVPPSSKMANLNLKEKASPTNLIEPLPLSLNLPSPTPRSQDQSSASSGHSSPSSSSSAAAFQ

SEQ ID NO: 2587 - protein, 328 aa, Zea mays
RNKMSNRATHWCYACRRPIRLRGQDIACPNCNDGFIQEISEMGGILNTYGLIEPDFEERRARRFGMMDAMSSLMRQRMEEMGRDGLFDIRGRQGTGTEYGRRPTAVPTLVFGGIPSPGVDSGDVNVVLRGGRRVGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDH

SEQ ID NO: 2588 - protein, 272 aa, Solanum lycopersicum
MEKVNFLKNGVLRLPPGFRFRPTDEELVVQYLKRKVFSFPLPASIIPEVEVYKSDPWDLPGDMEQEKYFFSTKEVKYPNGNRSNRATNSGYWKATGIDKQIILRGRQQQQQLIGLKKTLVFYRGKSPHGCRTNWIMHEYRLANLESNYHPIQGNWVICRIFLKKRGNTKNKEENMTTHDEVRNREIDKNSPVVSVKMSSRDSEALASANSELKKKASIIFYDFMGRNNSNGVAASTSSSGITDLTTTNEESDDHEESTSSFNNFTTFKRKIN

SEQ ID NO: 2589 - protein, 477 aa, Oryza sativa Japonica Group
SSSSDLTLDDHHHLTAVAAASGQATQKLQEFLSRLEEERLKIDAFKRELPLCMQLLNHAMEAYRQQLEAYQMGSQHSAAAAAAARAPLVLEEFIPVKNIGIDVVAADKAAAAGGNSVSSEKASWMVSAQLWNAPASASAADTAAKGPQTPKEHSEHHPLDTSPKLITAAALPELALAPAEKAADAITIAAGEVDKKPYAHDNGVVARSREAQNGGKPPSTPSDGQAVPPPPQPHRKARRCWSPELHRRFVNALQILGGAQVATPKQIRELMKVDGLTNDEVKSHLQKYRLHTRRPMPSPAPPTAATPQLVVLGGIWVPPEYATQAAGPAIYGAHPATQPHYTAAVAAQEYYHHHHHHLQHHPAAAALVHHRAVAPPPPLPPQQQLAPPYSAKSSASARLGSPDSDGRGSGGGGGAAASGAGRDMSESIEEEGEGEEREDDDDDDEMAATNNAHAVDGDDDNDEINTTTTTSAGAINY

SEQ ID NO: 2590 - protein, 378 aa, Fagus sylvatica
MCGGAIISDFIAPTGSRRLTADYLWGDRKKPISGKRFSKPVVDLDDEFELDFQGFKDEEESDIDEEEVLVQDVKPFTFSAPPSSGSKPVKSVEFNGQAEKSAKRKRKNQYRGIRQRPWGKWAAEIRDPRKGVRVWLGTFNTAEKAARAYDAEARRIRGKKAKVNFPDETPRASPKRSVKANLQKPLAKANLNSVQPNLNQNFNFMNNSDQDYTMGLMEEKPFTNQYGYMDSIPANADVGLKPFASNNTTPYFNSDQGSNSFDCSDYGWGEQGSKTPEISSVLSATLEGDESQFVEDAMPTKKLKSDSGNAVFIENNTAKTLSEELSAFESQMNFQMPFLEGSWESNMEALFSGDTTQDGNSMDLWSFDDLPVMAGGVL

SEQ ID NO: 2591 - protein, 311 aa, Oryza sativa Japonica Group
MEDLYSIHPGISRGGGGGGGGAASEASGVAGGGSSPPHPPPPATTAAAADLTELMKAQIAGHPSYPSLLSAYIECRKVGAPPEVTTLLEEIGREGRGGGGGATAGGEIGLDPELDEFMETYCRVLERYKEELTRPFDEAASFLTGIHTQLASLCGGAPPPTDNSDEMVGSSEDEPCSGDADAADFGQEHSSRLADHELKEMLLKKYSGCLSRLRSEFLKKRKKGKLPKDARSALMDWWNTHYRWPYPTEEDKVRLAAMTGLDPKQINNWFINQRKRHWKPSEDMRFALMEGVTGGSSSGTTLYFDTGTIGP

SEQ ID NO: 2592 - protein, 370 aa, Lotus japonicus
MFPNSSYPYPYFPSSSSSSPSPYPPFNFLNPGNASTNNIFLHDPPPLPSVPYTNNTTNTHHHHAPPTCSETFTNWALADAMLKQENLTGGPHHHYNLSNFLTRKLPAAKKPAKKDRHSKIHTSQGLRDRRVRLSIEIARKFFDLQDMLGFDKASNTLEWLFSKSNKAIEELFRSKHSDNNNSTGACAADGDGDGDDDSFSSSSSEDEVVSVKRAQKEKEPSGVQAKMKESREKARARARERTSNKMCPETENPQMQLHQFSSEFQPHQELHRDDDFKVFEESIVIKRKLKQSLMSSSHHHQNQNIGIPKEASFNNNNNSECPSSFPMSPNWDASGATPRSNICAIASVNLSTGLQIFGKSWEECTSPHLH

SEQ ID NO: 2593 - protein, 228 aa, Triticum aestivum
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRRMRGEELDGLSVGELQQMEKNLETGLQRVLCTKDRQFMQQINDLQQKGTQLAEENMRLKNQMHEVPTASMVAVADADAENVVPDDVHSSDSVMTAVHSASSQDNDDGSDISLKLALPWK

SEQ ID NO: 2594 - protein, 352 aa, Arabidopsis thaliana
MDEMSNVAKTTTETSGLTDSVLSLTKRMKPTEVTTTTKPALSNTTKFKGVVQQQNGHWGAQIYADHRRIWLGTFKSAHEAAAAYDSASIKLRSFDANSHRNFPWSDFTLHEPDFQECYTTEAVLNMIRDGSYQHKFRDFLRIRSQIVANINIVGSKQVLGGGEGGQESNKCFSCTQLFQKELTPSDVGKLNRLVIPKKYAVKYMPFISDDQSEKETSEGVEDVEVVFYDRAMRQWKFRYCYWRSSQSFVFTRGWNGFVKEKNLKEKDIIVFYTCDVPNNVKTLEGQSKTFLMIDVHHFSGNGFVVPEEVNKTVHEISDEEMKTETLFTSKVEEETKSEEKKGGFMLFGVRIQ

SEQ ID NO: 2595 - protein, 245 aa, Populus tomentosa
MGRGRVELKRIENKINRQVTFAKRRNGLLKKAYELSVLCDAEVALIIFSNRGKLYEFCSTSNMLKTLERYQKCSYGAEEVNKPAKELENSYREYLKVKARFEALQRTQRNLLGEDLGPLNTKDLEQLERQLESSLNQVRSTKTQYMLDQLADLQNKEHLLLEANRGLTMKLDEISARNSLRPSWEGDDQQNMSYGHQHAQSQGLFQALECNPTLQIGYNPVGSDQMSCTTHATQQVHGFIPGWML

SEQ ID NO: 2596 - protein, 241 aa, Lotus japonicus
MGRGRVQLKRIENKINRQVTFSKRRAGLLKKAHEISVLCDAEVALIVFSHKGKLFEYATDSCMEKILERYERYAYAERQLVANDSESQGNWTIEYTRLKAKIDLLQRNHRHYMGEDLGSMSLKELQSLEQQLDTALKHIRTRRNQLMYESISELQKKEKVIQEQNNMLAKKIKEKEKIAAQQQHAQWDHPNHGVNAPFLMQQPLPTLNMGGNYREDHAPDVGRNELDLTLEPLYSCHLGCF

SEQ ID NO: 2597 - protein, 346 aa, Arabidopsis thaliana
  misc_feature (70)..(70): Xaa can be any naturally occurring amino acid
  misc_feature (87)..(87): Xaa can be any naturally occurring amino acid
SHCQLHLTYYFHISFSYLYINPPGSSLISFIVKTYQMVNDPSTDWLITWGPAHNSFIVVDPLDFSQRILXKLETGDYELMILSLFTXGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSTPSPPSTENLYRNHSPDGWIVPMTQGQFGSYETGLVAKSMLSNSTSSTSSSLTSTFSLPESVNGGGGGGCGSIQGERRYKETVTFGGVVESNPPTTPPYPFYLPGRPLEPYSE

SEQ ID NO: 2598 - protein, 336 aa, Arabidopsis thaliana
MRFFFSLVPLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRLLFEAEISFLLAKHFYTTSDSLPRNVLLPAYGFCSPDKQEEDEFYPVTIMISEGKDWPSYVTNNVYCLHPSELVNVHDGKFHDNGICIFANRTCGVTDKCNEGYWKIKHREKLIMSRYGQTIGWKKVFQFYETEKERHFGNGEEVKVTWTLKEYRLTRKMNKNKVVCVIKYKVKCLPRITS

SEQ ID NO: 2599 - protein, 367 aa, Zea mays
  misc_feature (242)..(242): Xaa can be any naturally occurring amino acid
  misc_feature (258)..(258): Xaa can be any naturally occurring amino acid
MYHPQCELLTMAHETPDLDAGQPHLTVSGVASIPAELSFHLLHSLDAAAAVNPVTAPPQSTIDYFLGGADPHQQAMQYEPLPPAAGGHHQYTMDMFRDYCDGHYPTAEPYIRGTMTGALVFGATDDDDSAAAYMPGGHFETSPPPPRATGRGRKRGRALGGGFHAVLANGVEKKEKQRRLRLTEKYTALMHLIPNVTKTDRATVISDAIEYIQELGRTVEELTLLVEKKRRRRELRGDVVDXAAPAPVVAPPGEAGEXREGEGAPPPPAVPRQPIRSTYIQRRSKDTSVDVRIVEGDVNIKLPKRRRDGCLAAASRALDDLRLDLVHLSGRKIGDCQIYMFNPKIPKGSSVFASAVAGRLMEVVDEY

SEQ ID NO: 2600 - protein, 215 aa, Triticum aestivum
  misc_feature (101)..(101): Xaa can be any naturally occurring amino acid
MAVDAVRDAAAMVSEEEEEGQLRCDEGWGKRRRPRRQRQRAPSEEEHLALSLLMLARGHRDRHLLPSSSPAQEHRCSVCGKGFPSYQALGGHKASHRPKPXPAGADEPAATAAASPAASSSTTSSGAGGGGRVHECSVCKKTFPTGQALGGHKRCHYEGPIGASAVASRGFDLNLPALPDIVTERERCMPAPADDYEEEVLIPLVFKKPRLMIPA

SEQ ID NO: 2601 - protein, 383 aa, Zea mays
DEKETTRLAAVSLTTRCPRPIGRTALWCTGVSRPSSLTPSPATPSSILPDGAPGSRNKMSNRATHWCYACRRPIRLRGQDIACPNCNDGFIQEISEMGGILNTYGLIEPDFEERRARRFGMMDAMSSLMRQRMEEMGRDGLFDIRGRQGTGTEYGRRPTAVPTLVFGGIPSPGVDSGDVNVVLRGGRRVGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDH

SEQ ID NO: 2602 - protein, 71 aa, Physcomitrella patens subsp. patens
IKTKTHTDVMDDGYKWRKYGQKPVKSSPHPRNYYRCTTPNCPVRKRVERSTEDPDQVITTYEGRHTHQSPS

SEQ ID NO: 2603 - protein, 347 aa, Oryza sativa
  misc_feature (106)..(106): Xaa can be any naturally occurring amino acid
  misc_feature (127)..(127): Xaa can be any naturally occurring amino acid
  misc_feature (312)..(312): Xaa can be any naturally occurring amino acid
  misc_feature (321)..(321): Xaa can be any naturally occurring amino acid
MDSGLGRSSETSLKALPSMASNATRNTDPDQQGVRFSSTDQPPCFARPGQSFPAFPPLFGVQSSSLYLPDDIEAKIGNQFESNPSPNNPTMDWDPQAMLSNLSFLXICGKGFKRDANLRMHMRGHGXDEYKTAAALAKPSKDSSSESAPVTRYSCPYVGCKRNKEHKKFQPLKTILCVKNHYKRSHCDKSYTCSRCNTKKFSVIADLKTHEKHCGRDKWLCSCGTTFSRKDKLFGHVALFQGHTPALPMDDIKVTGASEQPQGSEAMNTMVGSAGYNFPGSSSDDIPNLDMKMADDPRYFSPLSFDPGFGGXLDDFTRTGXFDISENPFSFLPSGSCRFRGRERETG

SEQ ID NO: 2604 - protein, 876 aa, Oryza sativa Indica Group
MSSSASPAAWWARSRVRILLPVIFLAPALYFLLSPPSSPPFFFTLPTSREESPSASGSRVIWAQRRVAEWRSCGWWRAAMPAPSRRNGYIRIDCYGGLNQLRRDLCDGIAVARLLNATMVLPKFEVAAYWNESSGFADVFDVDYFIEQTRGYVEVVKDMPEEIASKEPFKVDCSKRKGHFDYVETVLPALLEHQYISLTPAMSQRRDRNHSYAKASYCQGCYNALRLNKNVETKAIELLQAIPKPFLSLHLRFEPDMVAYSRCVYTGLSSKSLSAIEAARGEDRKALTGEAALLWRNRGKCPLTPSETAFILKALGIPTDTNIYLAAGDGLMELEGFTSIYKNIYTKSSLLTHDDFEKMHGNTKAALDYYVSVSSDAYVATFFGNMDKMVTAMRTMQGHQKTLVLSRRAYANYTAVGLSGEQLAMAMWDAHREEYIMGRGSALPEQCFCEFKLIFRCANMDENFTAIESNADDKEETVLGEMGFHSQHGGWALWREAGSRTEMHLGPPSVSPAYCFDFSALHYSYRFCSVELGKKLDASMMTDYFNYSYSSYQCSSASSAIKGTRVDRLREASDTGHHRGRHKRARSSPRHDDEPPPPPPLSPAVTGAHGGAAWHSTVLAEDVESAVIVAALTHVISSTAAEVTTAVPPVTVAPQLAATATMFGQQVMQQPPRGFPPLPSSSGSAATAPEQQQPRRRYRGVRQRPWGKWAAEIRDPVKAARVWLGTFDTAEDAARAYDAAAVRFKGSKAKVNFPDEVAGASIAAVQLPRHHQHHPPTSLPPLPVPAHLRPHFSLAGGQSTTPAPAAAAVAAPPREEFPDLSSYAHILQSGDLEYDFHAAVSAGLTTTAGRSSSSSSLSMPPPSEDLDYKPPFGPSN

SEQ ID NO: 2605 - protein, 329 aa, Oryza sativa Japonica Group
MTITHASSLSRFHPLLKKLIMEYSNDWDLQALVRSCGTAVADSEPEPPAAPSTTRRAEAETVFVGRAGGVPEFVGQPVRSSAASFYDLEYLDLYHERPRAPFLVTAPSTSRERGEGGEHEVLISFPAIASTSGQGRKQPGRKPGVRTARPKRSKKSQLKKVVCEVPVADGGVSTDLWAWRKYGQKPIKGSPYPRGYYKCSSLKACMARKMVERSPEKPGVLVITYIAEHCHAVPTQLNSLAGTTRNNKPASPDQQQQQQPSPGGASTDEAAAAAAKTEDSADTTCSMADDENDLWAPVEMDMNDFFGPFDDDLDHFLDDDAVLGRRLSL

SEQ ID NO: 2606 - protein, 363 aa, Solanum demissum
MDEVMLPGFRFHPTDEELVGFYLRRKVQQKPISIELIKQLDIYKYDPWDLPKLAAVGEKEWYFYCPRDRKYRNSARPNRVTGAGFWKATGRAAKGIKTDWMMHEFRLPSITDSTAPKRFLDKHIPPNDSWAICRIFKKANSNAHRALSHSWVSPPQVLPQNNTTSHDFLTSSHFTNNSNEMSSFIHKTSSTSPIQFNDLLQNSSNNNMSSSFTTLDLPLYKTLNSMSNHNNDPITSYTFSSSCVDNMNNIDASSLLLNMSSSIFGDYSIVLPDNMEGGGVHDDTTTTTLKEANNVIINNMEHMEELQWGNVVRSNNIGVLPLMNNFPLNMAVDAWKTNLLWDSSSPCPSSEMSTSYSTNKCYT

SEQ ID NO: 2607 - protein, 105 aa, Physcomitrella patens subsp. patens
PHIIKGQWTPEEDRYLVELVERHGQQRWSLIATQLTGRIGKQCRERWHNHLRPDIKRDGWNTEEEEALVSAHNKLGNRWADIAKMIPGRTENAIKNHWNATMRRK

SEQ ID NO: 2608 - protein, 413 aa, Oryza sativa Indica Group
MSSETAASPPPPPPNPPAADSAHSSPASMTDETHGAGAHPDESQPHRSSSSSSSPPVAVDGETRVPLPVRSLPQPSHPSPPPSGEDEDDVVITGQIAVGDAAGAAMEERVKGPWSSDEDTLLSNLVEKLGPRNWTLIARGIPGRSGKSCRLRWCNQLDPQVKRKPFTEEEDRIIMAAHAIHGNKWAAIAKLLVGRTDNAIKNHWNSTLRRRHCTGGRCTQGGVMKRAIPERPRSVSEEPWPLGNLNSLNVREAMEAPAQTVSESYVGAWQIGDQSCKTEVVDPPYLARPVAKVGAFKPYNVGPAQSSQKEMLSFATKFDSNLHPFKPENGVCKFVDPTSFAAEVPNKCGHGCCSSHGQLRKNSLLGPEFNEFEDHPPISDSSFASLVSEISSIAWMKSGLQSSDTLARSVPPA

SEQ ID NO: 2609 - protein, 519 aa, Zea mays
  misc_feature (170)..(170): Xaa can be any naturally occurring amino acid
MEGRMTSLEATMKVSSLMASSMSRNADPDQQTLRPNSVEQFYFPRPGQSLPGIPPFFGPPSSSLYLPNDNEAKFGNQFESNPSQNTDWDPQAIVSNLTFLEQKIKQVKDIVQSMSNRENQVAGGSSELAAKQHLVTADLTSIIIQLISTAGSLLPSMKNPLLSSNPAVRXLANTLGSPMGLGMNANQRPSVDSKTDIPDTGKTSDYDELMNSLNPTQDERDEMIKCPNPCDGEGSELTPMEDHDVKESDDGGEGENLPPGSYVVLQLEKEEILAPHTHFCLICGKGFKRDANLRMHMRGHGDEYKTPAALAKPTKDSGADHAPVTRYSCPFVGCKRNKEHRKFQPLKTILCVKNHYKRSHCDKSYTCSRCNTKKFSVIADLKTHEKHCGRDKWLCSCGTTFSRKDKLFGHVALFQGHTPALPVEDGDVPEGSEQPQDGEPTNEMARSMVYSFPCSSSDGLLNLDMKMADDVRGYLSPLSFDNCFGAFDDFTRPGFDISENPFSFPPSGSCSYGQQNGDS

SEQ ID NO: 2610 - protein, 345 aa, Ostreococcus tauri
MFGECADASSGEGWDVFGCGASEYFCDPSVNYFDCDVDGFPGFGEDMEAFLGAKAREACSSESTDSEEMTLAIRAHPMYARLVEAYYECRKIGAHGDAAVALEREKDAMLYSVQVMSEEAYESSAMALDVASCDLDEFMRDCTHELETYVKELHSLYEDAKRCCKSLENRAHKVKTDVVHVDSSRRGEAAESKRHAPATEDELEAVSDDFDQILASEHQRRNHEERLRQDLKRKYASSITMLKTEFMRKRKKGKLPDTSTDILKKWWSDNIVWPYPSEDDKQVLIEMTKLDATQVNNWFINFRKRHWIRLFERGCTPKNEKEAATALAKAFNGSLEKAKDYARSL

SEQ ID NO: 2611 - protein, 155 aa, Oryza sativa Japonica Group
MGFPVGGYSGVPRLLLHLLFLLTHLRRLSSCLLRLAGADIDDSPTAVDAEYDGSYSYSSQSSQLLELDDHSPALRFDALSSSLQPPLHVATCAVCLRDFHKSAQVRRAHRCRHVFHRACLDAWAHHGHRTCPLCRSPLLPSSAPPVLLPLPLPAS

SEQ ID NO: 2612 - protein, 239 aa, Malus x domestica
MGRGRVQLKRIENKINRQVTFSKRRTGLLKKAHEISVLCDAQVALIVFSNKGKLFEYATDSCMEQILERYERYSYAERQLVEPDFESQGNWTFEYSRLKAKAEVLQRNHRHYLGEDLDSLTLKEIQNLEQQLDTALKQIRLRKNQLMNESISELQRKRKAIQEENNLLAKKIKEKEKAAAQPQVQNWEQQNHGLDLLPQPLPCLNNGGTQQDEFLQVRRNQLDLTLEPLYECHLGCFAA

SEQ ID NO: 2613 - protein, 198 aa, Methanocaldococcus jannaschii DSM 2661
MENVQRLDCPVCGGKGTFVITSHQIDIPYFGPVLETTMICEKCNFRRSDVFPLEVREPKKYILKIESERDLNKRVVRSSSAYIQIPELGVEIKPGPLAEGFVSNVEGVLNRVDNILQTLIRWAETEEQKKKAEELRERIKKLKEGKEEATLILIDPLGHSAIIGEGVEEEILSEEEVEKLKEGIVIMDLDKDKEKEKE

SEQ ID NO: 2614 - protein, 246 aa, Lotus japonicus
MGRGRVELKRIENVINRQVTFSKRRGGLLKKAHEISVLCDAEVALIVFSHKGKLFEYATDSCMEKILERHERYNYAERQLAGNADNSDEQVNWTIEYTRLKSKIDLLQRNHRHYVGEDLDTMSLKELQCLEQQLDTALKNIRTRRNQVMYDSISDLQKKEKVIKEQNNMLAKKIKEKEKEKAVAQEAPQLEQPNYRVDTSFLLHQEPLPTLNMGGNYHQQEAPELGRNDLDLTLEPFYSCHHLGCF

SEQ ID NO: 2615 - protein, 314 aa, Arabidopsis thaliana
MGVREKDPLAQLSLPPGFRFYPTDEELLVQYLCRKVAGYHFSLQVIGDIDLYKFDPWDLPSKQTCFTFVGEYNCNYLGKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 2616 - protein, 243 aa, Zea mays
ASGPSRDTLERPQPPPKQRKCLCSVAFVSISVVLPSLARLIKPGPYHCGLVCLFACRSKPPAAGKTTMTKSSSAGQKRARQPRFAFMTKSDVDHLEDGYRWRKYGQKAVKNSPFPSRSYYRCTNSKCTVKKRVERSSDDPSVVITTYEGQHCHHTAGARSPRANHAADGRHHLPFLQAAMSMPLASVPTTSLLPPPTTAPAASVSMTSSSSLPPATASSSAAPAAVDKGLLDDMVPPAMRHGG

SEQ ID NO: 2617 - protein, 411 aa, Chlamydomonas reinhardtii
QLEQYHQQQQQYEQYQQQQRQYELYQQQQQQQQQQQQQQYGQYGNAAATAAATEHPPREGGDHQPPPPPGYEPYSSAPYGDPNLYSIANAQDPSSQPPPLESRPTAAAAASAPPPPHAAAGFAAASNSLAAATASASGLGIAGNLSGGGATAGAAGPGGGRPGAMNWTSLQGRVAAGALAYGTSVAAPSRMINGRGLGFKASTTAAAVAAAPGHGGVGGGGGGGSGAGGSGGGAGGGAAAGAGVSGGGGAGAGAGAGAGAGVTSSAVTGSGAGGGAGGGGGGGSGPGSKKGRENLPKNAVTALKQWVYAHIVHPYPSEDEKEVLCAHTGLDLLQLNNWFINARVRIWKPLITQVFNSNHPRMAAEAQARGDGELLTKMQAARNSPTAQLALVAADASALQNLEQVGGWVGG

SEQ ID NO: 2618 - protein, 220 aa, Triticum aestivum
  misc_feature (21)..(21): Xaa can be any naturally occurring amino acid
  misc_feature (31)..(31): Xaa can be any naturally occurring amino acid
  misc_feature (209)..(209): Xaa can be any naturally occurring amino acid
  misc_feature (212)..(212): Xaa can be any naturally occurring amino acid
MQGVGDQGGGMEMSFGGGGGXGGECSSSSAXAVAVAAASAAEAEERQLLKGEMAVHPLCEQLVAAHVGCLRVATPIDHLPLIDAQLAQSSGLLHSYSAHHRPFLSPHDKQELDSFLAQYLMLLCSFREQLQQHVRVHAVEAVMACREIEQSLQDLTGATLEEGTGATMSEDEDEAPMLEVGLDMGSDGHDMMGFGPLMPNDSERSLMEXVRXELKMELKA

SEQ ID NO: 2619 - protein, 569 aa, Ashbya gossypii ATCC 10895
MTRRGRRRGRGRQALRQHHRYGSGGRGGVVEDIVNPALDAGALPHMLAEEDDAVSTMMMPFSPLLPHHLPLNSSTAGAGDHIVRRGTPVGVYGSATPELAGEHGSQLHSGLLSYNLRSSKLLTQKPSLVGRGPSKAGSSPPQLGGMPKKKLAAAKTKPAFVNKLWSMVNDPVNQSLIHWSHDGKSFIVTQREQFVHEILPKYFKHSNFASFVRQLNMYGWHKVQDVKSGSIQSNSDDRWEFANENFLRGREDLLANIIRQKSSAGSRDGAGMSVGAAHPNAVLVANGEEVDLGILFSELETVKYNQLAIAEDLKRISKDNELLWKENMLARERHQNQQQALEKIVKFLSSLYGSNTTRLLSDHVFREPQQAVAAPQGYGVHSTASMSPLHMADPLDAAPSPDVTATPVHRPRLLLKQRASPASDWPAQVQELRTSQVPSPVLQPLPARIHEIHPDAQLPADTPVLSPAVVDQASFFNDLQDNLDKQGESIQEIQDWIDKLSPASPFSRFDPRDYLAAPGFPAPPPDAADPISPRPAYKRPSNHREETRSEDYSPASKKQRQLSARDPPT

SEQ ID NO: 2620 - protein, 251 aa, Arabidopsis thaliana
MRRNIDYVSSTDYLPIKDNPHLTRVSFTQTITNRYSSIVPTNSLDAVQYDIELVKRAMDSKPNIWNPVFYPPNFLGKQCEILNPEPLNVIFPHQNSGDRQYLNMFSLSSKHNHDQNVFHEGRSSTKIPKPTMSIEKTTEYIDCEENEKSDDAQYDGRIHSLPYKKYGPYTCPKCNSIFDTSQKFAAHMSSHYKSETNKERAQRFRARNKRKYRKLNLEVYGESQKIKQEDGVHNDGRSDDKPIQHHKILFR

SEQ ID NO: 2621 - protein, 635 aa, Oryza sativa Japonica Group
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAVSSVPARAGVSIAHLPMFAAWTDA

SEQ ID NO: 2622 - protein, 140 aa, Physcomitrella patens subsp. patens
DPKPRLRWTPELHERFVDAVNQLGGADKATPKSVMRIMGVKDLTLYHLKSHLQKYRLGKQLHRDSSVHEANKDITEAIRLQMKVQRRLQEQLEVHKNLQLRIEAQGKYLQTILEKAKETLAGHTSASPDLKAAHAELTEL

SEQ ID NO: 2623 - protein, 274 aa, Triticum aestivum
MGRGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAAASRQQQQQQQQMQWEHQAQTQTHAHTQNQPQAQTSSSSSSFMMRDQQAHAPQQNICSYPPVTMGGEAAAAAAAPGQQAQLRIGGLPPWMLSHLNA

SEQ ID NO: 2624 - protein, 94 aa, Nicotiana plumbaginifolia
QWREGPLGPKTLCNACGVRYRSGRLFPEYRPAASPTFIPTLHSNSHRKVVEMRKKAIYGETSALEEPHNVIVEGPPMSPAPEFVPMSSYLFDVY

SEQ ID NO: 2625 - protein, 61 aa, Physcomitrella patens subsp. patens
KKRRYRGVRQRPWGKWAAEIRDPQKAARVWLGTFNTAEEAAMAYDKAAIRFRGLRAKLNFP

SEQ ID NO: 2626 - protein, 223 aa, Zea mays
MDGGFPALLDPTALSLALPVTQGPQGLNKLSKDDYLAICLAALAGTRGSGLVVKAAAGFGRKETGGINKQSWCPPQPAPAAHEEALRFRCAVCGKAFPSYQALGGHKSSHRKPPTAEQQAVVSAADSEDETTTSAGGGPHRCTICRRGFATGQALGGHKRCHYWDGASASVSLSASGTGSSGVTLRNFDLNLMPVAENAGMKRWVEEEEVQSPLPIKKRRILD

SEQ ID NO: 2627 - protein, 373 aa, Oryza sativa Indica Group
MEEEKRLERIIKEIDSSPISPGGSGAALLAEDDDLVFPGFRFHPTDQELVGFYLTRKVEKKPFSIDIIKEIDIYKHDPWDLPKVSHGAVALQGSSSSSSLSTAAAAEKECGYFFCLQGRKYRNSIRPNRVTGSGFWKATGIDKPIYSSSLAAAAAGAGDCIGLKKSLVYYRGSAGKGTKTDWMMHEFRLPSSISDSDHLQDASETWTICRIFKRSMTYTKGRAAAAASMNKRISHQLQHIHHHQQQFYYHEVVHDHGHHHRRHLQHYAGSASMAAAAANIVDVIDHSSDAETTTRSHSHSQSHLVADIRHRQSPFMLDFHAGTAVSSSSTAAAGWSEVMSFSRDGGSSSGSSWDELGRIMDISTNSANNNYYL

SEQ ID NO: 2628 - protein, 247 aa, Vitis vinifera
MGRGRVQLKRIENKISRQVTFSKRRSGLLKKAHEISVLCDAEVALIVFSTKGKLFEYSSDSSMERILERYERYSLSERQLLSTDPDPQGNWSMDYPKLTARIEVLQRNLRHFVGEDLDPLSLRELQNLEQQLDTALKRIRTRKNQLMHESISELQKKEKSLVEQNNALAKKVKEKEKVEQNNRAQWEQQNNIGQNSSAYVVPPPPLQLPSLTIGGSFVGRAVEEDGAEARPSPNTLMPPWMLRHVNE

SEQ ID NO: 2629 - protein, 1060 aa, Physcomitrella patens subsp. patens
MDSSEPLRAYAADTNHNLQADSYNSSLMASDSYNFLTGVGVLEVPLKEPSQSQAPKTSEGAAQNSSGPLIDTLYTNHEPSPTSGSFPSRSTPVSKSNNWENINGGGLYSNSNMQNILISGSGIMAAPTSTATAQLLIGGLHGGSFNDGGHSDHGSVYYTPSNNQEESMAQLYYVNAAAGFSNAGFHSDGRQAGLVTTLLYPPQEGGTTAPQSSSDQSQQQFGVPFISQTALAHGAVSQRALEASGAIPGLSLHDHSASRSGNHHYNWRNGGNEHSFLPMNEELNQNHQSQFDTDLPQYGITRACQADLSRMHQTDHLQSEIGLQMDRSHGVSVTGQGLSLSLSSHQSHFHSGGGQLPDSEQMNAVAAQAAAIAKTKELASRYLTGASADLSRFRTSSRDDVMGMGARFLQEHMDSGGRKHLASSSYSGPSGTAGSSNHISASKFLRSAQAILNEVCRVTPLKRPPKSVRSSDQQHWSMAGGSSTSVDANLTYNGREERSGMLAGEVDSARDPASFVTTSSLVTVSQVPLESEMIQGLAEAARCESRDDLELKKQKLSLMLDEVEARYRRYCDHLQLVITGFNSQAGPNTATPYTILALQAMSRHFRCLKDAIGSQLRIVKRTLGEDDRTGQGETSRLRYVDQQIRQQRALQQLGMLQQHAWRPQRGLPERAVSVLRAWLFEHFLHPYPKDVDKLSLAKQTGLTRSQVSNWFINARVRLWKPMVEEMYVEEQKEYSEDHSTALAQSERMARDQVEIENNTYEQYEGGRGHSGLLHEISAGAQSSRLPNGVKRNDDREHDAGASVSEAGAMSSDTNTEFHSQPLPRGHHLDVGVAGSYNPEGREVKKPKLNSVSDAFNSNSSTALIHPGMNVDTGENCAQPQNFSPEDELDLQGKGDTDFGAHSQSMNQINQDENGYTISQRGATTVDQLEANVASGTFGSYNSNIGHRYGNEDYASRTISAGLTTSTGVSLTLGLRHCDANQLGSSMVSPTLTKNPYNMDMNDQMNQLNRVDHFEGRIEGISSNGQSSATMSNGHYNQITVHENTNNSTQQLSPHHEFVTS

SEQ ID NO: 2630 - protein, 449 aa, Oryza sativa Indica Group
MLIHGEGSSSSAAAAGGKIKGSWSPEEDEQLRGPVARHGPRNWTAISEEVPGRSGKSCRLRWCNQLSPGVHRRPFTPDEDALIVAAHAKYGNKWATIARLLDGRTDNSVKNHWNSSLRRNRRAAAAAAAAAASVSRRTRRGLYILPRARVPIARPSPIDEMLIHGEGSSSSAAAAGGKIKGSWSPEEDEQLRGAVARHGPRNWTAISEEVPGRSGKSCRLRWCNQLSPGVHRRPFTPDEDALIVAAHAKFANKWPTIARLLDARTDNSVLRLGRRAGCIRVVPVHGSHRGADNDDEGTSDDSVAIPAQSSPAAVVAGVPVLPPPPPPAKRLCVAPPTGVEHRAPPPDPPTSLSLSPPGAAAAAISASTVVGGSSAARAEEEAVAREKARMEQDPWLMAMMRQMITEEVQRQVSVVYSLVASSAAVAAQTGNAGGVGRKGPDGRPSNGQD

SEQ ID NO: 2631 - protein, 216 aa, Thellungiella salsuginea
MNSFSAFAEMFGSEYESPVTVGGDYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTMTSDHGLDMEETTVEVIVTEEEQSEGFYMDEEAMFGMPRLLANMAEGMLLPPPSVQWGHNYDCDGDADVSLWSY

SEQ ID NO: 2632 - protein, 1315 aa, uncultured haloarchaeon
MVNHEYGRAIVLFIILCLIAGNWYVIGSGSASTTNQSSITLDRSLYYENDNIRVTLDDANLSTDIDHFVSIFSETEGQTVVTENVPAGVSSYTTKAPVGERINSTRISESDAEFDYTPDVGTEDDVINKTKYNDNNTVTFFFDKPANSEGEVQIFSLETVTLSHAGDTVFTGTIDISQTDALGTLNAGDGDTITVQYDDMSVQEQRTDNASFSAQNSPTATPTATPTATATPTATSTPTATATATITSTPVSTSTPTPTPTPTPSPTPSPTPTPTQTPTPTPLPTPSPTPTPSPTPTPTQTPTPTLTPTSTPTPSPTPSPTPTPTPPATATPTPTPTSSPTPAPTNTPPPTSAPTPTATPTPTPTPTPTPTATPTPTPSPTPTTTPTPTATATSTPTPPSVEPTTPVDTEDENENESDSDSSSGSSTDSSGGSNSNNKPGKQSTPKAPTPTPTPTPIPSERPTVGSTAGVTTAVTANGEGASTHLELPFTEPVMSAVDGESLAIGQSVDIYIDDQIENDAFSLLQDGSATGQLLLSTYRQFGPETEIRVEVDAVQGTQTGGTLPSTVQSVRVYNHTIKTTADRRVIDTPGFVALQVGDAHSDNNDGVIGQSLRILDADETVIETVQTGVGSQIAIVDMGDYKTGIYTIIAEDGAETTMMVYNLGLDIVVDRQTVTVGSALRGHVAATIETPRVMTVTLITENDTPIAETTATITANGTGIFSINTTAVSNADTEAYRLLVTDPQTNLQVASEPVRFISSTGVGFTQATYADARGDIMEIPLSIGTEHAATVMIGNSSSNIQANVTVQDRTGDGIVTLRFNTDAAIASALDKSERAVFTVKPVSADDQSSGDNHDIIHSTNPTATMTARMADNAVPLSEKHYPVSIKSEATETAFTNNTAMIRIDSPTIETLQVYTAPRGMAFSSVEQITNAIDNEQMTPTGSVASGDVIIYALTAEGFEGRTEQAEEQTIRTFDRTATKHANRYQTPSLSVTYPNATPSISNQLNNSWVMSNTSNHQYYIGATAGTGTNTASEQRVNDSVGTHFTATLQPGTRIDDARPSGSITTPGERLDNSESSSVGKAQKEPSGDWTVQTAVVPQQIVFDTNQTRVAPVSDQYITGTTTVAPGSIMTITLRANASKRQSGGTYPLDKTIRTTIGINRTWSGAFDFSTFDIGQSFVIHSVISQSDSVITQNRMRGYIEVSPADADTVVAKEKTGASGGGGGGGITGILTGLLDSGNERINPEAQPSDTVYNGNTTDAGSVVDGIITGSFIDTELGRVVDNTVKSSIQTRLMNPVAAGFILILSIVSLLLYRRR

SEQ ID NO: 2633 - protein, 383 aa, Oryza sativa Japonica Group
MGKGEVATRSKSQKSSATQNEQSTPTNPPTAYPDWSQFQAYYNPAGTAPMTPPGFFHPNVAPSPQGHPYMWGPQMMPPYGTPPPYAAMYAQGTPYQQAPMLPGSHPYNPYPGQSPNGTVQTPTSAGGTETDKSGKSKRKTPLKRSKGSLGNLDVVATKNKKAPAKPSASSSNEGSSHSESGSGSSSEGSSTNSKSGSRTKDGSEHGQGNDASNKGATAQSSAVEPVQASTGPVVLNPMMPYWPVPPPMAGPATGVNMGMDYWGTPTSVPMHNKVIAAPASAPSSNSRDVVLSDPAIQDERELKRQKRKQSNRESARRSRLRKQAEWEEVANRADLLKQENSSLKEELKQLQEKCNSLTSENTTLHEKLKELEGEKSNGNWYKE

SEQ ID NO: 2634 - protein, 252 aa, Glycine max
YECRMVVDPVLGFTRDPSLRSSICSCPDCGEIMKAESLEHHQAVKHAVSELGPEDTSKNIVEIIFHSSWLKKQSPVCKIDRILKVHNTQKTITKFEEYRDSIKAKATKLSKKHPRCIADGNELLRFHCTSFNCSLGLNGSSNLCNSIPQCNVCSIIKHGFKVTGGGAGILTTATSGKAHDKAACVDESEEKRAMLVCRVIAGRVKKNIAEGGGMEEYDSVAAAVGAYSNLDELVVSNPRAILPCFVVIYRGF

SEQ ID NO: 2635 - protein, 496 aa, Arabidopsis thaliana
MMDLQEETGEVKIEDQCVENKQSTPASCSSVSEGSAGSSHKSPTIASPATVSPTHRYLGRTSGPIRRAKGGWTPEEDETLRQAVDTFKGKSWKNIAKSFPDRTEVQCLHRWQKVLNPDLIKGPWTHEEDEKIVELVEKYGPAKWSIIAQSLPGRIGKQCRERWHNHLNPDINKDAWTTEEEVALMNAHRSHGNKWAEIAKVLPGRTDNAIKNHWNSSLKKKSEFYLLTGRLPPPTTTRNGVPDSVTKRSSSAQKRVFGSVAQTSSVTTDVNNLAEDGNGQINSSVPVEEVVAASRMTSLNEYARSPQLPNPEPLPENGGAANNGYHLYYTPQIDYYRASEVDTQRMYGNECGCSPSASPVSFFTPPPCRNVHSNGSTPRSPESYLREAGRTYPNTPSIFRKRRPRVVVQDNNNAKKTDEAKEVDQKVNDGKDSSEIQNNGSNAYNLSPPYRIRSKRTAVFKSRQLEFISREEEKADDETKSSEKDMLIDGDSQLLG

SEQ ID NO: 2636 - protein, 112 aa, Leycesteria formosa
TAQGPRDRRVRLSIEIARKFFDLQDMLGFDKASRTLDWLLNKSQTAIKDLVQSKLGCTSSSDARCSLSSIYEYESDKHKLDPENGEIASGVKEKKLRKPADKSSVIDLAARE

SEQ ID NO: 2637 - protein, 411 aa, Oryza sativa
MEEMLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSWGIVKRRMKGRTRLGRKKEKWTPITMHASSEMSCLTIVPKPESSSHEKH

SEQ ID NO: 2638 - protein, 112 aa, Lonicera reticulata
  misc_feature (93)..(93): Xaa can be any naturally occurring amino acid
TAQGPRDRRVRLSIEISRKFFDLQDMLGFDKASRTLDWLLNKSQTAIKDLVQSKLGCTSSSDARCSLSSIYECESDKLKLDPENGEIASEIKXKKLRKPTHKSSVIHVAARE

SEQ ID NO: 2639 - protein, 344 aa, Zea mays
MASSSPSCRGSGGKSDVDRIKGPWSPEEDEALQRLVARHGARNWSLISRSIPGRSGKSCRLRWCNQLSPQVEHRPFTAEEDDTILRAHARFGNKWATIARLLSGRTDNAIKNHWNSTLKRKYYAASDAVVADADDERPLKRTSSDGHPGLCFSPGSPSGSDLSDSSNHSLPSVMPSAASAAAVTSHQQQQHVYRPVPRAGGVVMLPVAPLVPPPPQPPATSLSLSLSLPGLDGQKPEPSPAVLTPAPAPPQPPLQIQQQQPAPPQMPPPQAQPSLPFQLQAAATNLTSQQPAAAPFSSEFLLLMQEMIRIEVRNYMSGSGLDPRTDGAPVHPVSKRMMGMAKIE

SEQ ID NO: 2640 - protein, 183 aa, Zea mays
VQLSSPLSAIREHVVQTRPSAPVNELQPVQIECLPEVSVSTAGTAAENIQQVQQSSKDIQSKSQGASTRSCTKVHKQGVALGRSVDLSKFTDYGELKAELDKMFEFEGELVSANRNWQIVYTDNEGDMMLVGDDPWEEFCNIVRKIYIYTKEEVQKMNSKSSVPRKEEPPAAGEGCAAAAANE

SEQ ID NO: 2641 - protein, 282 aa, Zea mays
  misc_feature (85)..(85): Xaa can be any naturally occurring amino acid
MARERREIKRIESAAARQVTFSKRRRGLFKKAQELSVLCDADPALIVFSSTGKLSQFASSSMNEIIDKYSTHSKNLGKAEQPSLXDLNLEHSKYANLNEQLAEASLRLRQMRGEELEGLSVEELQQLEKNLESGLHRVLQTKDQQFLEQISDLERKSTQLAEENRQLRNQVSHIPPAGKQAVADAENVIAEDGQSSESVMTALHSGSSQDNDDGCLVLHGSEKTRWSVLIWVELRLQQIGTCVIVLWTTPDYCNNLASEARSVNLILSSLWLHAMLRLRLGC

SEQ ID NO: 2642 - protein, 239 aa, Malus x domestica
MGRGRVQLKRIENKINRQVTFSKRSTGLLKKAHEISVLCDAQVALIVFSNKGKLLEYATDSCMEQILERYERYSYAERQLVEPDFESQGNWTFEYSRLKAKVEVLQRNHRHYLGEDLDSLTLKEIQSLEQQLDTAHKQIRLRKNQLMHESITELQRKEKAIQEQNNLLAKKIKEKEKAAAQPQVQNWEQQNHDLDLLPQPLPCLNIGGTQQDEFLQVRRNQLDLTLEPFYSCHLGCFAA

SEQ ID NO: 2643 - protein, 219 aa, Zea mays
MALDAALDVCSKTPSPSPPTVDSSARGGRRSKRRAGSPASDGGGGVDGNEQPEQEEYLAQCLLMLSHGLPGDGAAPPSAAAKAKAIQQQHQHGRYECSVCGKVYTSYQALGGHKTSHRKPPVVAPAPAPAPGGEADASLSGGTAHAAAEKEKTHRCSVCKRTFQSGQALGGHKRLHYEAKAKDADAVAATAVLQNLDLNLPAEGAPPEPKRARTMLLLA

SEQ ID NO: 2644 - protein, 237 aa, Saururus chinensis
MGRGRVQLKRIENKINRQVTFSKRRTGLLKKAHEISVLCDAEVALIVFSTKGKLYDYSTNAGMARILERYERYCYAEREVAVTSPDSEGSWWLEYGKLKARIEAQQRIQRQLMGEDLDALTPKELQQLENQLESALKHVKSRKNQVIYDSMVELRRKEKLLRDENTMMEKKIQEKKKERVQQAQWEQQIQSQNSPSFLPTLNIGYHQGTATETGEKEEAHPGHNTVMLAWLLRSSNN

SEQ ID NO: 2645 - protein, 250 aa, Arabidopsis thaliana
MANLSSDFQTFTMDDPIRQLAELSNTLHHFQTFPPPFSSSLDSLFFHNQFPDHFPGKSLENNFHQGIFFPSNIQNNEESSSQFDTKKRKSLMEAVSTSENSVSDQTLSTSSAQNSSRRGKRSKNREEEKEREVVHVRARRGQATDSHSIAERVRRGKINERLKCLQDIVPGCYKTMGMATMLDEIINYVQSLQNQVEFLSMKLTAASSYYDFNSETDAVESMQKAKAREAVEMGQGRDGSSVFHSSSWTL

SEQ ID NO: 2646 - protein, 301 aa, Asarum caudigerum
AGLSSPPRERKRVRENLIFSLAFKFARFQNFRFSFSFAGGFIFFEFSSLFFFGLQEMGRGRVQLKRIENKINRQVTFSKRRTGLLKKAHEISVLCDADVALIVFSAKGKLYEYATNSSMETILERYERYSFAERELVADPESEGGWCLEYGKLKARVDALQKSHKHIMGEDLDSLSIKELQHLEQQLDVALKHIRSRKNQVMLDTISELQRKEKMLLEQNKALQKTMREKENAMVRQAQWEQDNQPQASRPSFMLSRPLPTLHIGSNYHQTRNTETEKQGDRPHSRSNSGIPAWMLSHMND

SEQ ID NO: 2647 - protein, 329 aa, Arabidopsis thaliana; identical to SEQ ID NO: 209

SEQ ID NO: 2648 - protein, 137 aa, Oryza sativa Indica Group
MEPESSLHKVVVPLDLNYPRICSHCQTSKTSVWRNGPFGPKSLCNACGIRYHRKGIDALELEGKRSKDKKRKTSRNEVPLRRGLRKNNKNAKEVDFGVRMMMEGCQSEPMLTQSQQYEDDVKKAAIQLMYLSRAANT

SEQ ID NO: 2649 - protein, 771 aa, Oryza sativa Japonica Group
MQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 2650 - protein, 134 aa, Betula pendula
MEASRAEGKRSFMEEEEDQEEEEEEEEKREMSTSSSRRASGSGGSTPPTCQVENCNADLTDAKHYHRRHKVCESHAKAPIVYVAGGQKRFCQQCSRFHDLSEFDEYKKSCRKRLAGHNERRRKSSSDFHREGSN

SEQ ID NO: 2651 - protein, 330 aa, Picea sitchensis
MGRAPCCEKVGLKKGPWTPEEDQKLVAYIQEHGHGSWRALPQKAGLLRCGKSCRLRWANYLRPDIKRGKFSAQEEQTIIQLHALLGNRWSTIATHLPKRTDNEIKNYWNTHLKKRLLQMGIDPVTHKPKSESIMAVGRQSSNGSSNLSHMAQWESARLEAESRLARESKLRAKGLWSASMRNANVSSDIFSRLRSDSQGFDSDKEELKTRGLNSTGGFECMKITQKWDKSQDLRLGAKSDQCNSSALGGPFRGYKYNPLENGQSENRASKTSYVSLLQQAMCPSAQGSKILYNEAKKLVENQKNRQANAAATAYNVHQSHENCGESKYNL

SEQ ID NO: 2652 - protein, 272 aa, Arabidopsis thaliana
MAAIDMFNSNTDPFQEELMKALQPYTTNTDSSSPTYSNTVFGFNQTTSLGLNQLTPYQIHQIQNQLNQRRNIISPNLAPKPVPMKNMTAQKLYRGVRQRHWGKWVAEIRLPKNRTRLWLGTFDTAEEAAMAYDLAAYKLRGEFARLNFPQFRHEDGYYGGGSCFNPLHSSVDAKLQEICQSLRKTEDIDLPCSETELFPPKTEYQESEYGFLRSDENSFSDESHVESSSPESGITTFLDFSDSGFDEIGSFGLEKFPSVEIDWDAISKLSES

SEQ ID NO: 2653 - protein, 85 aa, Physcomitrella patens subsp. patens
MKKTAEKRIGVPRTKLYRGVRQRHWGKWVAEIRLPRNRTRLWLGTFETAEEAAMAYDAAAYKLRGEYARLNFPRQQCNSGIPGGG

SEQ ID NO: 2654 - protein, 660 aa, Vitis vinifera
MPRQKIQIKKIDNTAARQVTFSKRRRGLFKKALELSTLCDAEIELIVFSAAGKLFEYSSSSVNQVIERHSQHPQTPEKPEPPSLELQLENRTCAALSKEIAQQTQRLRQMRGEELQGLKIEELIELEKLLEAGLCSVVEEKAERIQTEISDLQRKGDLLRGENERLRKWMENISEAQPLLQQGHSSESITNNICSLSDPNQGHHNSDTSLKLGIRKEAMDFLSYVSEVTRGWDEPNSKELGRMKAPVNPKGGMYMLSEDMDIKAKVATIARRLEELELKKMHEVQAISETQAHAMPCTICQSCDHVVDECPTMPAVREMLGDQANVVGQFRLNNNAPYGNTYNSSWRNHPNFFWKPRPPPYQPQAQTQAPQQTSSVEQAIDNLSKVMNDFVGEQRAINSQLHQKIENVESSLNKRMDGMQNDLYQKIDNIQYSISRLTNLNTGDSSKLREVKAVITLRSGKEVDQPLPKVRQDEELLSKKTLVKESNNQEEEIPTYAKFLKDLCMVKRGLHVTKNAFLTEQEVCLINTLVEEHCDKSLEESLNESLEVFEEGLPEPSDVLAIMSPWRRREEILPLFNKEDSQGAAMEDPPKLVLKPLPVNLKYAYLEEDEKCPVVVSSNLTSDQEDSLLGVLRKCKKAIGWQISDLKRGLKHKKLKEVEG

SEQ ID NO: 2655 - protein, 225 aa, Zea mays
MDGGFPALLDPTALSLALPVTQGPQGHNKLSKDDYLAICLAAFAGTRGSSLVVKAAAGFGRQETGGINKQSWCPPQPAPAAHDEALRLRFRCAVCGKAFPSYQALGGHKSSHRKPPTAEQQAVVSAADSEDETTTSSGGGPHRCTICRRGFATGQALGGHKRCHYWDGASASVSLSASGTGSSGVTLRNFDLNLIPVAENAGMKRWVEEEEVQSPLPIKKRRILD

SEQ ID NO: 2656 - protein, 211 aa, Aloe vera
MISRAMQARNYNLGVRSQPMKLAAAAAPPQPKPTKLYRGVRQRHWGKWVAEIRLPKNRTRLWLGTFDTAEEAALAYDKAAYKLRGDYARLNFPHLKHTGAHLAPGGPLHSSVDAKLQAICQSLEQNKSSNSNSSKKEKRGDAVEEKSDKVVVVVAEGEESCSSSSMNTGSASSPSSEIESLDFTEVPWDESEDFVLRKYPSWEIDWDAILS

SEQ ID NO: 2657 - protein, 429 aa, Glycine max
TPFRQLAHSSHLTSSGAVGHMFSSSPGYSTDLHHSSFSSHEKQPRNTHFISQSLSNMASLPLSYSSNSEPIPSTTSTPYSNGNSVSWHTDSLPSFLDFPANTSIGNSQVESSACNIMATEEYSKRNDWQEWADQLISDVDPLTSNWNDLLADNIQDLEPKVTKSSSQLPIGHQSQSHQQLPASSGENRVGVAPTSSTNSAPAKPRMRWTPELHEAFVEAVNQLGGSERATPKGVLKLMKVEGLTIYHVKSHLQKYRTARYRPESSEGAAEKNLSRIEEMSSLDLKTGIEITEALRLQMEVQKRLHEQLEIQRNLQLRIEEQGRYLQMMFEKQCKPGIETFKASSSVIESQSGVSSDAIKDSPAKTESETIKVDHCKSGADLANGSTTVEESSLEVAEKQDAPEIQASDNPEQHASEDSGNASKRPRTEE

SEQ ID NO: 2658 - protein, 285 aa, Zea mays
MDSSGGRAFAQKSTLSLLPHTASGLLRTRASDLLQHLRSGGARGWRSRRGGAMVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSK

SEQ ID NO: 2659 - protein, 398 aa, Malus x domestica
MEDYNNQMDHESSGGRGNFLYASPNLGGNYGRAASDHQMGINTFHLQSSGGGGGGGSGDQCNFQSPGTHPINVKTEATTSQHGHPKFQYNNNNNNHHLVSSSRGHQPVVHQLQHNLDLQNDDHSLSSNEVEAIKAKIIAHPQYSNLVEAYMDCQRVGAPSDVVPRLSVARQEFEARQRSSGTSRETSKDPELDQFMEAYYDMLVKYREELTRPIQEAMDFMRRIETQLNMLGNNNNAPPLRIFSPSEDKCEGIGSSEDEQENSGGETEVPEIDPRAEDRELKNHLLRKYSGYLSSLKQELSKKKKKGKLPKEARQKLLSWWELHYKWPYPSESEKVALAESTGLDQKQINNWFINQRKRHWKPSEDMQFMVMDGLHPQNAALYMDGHYTGDVHYRLGP

SEQ ID NO: 2660 - protein, 397 aa, Malus x domestica
MEDYNNQMDHESSGGRGNFLYASPNLGGNYGRAASDHQMGINTFHLQSSGGGGGGGSGDQCNFQSPGTHPINVKTEATTSQHGHQKFQYNNNNNSHLVSSSRGHQPVIHQLQNNFDLLNDDHSLSSNEVEAIKAKIIAHPQYSNLLEAYMDCQRVGAPSDVVARLSVARQEFEARQRSSGTSRETSKDPELDQFMEAYYDMLVKYREELTRPIQEAMDFMRRIETQLNMLGNNNNAPPLRIFSPSEDKCEGIGSSEEEQENSGGETEVPEIDPRAEDRELKNHLLRKYSGYLSSLKQELSKKKKKGKLPKDARQKLLSWWELHYKWPYPSESEKVALAESTGLDQKQINNWFINQRKRHWKPSEDMQFMVMDGLHPQNAALYMDGHYIGDGHYRLGP

SEQ ID NO: 2661 - protein, 312 aa, Nicotiana benthamiana
MGEEVKITGGEAFAGDDNRILEWEDGLPSLDDITPLSQALIPPELASAFKISPEPAKTMTDVNRASENTFSSLRGSGPLQQLQILSSPETEHGSDPRKTRRIDPEMLEADSALPRNENCGGGDDSNNKSASKTLNKRPRLVWTPQLHKRFVDVVAHLGIKNAVPKTIMQLMNVEGLTRENVASHLQKYRLYLKRMQGLSNEGPTSSDHLFAFTPVPQSLQQSGGNGQNGNGHNSSGYNSNGHNSNGHAQMPMQMPMPMPMIYPPQMVPMPMMGISGHGHGHGFHHQYNMGAQQRDWSGNKFGSYHHVAPSDE

SEQ ID NO: 2662 - protein, 874 aa, Vitis vinifera
  misc_feature (158)..(158): Xaa can be any naturally occurring amino acid
MRNFRPESHVAQQSRRDKLRVQHQSSTPAHHLEEFPNSLEQLSVHPELNPDLIQVRNVRNGNVLYDPIVLSSEMLNFSSNSHVFLGSKDAMVGQDSNAVSQDASFPNLSHPISSKAAGDPQNCDNWKGLGTQQSCDWIVNYANGTVASESNQNPMYVXEVLSASSMKVNNISASSLDLKPNYSGYQDVQSSITNPSSEISSQDSQKHYGEIHFNSPQLYRNTLQEVVTSAAVGTQGLEMASFAHQNIRDTGRDSWEDGGNELVLLPNFGNQSSALRLDSSVAWMTRPVEGCHQWSGGDLGVLANKSLGDLSTIASDSNAQGLSLSLSSHPSSKIQVAQFGERYESKDLRSGTAAFSCPQDLKVMSSGYLCSDSKPPVSGKGYGNSLHDIVGTSTYTHRSAGPLGPFTGYATILKSSKFLKPAQQVLDEFCKAASPKLVKTCEVTRRTSGDVSVSVPDAVNTSDTEVGAAKGGNSAVSSSTFYDSNEISEGGVKSSSCESYRPDYQQKKAKLLFMQEEFAFQLALEFNGRFKRSQIRFPGIEFPGYVDFPRRYKQYHQQMQMVVSSFETVAGLSAATPYIALALKTVSRHFRFLKNAISDQLRHIRKALGEDLSSPSTGACTSAGDASSPRLKFMNQSFPKHKPGGANLGFLEPQQHVWRPQRGLPERAVAILRAWLFEHFLHPYPTDTDKHMLATQTGLSRNQVSNWFINARVRVWKPMVEEVHMLETKGLAERDQNSGKKDWKSIGEGVSQRDGNQPSNKPSVNAMSDEQLECRGMCPSAGTGDELGAEQWNQEKRSRVECQIPGSMDGSLMGFVPYQRSGVEIGGLGAVSLTLGLRHSVETAQQQQHQQQLQQQEDQLRRQFGGQMIHDFVG

SEQ ID NO: 2663 - protein, 184 aa, Arabidopsis thaliana
MQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 2664 - protein, 354 aa, Zea mays
MYHQQQLHTHNQHLSSSRPGLPPEKQFLLHGAGGGGGGGDAGLVLSTDAKPRLKWTPELHERFVEAVHQLGGPDKATPKTIMRLMGIPGLTLYHLKSHLQKYRLSKNLQAQAHTASAKNALVGCRTGADNALCQGSASPPPPPPPPHLNLEPPQINRSMHISEALQMQIEVQRRLHEQLEVQRHLQLRIEAQGKYLQSVLEKAQEALAQQSGGADETTTTTQQQQQLLLPDLILRATATRGGNVQQEHLPQQAPPWRRRICIPDMEKYTAEILSSVSGMYRTRSGCTRIHAAASALAHQSTRCPEHDSISTAFFSFLSFLRVAVNCYMLGRISSTGLFLTLVILYILISLTLTG

SEQ ID NO: 2665 - protein, 558 aa, Ustilago maydis 521
MSSTTQWENIYHGLDTTPGKLRMSQGGLGWKPSVGEGSTITIPADQMASFQWIRVARNYQLAIYLNKDRDAPSSAQTNPRRTNFDGFVRDDFDRLSSHIRQYFNKPLEAKEVSTRGWNWGQAKISNHDVQFLVRDKLAFELPLSHLANSNIAKTEVSMEFLNPEQQQPGANTGTSDVNGTKSRRSKGDQLVEMRLYVPGQAIKDDGSDAASAQDDDVNNEETAAEAFHEALKSKADIGQVAGDSIVVFKEVLVLTPRGRYDIDVFSTFIRLRGKTYDYKILYSSMNKLFLLPKADEIHVMLVIGLDPPIRQGQTRYPYLVLQFPREEEMDAELNLDEQTIQEKYDGKLKKRYEEPTFRIVTNIFKVLSGQKVATPTDFESSSGQTSIKCNVKAADGNLYPLEKSLLWVSKQPVYVPYSEIHQAILSRVGGAVASSKTFDLRVATKSGTEHTFQSISREELDRLKAWLADRKVRIKNEMAEETGGLAAAAAAGLLSDDDDEEMGAAGGADEDEDSEEDADFAADSDSDGGSPSEASSDEGEGGGYDDEGDERPKKKRKD

SEQ ID NO: 2666 - protein, 368 aa, Gerbera hybrid cv. 'Terra Regina'
MGRAPCCEKVGLKRGRWTAEEDDILTNYIKTHGEGSWRSLPKNAGLLRCGKSCRLRWINYLRSDIKRGNISKEDEDVITKLHASLGNRWSLIAAHLPGRTDNEIKNYWNSHLSRKIIPSRRLLNTPATPVPAKLSSHPLNKRKGRTSRSAMKINKTHKSSSRDIGANNREVDGAIDTTPLAPSIEKESNVYMEPCAASHEYSDDGQKRERHDNEAEVVDDVGMFCFNEIMDGGALTDPHGVLSLAEKETEKDLALMNVVTSEEERQNVSEPISIIGGEEVNKTGSCATSTSTDSCNVGDHDNILSGPWDWKWNFDVEEGMLGLGVEDEDNILSWPWESTTTTDSGNGDTDFVGEDLEKQNAMVAWLLS

SEQ ID NO: 2667 - protein, 271 aa, Triticum aestivum
MGRGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAAASRQQQQQQQQQMQWEHQTQTHTQNQPQAQTSSSSSSFMMRDQQAHAPQQNICYPPVTMGGEAAAAAAAAPGQQAQLRIGGLPPWMLSHLNA

SEQ ID NO: 2668 - protein, 266 aa, Gerbera hybrid cv. 'Terra Regina'
MGRTPCCSKVGLHRGAWAIEEDKLLTDYIQTHGEGQWRALPSNAGLLRCGKSCRLRWMNYLRPGIKRGTFTSDENDVIIRLQSLHGNRWSLIAAELPGRTDNEIKNHWNSHLRRKSAENADTHHGKVSKNNKKAKKKRKSDDRRAETTTPEKSKKVKLPDSSVSSSSSCVSLSKNDSSDNGIMSSTGASSSCTIDLEDADFDFSWSDWTPLLEVEGTTSINGEQDKGFLMDGCDLLMSKEDESLRLEKLYYEYLDLLDHEDGDGNN

SEQ ID NO: 2669 - protein, 143 aa, Triticum aestivum
MSPAEMESDKVVEAAADPEERGAGDPKACDDCNTTKTPLWRGGPNGPKSLCNACGIRYRKRRREEDTKAGDQKADDEKAAKKTKKTATTHTVELHMVGFAKDAVLKQQQRRRRQMRRRKPSCLGEEERAAILLMSLSSGVIYA

SEQ ID NO: 2670 - protein, 149 aa, Brassica napus
RLLAWEKKLYEEIKAREGVKIEHEKKLSQLQSQEYKGEDEAKLDKTKASITRLQSLIIVTSQAVTTTSTAIIRLRDTDLVPQLVELCHGFMYMWKAMHQYHETQNGIVEQVRGLINRSSKGESTSELHRQATRDLESAVSSWHSSFTHV

SEQ ID NO: 2671 - protein, 263 aa, Triticum aestivum
MDGAGAGGAYVARTAEEVFRDLRGRRAGMIKALTEDVDKFFKLCDPEKENLCLYGYPNETWEVTLPAEEVPPEIPEPALGINFARDGMNEKDWLALVAVHSDSWLLSVAFYFGARFGFDKENRRRLFNMINNLPTIYEVVTGIAKKQSKEKTPNSSSKSSKPSMKVLSRAEPRAKAKVPAPKDEEESGEDEGDDEEEEHDNTLCGTCGTNDGKDEFWICCDNCEKWYHGKCVKITPARAEHIKHYRCPECTNGGSNSNKRVKT

SEQ ID NO: 2672 - protein, 270 aa, Oryza sativa Indica Group
MAEATSKCQTRHTHTEQQQQQHQTARHNERSLAFQAIKRFDMVKTAASNGAAAARRVGGGGDGKRAAYKGVRMRSWGSWVSEIRAPSQKTRIWLGSYSTAEAAARAYDAALLCLKGSAAADLNFPVRLPFDLPAAAMSPKSIQRVAAAAAANANANASSSCSAAVFAGVDDSGGASASEASTPACSSSDGAASPSPVSSPETVISDVDVDYSLLADIEAFFQSPKCMEYAMMDPCSAFFAPPPPPAMAMEEECGWEEEGDIALWSFSSLD

SEQ ID NO: 2673 - protein, 189 aa, Glycine max
MDGMYGVPPEYADKALMTPENLIFPPDYHHAFLSAGRIPLFGSDELFSSADGIHRQQDEDDVATTTVMKAKIASHPQYSRLLQAYIDCQKVGAPPEIARLLEEIRRENDLCKSDVVSSSTCFGADPELDEFMETYCDMLVKYKSDLARPFEEATTFLNKIEMQLSHLCTGASVSNVSVYSYAMVKSLSD

SEQ ID NO: 2674 - protein, 241 aa, Pisum sativum
MDTTQWPQEIMVKPLATNTSEKKPRPEKQQAVNCPRCNSINTKFCYYNNYSLTQPRYFCKTCRRYWTQGGSIRNIPVGGGTRKNNKVIRSSSNLVSNPTKNLVPSILVTSSQNQKHHEQGQDLNLDFTSVSSHSFSALELLTGITASTTRGFHSFMPVQLQGDSNTSNIGFPLQDFKQVPMNFCLDGIGGNGYGNEGRVLFPFEDLKQDLDQNNNKGDQQGYTTGFWNGMLGGGGGGYNGN

SEQ ID NO: 2675 - protein, 819 aa, Oryza sativa Indica Group
MSTGGNGGGVRRRRWNLYWCYVCRRALRVVVPSATSDVYCPRCFGRFLHEIDLPVPRVSPPAEDQFFQPPFLPYDGPRRWVLYTGGGGGGDYGGADVTARRRRLPSPPPAPGTRRQDGAGDGDPPPPAPAIDPGEYFAGPDLNALIDALTQDDRPGPPPAPESAIESLPTVHISPDHLPADGGSECPVCKEEFELGEAARELPCKHAYHSDCIVPWLRLHNSCPVCRQEVPPPPEPDGESPGIDGGGDDGGGGGGEPAEPPRPAMAGWDPIALLAIALRPDLNGWENSHGRSESEADDDEVAGGGVIHALTKPALDERCRWNRFGFFLFDEKIGMLARDAVLRFAVRLFIVIVVSSRSSSADDGGGGGGVDFIYQGFQHAANLTMDGSAKVLHGGALQLTNDSNRLVGHAFHVAPVRFLDDGAGGGGGVVSSFSTAFVLDIVTVGSGGGHGLAFVVAPSITLPGASPEIYLGILGPHTNGNASDHVFAVEFDTVMDLEMNDTNGNHVGVDVNSLVSVVSEPVAYYAGDGSTKVPVQLESAQQIQAWIDYDGGSSILNVTVAPATVTGAASPAAHLHQARPPADLQGEHRFAILKGVAHGLLYLHEEWEHVVVHRDVKANNVLLGAGDTGAARLGDFGLARLYEHGATPATTRVAGTLGYMAPELTFTSRATTATDVFSFGALLLEVACGRRPIEPAAGEADGDVLLVRWVRDRALDGDGGGDVLRAVDPRLEGCYDEEEARLVLWLGLMCSQARPEARPSMRQVCRYLDGEEMLQEDATPAAIFSGADSSDLFGGSFVVSMTSSSAGGTMSASSLQGGR

SEQ ID NO: 2676 - protein, 535 aa, Oryza sativa Japonica Group
MIVGAGYFEDSHDQSLMAGSLIHDSNQAPASSENTSIDLQKFKVHPYSTEALSNTANLAEAARAINHLQHQLEIDLEQEVPPVETANWDPAICTIPDHIINHQFSEDPQNILVEQQIQQYDSALYPNGVYTPAPDLLNLMQCTMAPAFPATTSVFGDTTLNGTNYLDLNGELTGVAAVPDSGSGLMFASDSALQLGYHGTQSHLIKDICHSLPQNYGLFPSEDERDVIIGVGSGDLFQEIDDRQFDSVLECRRGKGEFGKGKGKANFATERERREQLNVKFRTLRMLFPNPTKFISMMFFTDNSAMLLRVVLVLSQIMPYQIVGILKSYLAKFGLPPKLVKFWHYQYIDMVTNQNTPNCVHPNQNDRASIVGDAIEYIDELNRTVKELKILVEQKRHGNNRRKVLKLDQEAAADGESSSMRPVRDDQDNQLHGAIRSSWVQRRSKECHVDVRIVDDEVNIKLTEKKKANSLLHAAKVLDEFQLELIHVVGGIIGDHHIFMFNTKVSEGSAVYACAVAKKLLQAVDVQHQALDIFN

SEQ ID NO: 2677 - protein, 216 aa, Picea sitchensis
MAKTRPAKKSLDSYTIKGTNKVVRAGDCVLMRPSDSDKPPYVARVEKIESDIRNNVKVKVRWYYRPEESIGGRRQFHGAKELFLSDHFDVQSADTIEGKCTVHSFKNYTKLESVGADDYFCRFEYKSATGGFTPDRVAVYCKCEMPYNPDDLMVQCEGCKDWFHPACMNMTPEQAKKVDHFFCPSCSSEDEDKKTRNSHVASPLAEAKLESKRRKR

SEQ ID NO: 2678 - protein, 652 aa, Coprinopsis cinerea okayama7#130
MTTQFDRIYYGLSPEVGKFRVAATGMGWKGSETNTVVTLEGSRIKWAQWLRVARNFQLRVGLSDHTRQKFDGFLREEHDKLASLLKNHFGITLETQEVSFRGWNWGVADFRGEELAFLVQDKTAFELPLNQVANSNIAGRTEVSLEFASIAGSSKGPGKQAGDEMVEIRFHVPGAVPKVKGSDAGSQDGEQDNEDEEEISAAQAFHETIKERANIGQITGNMILSFEEVLVLTPRGRYDMDMFRDFLRLRGKTYDYKIVFTSISRLFLLPKDDQHVLFILGLNQPIRQGQTRYQYLVMQFTREEEITAELNISDEDLAKYDKLKKNYEDPTYEVISSVFRALSGKKIIGAGSFQSRDGHPGIKANLKAIQGDLFMLEKYIFFVSKAPTLIEISDIHQVVFSRVGASMGAAAARTFDLKIITKSGPEYNFTSINKEEHEVTEAYLKDKKVRVKNEMLPDADLLLAAAGADDDDDDDMASVISSEDGRVRNRPSRGGDDEDSEEDEDFQVSDSDSGSPSDTDSDGSGAETASDASGDLQFTAPVKKKKVKGKDAAEGKKAGKKKGSGSEDEAPKKKAPAKKKAKNDDAMDVDEDKPKPKPKPKPKAKANDSDVEVMDVDEDKPKPKPKPKPKPKAKKPSEDDAEPPKKKLKTTD

SEQ ID NO: 2679 - protein, 402 aa, Arabidopsis thaliana
MYYHNQHQGKSILSSSRMPISSERHPFLRGNGTGDSGLILSTDAKPRLKWTPDLHERFVEAVNQLGGGDKATPKTIMKVMGIPGLTLYHLKSHLQKYRLSKNLNGQANSSLNKTSVMTMVEENPPEVDESHSESLSIGPQPSMNLPISDALQMQIEVQRRLHEQLEVQRHLQLRIEAQGKYLQSILEKAQETLGRQNLGAAGIEATKAQLSELVSKVSADYPDSSFLEPKELQNLHHQQMQKTYPPNSSLDSCLTSSEGTQKAPKMLDNRLGLRTYIGDSTSEQKEIMEEPFFHRMELTWAEEESLRENHNRPYLSTMVNNAEPRISSSRRSPGRLSIGVGLHEHRGRSSNNSEYTEERFNENNEDCKLETHTRTAIDLNTHDENYGTARPKQFDLNGFSWN

SEQ ID NO: 2680 - protein, 107 aa, Symphoricarpos orbiculatus
TAQGPRDRRVRLSIEIARKLFDLHDMLGFDKASGTLDWLLNKSQTAIKDLVQSKLSCTSSSDARCSLSSIYECESDKHKLDPENGIEGKKLRNPIDKCSVIDLAARE

SEQ ID NO: 2681 - protein, 104 aa, Myriophyllum aquaticum
FMRRIESELNTLGYGDATKCFYAGDDDCLGGDDSTEEDQQDGGGEALLSGTDLRKEDVELKNHLLKKYGGHLSGLKKEFSKSKKKGKLPKEAKQKLLTWWDLHY

SEQ ID NO: 2682 - protein, 112 aa, Triosteum himalayanum
TAQGARDRRVRLSIEIARKFFDLQDMLGFDKASRTLDWLLNKSRTAIKDLVQSKLGCTSSSDARCSLSSIYECESDKHKLDPENGEIASGIKEKKLRKPADKSSVIDLAARE

SEQ ID NO: 2683 - protein, 97 aa, Triosteum himalayanum
TAQGPRDRRVRLSMEIARKFFDLQDLLGFDKASKTLDWLLTHSKAAIKELVQMKINCTTDQGGGSEMICGNNYCNKNETSSVVGNEKRDAFDISSRE

SEQ ID NO: 2684 - protein, 316 aa, Zea mays
MAAAIDMYKYCNTSAHLIASSSPSDQELAKALEPFITSASSPYHRYSLAPDSYMPTPSSYTTSPLPTPTSSPFSQLPPLYSSPYAASTASGVAGPMGLNQLGPAQIQQIQAQLMFQHQQQRGLHAAFLGPRAQPMKQSGSPPAQSKLYRGVRQRHWGKWVAEIRLPKNRTRLWLGTFDTAEGAALAYDEAAFRLRGDTARLNFPSLRRGGGARLAGPLHASVDAKLTAICQSLAGSKNSSSSDESAASLPDSPKCSASTEGDEDSASAGSPPSPTQAPPVPEMAKLDFTEAPWDETEAFHLRKYPSWEIDWDSILS

SEQ ID NO: 2685 - protein, 295 aa, Zea mays
MCCAPKVANAEGRGPCLCCAGGEEDDEDGQQPAAAWRMLSGYERSREASMMVDALATVVAGGATPPATAAEHGAARIPATAASPSSSSQPPSPSSTGSGTPRRRYRGVRQRPWGKWAAEIRDPHKAARVWLGTFDTAEAAARAYDVAALRFRGSRAKLNFPESATLAAPPSAAAVPPPPSPPPQRPEALLESQALALAGGQEYSEYARFLQCPADPPRLYDQAPAATVPSAASGSASSSFPVLFRFGGGGESSGVASSQWWTQGSRSVSQEGAGSPPASWADSAWWPAPPRDPPR

SEQ ID NO: 2686 - protein, 245 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 2687 - protein, 399 aa, Brassica napus
QFTWPSSSDHHQSQGDMIGTVHVEGGKGLSLSLSSSLEAAAAAAKAEEYRSIYCAAVDGTSSSSNASVHHHQFNQLKTLLLDNSSSHQHQVMGHFGSSSSSPMAASSSIGGIYTLRNSKYTKPAQELLEEFCSVGRGHHFKKNKLSRDNSNPNTSGCGGGGGGGGSSSTAGAANDSPPLSPADRIEHQRRKVKLLSMLEEVDRRYNHYCEQMQMVVNSFDQVMGYGAAVPYTTLAQKAMSRHFRCLKDAVAVQLKRSCELLGDKESAGAASSGLTKGETPRLRLLEQSLRQQRAFHHMGMMEQEAWRPQRGLPERSVNILRAWLFEHFLNPYPSDADKHLLARQTGLSRNQVSNWFINARVRLWKPMVEEMYQQEAKEREEEELGENKKEDYQHQRRHR

SEQ ID NO: 2688 - protein, 247 aa, Brassica napus
  misc_feature (12)..(12): Xaa can be any naturally occurring amino acid
  misc_feature (238)..(238): Xaa can be any naturally occurring amino acid
MGAPKQKWTQEXESALKSGVVKHGPGKWRTILKDPEFSGVLYLRSNVDLKDKWRNMSVMANGWGSRDKSRLALKRTHSLPKQDDSSLANTSSLQSDEDMADAKHFSTTGTSALQLPATPTPRRPNVRLDSLIMEAISTMKELGGSNKTTIGAYIEEQYHAPPDFKRLLSTKLKYLTACGKLIKAKRRYRIPLSTPLSSHRRRHLGTPSGKQSVLSLPSPITDRDEVNVQTQAQIDAEXARMKTMNAH

SEQ ID NO: 2689 - protein, 200 aa, Sorghum bicolor
MGEEAMDDYELHMVCYGGDDDGRVMEWESGLPGADELTPLSQPLVPPGLAAAFRIPPEPGRTLLDVHRASAATVSRLRRAPSSSSSGSGGSGSSSFAPFHPHPQAAAAAGHARGDEDADSSAAALGGGNAATTTTNTGTNSKRPRLVWTPQLHKRFVDVVAHLGIKNAVPKTIMQLMNVEGLTRENVASHLQKYRLYVKR

SEQ ID NO: 2690 - protein, 215 aa, Capsicum annuum
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEALRPLKLEGISKESSSSTPESMFFMDEEALFCMPGLLTNMAEGLMLPPPQCAEIGDHVETADADTPLWSYSI

SEQ ID NO: 2691 - protein, 220 aa, Euphorbia esula
MTRQKIQIKKIDNITARQVTFSKRRRGLFKKAHELSTLCDAEIALIVFSATGKLFEYASSSVTRVIERYHLHPKNLSKMDQPSLELQLENGPLSALSNEVADKTQELRNMRGEELQGLGFEELQILEKLLEGGLKKVVETKGNALMNEIKELKSKGNQLMEENERLKHQITSSPLELLHFEKGHSPDSVTTNTSSLIDHSQDFGGSDLDTFLRLGLPFPN

SEQ ID NO: 2692 - protein, 85 aa, Setaria barbata
ECQKVGAPPEVSARLTAMAQELEARQRTALGGLGAATEPELDQFMEAYHEMLVKFREELTRPLQEAMEFMRRVESQLNSFSISGR

SEQ ID NO: 2693 - protein, 85 aa, Setaria palmifolia
ECQKVGAPPEVSARLTAMAQELEARQRTALSGLGAATEPELDQFMEAYHEMLVKFREELTRPLQEAMEFMRRVESQLNSLSISGR

SEQ ID NO: 2694 - protein, 290 aa, Physcomitrella patens subsp. patens
RTADVVQVLRRLAQNREAARKSRLRKKAYVQQLESSRIKLNQLEQELQRTRQQQGLYLGPGSYSDQNGQSAGAAAFDLEYARWVEDHTRQMSELRVALQAHVADADLRLLVDGSMAHYDDLFRLKDAAAKADVFHLVSGMWKTPAERCFVWIGGCRPSELLKILVPQIEPLTEQQLLNICNLQQSSQQGEEALSQGMEQLQQSLAETLSAGSLGSAANVANYMGQMAVAMGQLGNLEGFVRQADHLRQQTLQQMHRVLTIRQVARGLLAMGDYFARLRALSSLWSARPRE

SEQ ID NO: 2695 - protein, 339 aa, Cymbidium hybrid cultivar
MSTSSVHLPPGFRFHPTDEELILHYLRNRAASSPCPASIIAEVDIYKFDPWDLPEKAAFGDREWYFFTPRDRKYPNGNRPNRAAGSGYWKATGTDKPISSGSENIGVKKALVFYKGRPPKGLKTNWIMHEFRLADANKSNSYKPIRLRDHSMRLDDWVLCRIYRKSNHLSPTEMDQEQEDPCGEETCFPAMQNQMMPMNHGMKLQKVSSISEFLQEYSPLLNLFDNQQEIPRFDSNSLLGHPLLSQSMINQNQDSGGNGYFLPQLSQAESPVSIGAKRQRMDDCTNEESNGTSHSSKKQNDLNMFPNFSSQFDGSQYGLLSQPFFSQQLLMNSNTGSLH

SEQ ID NO: 2696 - protein, 381 aa, Triticum aestivum
MGKGDVATRSKSQKSSTSQNEQSTPTNPPTAYPDWSQFQAYYNVPGTAQMTPPAYFHSTVAPSPQGHPYMWGPQMMPPYGTPPPYATMYAQGTPYQQAPMPPGSHPYSPYPVQAPNGTVQTPTPGAGGSETDKSNKNKRKTPLKRSKGSLGSLDVVTVKDKTPPAKPLVSSSNEGSSQSESGSGSYSGGSSTNSKSGSHTKDGSEHGPANDASNKGVTAQGTAVEPTQVSSGPVVLNPMMPYWPVPPPMPGQATGVSMGVDYWGAPTSVPMHGKAVAAPTSAPSSNSRDIVLSDPVIQDEREVKKQKRKQSNRESARRSRLRKQAEWEEVASRADLLKQENSSLKEELKQLQEKCDNLTSENTSLHEKLKALDSEKPNGNL

SEQ ID NO: 2697 - protein, 163 aa, Arabidopsis thaliana
MEKLVHKEIEKRRRQEMASLYASLRSLLPLEFIQGKRSTSDQVKGAVNYIDYLQRNIKDINSKRDDLVLLSGRSFRSSNEQEWNEISNHVVIRPCLVGIEIVLSILQTPFSSVLQVLREHGLYVLGYICSSVNDRLIHTLQAEVNDLALIDLADLKDTLTLMK

SEQ ID NO: 2698 - protein, 509 aa, Glycine max
MDPKGSLCATRSSSLTSPGNGLQTNLSSDPPSFYGVRIESPFKEFIQPSPPTQSVLPGESNADIDIPDQENCPLSNSSHTSKLQDWNPSAMLNNLSFLEEKIHQLQDLVHVIVNKKCQPFGQPHELVTQEQQLITADLTSIIVQLISTAGSLLPSVRHTLTNANPLVGQLDQLHGINLPFESEPSSGIRPQNNSGNKLFDQSIQNDLPNKLEMEQNYNMEEHEPKDEEDVDEGENLPPGSYEILQLEKEEILAPHTHFCTICGKGFKRDANLRMHMRGHGDKYKTPAALAKPHKETGSEPKLIKRYSCPYAGCKRNKDHKKFQPLKTILCVKNHYKRTHCDKSYTCSRCNTKKFSVMADLKTHEKHCGKDKWLCSCGTTFSRKDKLFGHIALFQGHTPAIPLDETKGMAEPPDIQNRESNNKVESINFCFGSNSSSENVVQNMMDMKGNNDDPMNYFSSLNFEGCNFGAFNEFSQPPFEDSDGCFSFPMSGSFNYAPKFGGGESSSDNL

SEQ ID NO: 2699 - protein, 239 aa, Malus x domestica
MGRGRVQLKRIENKINRQVTFSKRRTGLLKKAHEISVLCDAQVALIVFSNKGKLFEYATDSCMEQILERYERYSYAERQLVEPDFESQGNWTFEYSRLKAKAEVLQRNHRHYLGEDLDSLTLKEIQSLEQQLDTAHKQIRLRKNQLMHESITELQRKEKAIQEQNNLLATKMKEKEKAAAQPQVQNWEQQNHDLDLLPQPLPCLNIGGTQQDEFLQVRRNQLDLTLEPFYSCHLGCFAA

SEQ ID NO: 2700 - protein, 123 aa, Chlamydomonas reinhardtii
MNQLDLYADGAHGDDDVTKGPWTPEEDAILRQLVMTQGPRNWTSIASCIPGRSGKSCRRPAKLRWLNQLSPAVKSGPFSAEEDAVILWAHMQYGNKWASIAKHLPGRTDNHIKNRWNCTLKKK

SEQ ID NO: 2701 - protein, 117 aa, Viburnum lentago
TAQGPRDRRVRLSIQIARKFFDLQEMLGFDKPSKTLDWLLTNSKAAIKDLVEMKLSCTGTVAKSLSSTSECEVLSGSNEATDNGDEHRKLPLMSVYKEKIGLLRRQRKAPFHLLSRE

SEQ ID NO: 2702 - protein, 426 aa, Arabidopsis thaliana
  misc_feature (70)..(70): Xaa can be any naturally occurring amino acid
  misc_feature (312)..(312): Xaa can be any naturally occurring amino acid
  misc_feature (359)..(359): Xaa can be any naturally occurring amino acid
MNTTQILNPTRPIWPSFSSSKSLSGDANCMEQLLLHCANAIESNDATLAQQIIWVLNNLASPDGDSTQLXRLAASFLRALISRTASKSPAFAFLSLAATASISQKTLHRFSVIELAEFVDLTPWHRFGFIAANAAILDAVEGYSSVHIVDLSLTHCMQIPTLIDSMANKLHKKPPPLLKLTVIASDAEFHPPPLLGISYEELGSKLVNFATTRNVAMEFRIISSSYSDGLSSLIEQLRIDPFVFNEALVVNCHMMLHYIPDEILTSNLRSVFLKELRDLNPTIVTLIDEDSDFTSTNFISRFIFFRFYFKIXYDTAEMFLTRGSEQRQWYEADISWKIDNVVAKEGAERVERLEPKSRXLERMREAKFTGVGFGETAMTEVKTMLEEHATGWGMKKDVDDDNDVERFVLTWKGHSVMFASAWAPPN

SEQ ID NO: 2703 - protein, 117 aa, Viburnum prunifolium
TAQGPRDRRVRLSIQIARKFFDLQEMLGFDKPSKTLDWLLTNSKAAIKDLVEMKLSCTGTVAKSLSSTSECEVLSGSNEATDIGDTQRKPPLMSVYKEKIGLLRRQRKAPFHLLSKE

SEQ ID NO: 2704 - protein, 264 aa, Glycine max
MESYYYSGWPLAQFNSAPNSDQLSPFSVPTTTQQTLPLVATSTSDRAAAASLQFGEFPSWPAPIAAEDRAASASKSHSQAEKRRRDRINAQLATLRKLIPMSDKMDKATLLGSVVDHVKDLKRKAMDVSKAITVPTETDEVTIDYHQAQDESYTKKVNILKENIIIKASVCCDDRPELFPELIQVLKGLRLTAVKADIASVGGRIKSILVLCSKDSEENNSVCLSTLKQSLKSAVNKIASLSVATNCPTRSKRQRFFLPSHYVQ

SEQ ID NO: 2705 - protein, 79 aa, Pisum sativum
DPNAPPKTPKASGSGRPRGRPKKIARTEDVDASTPSPVSVAAVNVDVVVPCVAAVPTSSGRPRGRPPKVKPQLTQVSVS

SEQ ID NO: 2706 - protein, 117 aa, Viburnum rufidulum
TAQGPRDRRVRLSIQIARKFFDLQEMLGFDKPSKTLDWLLTNSKAAIKDLVEMKLSCTGTVAKSFSSTSECEVLSGSNEATDIGDTQRKPPLMSVYKEKIGLLRRQREAPFHLLSKE

SEQ ID NO: 2707 - protein, 529 aa, Neurospora crassa
MAMSTVAAALGKLLFVAVVTLVISVANALSSVPELSDWEQDQYLTLQLTVPLGSGDAKPIRHRVVPLTEAVGMNQSVIARESITIKGTMVPTEESGWLEFIDSNSIAYLNCDNSNSTSFFDQLMSKAPKAILLFSLAGAGCRRDSTDDWNYTTLFTMTDQIDARDTLNLTMSGSLATITGDYEEPDDDDDEDRTGHGSPIAMNILYSITGVITLLFLAIIATGAIRAHRYPERYGPRPGYGGRPSQSRAKGLARAVLETLPIVKFGEKSPAKPDPDFQLEQQPSRSSQDPTPRAKLSAIQEAVPSIAKSQGPMTVASVEASEQASSATVYGAQTGMTNTAGDIENTTPDDINLGCPICTEDFTIGEDVRVLPCNHRYHPACVDPWLVNISGTCPLCRLDLRPHSSTESTTGPGDNHSVSLPTAAGDNAQQPGTSGSPMPSTTPRERRRSLRILDLHRLRAASIEERMEILRRHRSQQQQRRHVTGSSLTGDPDTGESADPTHRARLAERFRGRFRASRPPGRRSHNQQR

SEQ ID NO: 2708 - protein, 112 aa, Brassica napus
KQEAEGVEVEIVQDDDESVTEVSSLYSEDRIESQISERDETRSNPPQLLESCEEEEESGSKGDLTKVIVLIVISLAGLCSGKVLAIALTLSWCLILRFVCCKSRTSLSTHQK

SEQ ID NO: 2709 - protein, 336 aa, Oryza sativa Japonica Group
MESFASLAGGGSSSTTARLPELISPENPDHISPPPLLYQLLAGPESSARQHGHDGHHHGGGGGEAAAAAVQGQVSPAGAEAAVKAEIMSHPQYSALLAAYLGCKKVGAPPDVLTKLTAVPAAQQLDEADGHPRRRHEPQRDDDPDQLDQFMDAYCSMLTRYREELERPILEAAEFFSRVETQLDSLAGTGSSEEEQDPSDKQLKHQLLRKYGGSLGDLRQVFSKRTKKGKLPKEARQKLLHWWELHYKWPYPSEMEKMTLAQTTGLDQKQINNWFINQRKRHWKPTPVAGTAFPTMEAAGGGFRHSGHGGGLAAAAALPLYMGRPFVVDGMYRLGS

SEQ ID NO: 2710 - protein, 170 aa, Physcomitrella patens subsp. patens
TGAGLTPGVPGGGFPVLPSLLPGPSSSPYSSPDRRGRGRPLGSGKKQQLAALAGSGQGFTPHILTVNTGEDVATKIMQFAQHGPRATCVLSANGAISNVTFRQQSSSGGTVTYEGRFEILSLSGSYLPTDLGGGARQRTGGLSVSLAGIDGSVIGGGVAGMLTAASPIQV

SEQ ID NO: 2711 - protein, 144 aa, Oryza sativa Indica Group
MAMSQPALKGKDDGEAKQAPASGCLYVKVSMDGAPYLRKVDLKMYKNYKELSLALEKMFSCFTVGHGESNGKSGRDGLSDCRLMDLKNGTELVLTYEDKDEDWMLVGDVPWRMFTDSCRRLRIMKGSDAVGLAPRATDKSKNRT

SEQ ID NO: 2712 - protein, 255 aa, Arabidopsis thaliana
MGRGRVELKRIENKINRQVTFSKRRTGLLKKAQEISVLCDAEVSLIVFSHKGKLFEYSSESCMEKVLERYERYSYAERQLIAPDSHVNAQTNWSMEYSRLKAKIELLERNQRHYLGEELEPMSLKDLQNLEQQLETALKHIRSRKNQLMNESLNHLQRKEKEIQEENSMLTKQIKERENILKTKQTQCEQLNRSVDDVPQPQPFQHPHLYMIAHQTSPFLNMGGLYQGEDQTAMRRNNLDLTLEPIYNYLGCYAA

SEQ ID NO: 2713 - protein, 443 aa, Solanum peruvianum
RMSVDVGAPSPRSIQMDEQVNPGEEYAPKIRKPYTISKQRERWSEEEHKKFLEALKLHGRAWRRIEEHVATKTAVQIRSHAQKFFSKVVRDSSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSRNVVEESVRVRASVPSLFERRANSTKRVKGFVPYKRCLAERGMSSSTLTGEEREEQRTRLCL

SEQ ID NO: 2714 - protein, 183 aa, Physcomitrella patens subsp. patens
DRPSEDGYNWRKYGQKQVKGSEYPRSYYKCTQTNCPMKKKVERSHDGQVTEIVYKGDHNHPKPQPTRRMALSGAHSLSDGLSRDGDGNDSRPDSWDATAAPRTIREPRVVVQTTSDVDILDDGYRWRKYGQKVVKGNPHPRSYYKCTNVGCPVRKHVERASTDIKAVITTYEGKHNHDVPAAR

SEQ ID NO: 2715 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 2716 - protein, 369 aa, Populus trichocarpa
MEPNDSHQQQQHFTSYFSTTTTTTTTTTPSPTNGLLPPHQPTDSTTPTGPHMLYPHSMGPSTTATVTGGGGAPVEAAAAAAAAKRKRGRPRKYGTPEQALAAKKTASSNSAAAYREKKEHQAGSSSTISSFSAYSSKKSQHASLGNAGHGFTPHVITVAEGEDVTQKIMHFLQQSMREMCILSASGSILSASLSQPATSGGNISYEGRYEIISLCGSYVRTEMGGRAGGLSVCLSDTNGQIIGGGVGGPLKAAGPVQVIVGTFMLDNKKGGSGKGDASGSKLPSPVGASVPSFGFRSPVESSLMNPARANDDHPTIGGNPFTMQPTSMHLTPTRPIDWMSGPDVRTSGYDFTGRTGHGGPQSPENGDYE

SEQ ID NO: 2717 - protein, 433 aa, Vicia faba
MGSRIRVSFEDEKGAETGMPSFNSDDACYTEGNTVDAFHVSDFGAFGQPYRIEDAVALSGNSNSVFNSLKVSGQTISPGPAHISTLGKFPTSLDKSPLENQTEPHRLQLTKLQSSNLSSSSILSVHIENQEEFTMADASPRTDISTDVDTDDKNQRFDTNQSLVPVGSDSSDRSKDKSDQKTLRRLAQNREAARKSRLRKKAYVQQLESSRLKLTQLEQELQRARQQGVFISSSGEQTHSLSGNGAMQFDAEYARWLEEQNRQINELRAAVNSHASDTELRMIVDGILAHYDEIFRLKGVAAKADVFHLLSGMWKTPAERCFLWLGGFRSSELLKLLVSQLEPLTEQQLMGITNLQQSSQQAEDALSQGMEALQQSLAETLSTGAPSSSGSSGNVANYMGQMAMAMGKLGHSRASFDRLTICASRLYNKCTEY

SEQ ID NO: 2718 - protein, 242 aa, Nicotiana tabacum
MGRGKVQLRRIENKINRQVTFSKRRGGLAKKAHEISVLCDAEVALIVFSHKGKIFEYSSDSCMEQILERYERYSYAERRLLSSNSESSVQENWSLEYAKLKAKIDLLQRNHKHYMGEDLDSLNLKDLQNLEQQLDTSLKLIRSRKNQLMHESISMLQKKEKAIQEENNMLSKKIKEKDKTVGKQAEWHQQNQVPNSASFLLQPHPCLNIGGNYQEEAEEARRNELDLNLDSLYPCHMGCFAT

SEQ ID NO: 2719 - protein, 115 aa, Weigela hortensis
TAQGPRDRRVRLSIEIARKFFDLQDMLGFDKASRTLDWLLNKSKTAIKDLVQSKLGCTSGGNATSTALTSIYECEEMKSKTYKLVPNNGEIACGIKEKKTRKQTDKSAIDLVARE

SEQ ID NO: 2720 - protein, 90 aa, Weigela hortensis
TAHGPRDRRVRLSMEIARKFFDLQDLLGFDKASKTLDWLLTNSKAAIIELVQMKISCTTGSQCDMVCENYNGLPVGNEKIRDAFDISSRE

SEQ ID NO: 2721 - protein, 242 aa, Nicotiana sylvestris
MGRGKVQLRRIENKINRQVTFSKRRGGLVKKALEISVLCDAEVALIVFSHKGKIFEYSSDSCMEQILERYERYSYTERRLLASNSESSVQENWSLEYAKLKAKIDLQQRNHKHYMGEDLDSLSLKDLQNLEQQLDTSLKLIRSRKNQLMHESISMLQKKEKAIQEENNMLSKKIKEKDNTVGQQVEWHQQNQVPTSASFLLQPHPCLNIGGNYQEEREERRRNELDLNLDSLYPCHMGCFAT

SEQ ID NO: 2722 - protein, 350 aa, Vitis vinifera
MSNSGRFFGQAPKFPFVGDITRQEGTDTRVPLLNLATVQIRVDSLERFLSDSISRSVVIGPDQMEMVSTEIVSAIHQIIVNGAALLSCSQPEYSSFPAAGAARVEDDVKEEIDGGNDDGDCEVIELDAVELLAEHIHFCDICGKGFKRDANLRMHMRAHGNQFKTPEALAKPDKCMETQRRVRFSCPYQGCNRNKGHKKFRALKSVICVKNHFKRSHCPKMYSCNRCNKKSFSVLADLRSHLKHCGESKWRCSCGTSFSRKDKLFGHMALFEGHMPAVENGDEKSVLSAAAVAAATMEEDEHEDEDGIGKEEENGMFEGLFQGFGSIGEYCLQDVLRSPPRLYDISDFLD

SEQ ID NO: 2723 - protein, 94 aa, Abelia x grandiflora
TAQGLRDRRMRLSLQIARKFFDLQDMLGFDKASKTIEWLFTKSKKSIKEVTLKHPQMKNNFRNREEKNESITSECEVESPIANVYGEKGKAQKE

SEQ ID NO: 2724 - protein, 199 aa, Oryza sativa
MRRGGAAEEDAEAARFRGVRKRPWGRYAAEIRDPAKKARVWLGTYDSAEDAARAYDAAARALRGAKAKTNFPLSLPHAQPQLHHHHHHHLTYPAAAVVAARPATSSLSSTGESFGTRPRPVLPPRPPPPPPIPDGDCRSDCGSSASVVDDECADAAASPSCRLPFQFDLNLPPGGGGGGGGGFGCAYDDEELRLTALRL

SEQ ID NO: 2725 - protein, 94 aa, Abelia x grandiflora
TAQGLRDRRMRLSLQIARKFFDLQDMLGFDKASKTIEWLFTKSKKAIKEVTLKHPQMKNNFRNREEKNESITSECEVESPIANVYGEKGKAQKE

SEQ ID NO: 2726 - protein, 223 aa, Oryza sativa Japonica Group
MEVEAATRRFHLWLRGLRGLRRELRAARWADDPAQLGSLVGRFVAHVECYTAARAEMDPVWTLSAPWASPVERGAAYWLAGWRPTTLVHLLYTESGRRFEAQLPDLLLGVSSGNLGDLSPSQLAQIDDLQRRTVAEEDGLSREMALVQEGHGAVAVGGGIDVDGIVGRVRGVLGRADALRLRTVKRAVEILEPAQAAELLVAAADMEIGFREFGLKYSSARSD

SEQ ID NO: 2727 - protein, 102 aa, Centranthus ruber
TAQGLRDRRMRLSVQIARKFFDLQDMLGFDKASKTIDWLFTKSKKAIKEVTLKHSQMKNSFRYRDEGITSARDVESMMENVYVETEKCEKIVYDPVAREMRD

SEQ ID NO: 2728 - protein, 85 aa, Zuloagaea bulbosa
ECQKVGAPPEVSARLTAMTQELEARQRTALSGLGAATEPELDQFMEAYHEMLVKFREELTRPLQEAMEFMRRVESQLNSLSISGR

SEQ ID NO: 2729 - protein, 111 aa, Triticum aestivum
  misc_feature (18)..(18): Xaa can be any naturally occurring amino acid
  misc_feature (22)..(22): Xaa can be any naturally occurring amino acid
  misc_feature (31)..(31): Xaa can be any naturally occurring amino acid
  misc_feature (41)..(41): Xaa can be any naturally occurring amino acid
  misc_feature (47)..(47): Xaa can be any naturally occurring amino acid
  misc_feature (66)..(66): Xaa can be any naturally occurring amino acid
QVHKQGVALGRSVDLSKXTDYXELQAELDKXFEFEGELVSXSQNWQXVYTDDEGDMMLVGDDPWEXFCSIVRKNYIYTKEEVQKMNSKSAAPRKEDLRQQAAEEVAPPPQR

SEQ ID NO: 2730 - protein, 364 aa, Arabidopsis thaliana
MSAVSESAAISSLFLISFAIQSSSSSSSSVLFFGLSLTAVLNALRFCSEQRLILEVPSISMGLRLKRTCSGVEVFGDMKSFVKPERDSLLRTVRIVFTDPDATDDSSSSSDEWLPKPRKVKRFVHEITFLPQVSESSQDRSNAVKTPRRKSTRQFKYPVGVRPRPSGKFAAEILNPFTKTKKWLGTYETPAEAEKAYVDKKVEYDALASSGSAVSSSVVTVTSQCLRSPTSASVSCVSADDLSKEKTSLNKDVAASGDSTTKEVFTTFDFSDVKIPDLRFLAAEEDSMVSNANGAELDFDCFLTDSNILLDDYSLLENDINFSRFENSLPSELPDCDFTEMEFQLDDFKFAYTDHLTTPPLGLV

SEQ ID NO: 2731 - protein, 321 aa, Oryza sativa Indica Group
MDRQWRCLAAAASTSGNSKLPPLPMALGGAVEYGQLVHGAAAPVAPFFVDAEQQSLSPATAMVLGAGWYNYNLVTPSQAAQLHHRLRRAVGAAPCSMKRCGGMAAAAAGRLALVGPTPVQAKLYRGVRQRHWGKWVAEIRLPRNRTRLWLGTYDTAEDAALAYDGAAFRLRGDAARLNFPELRRGGRHHAPALSASVDAKILQATTTTTADTAAAAAPASTNTTPPPSPRVVKTEPGCCSVSEASTTTTADAADVSSTGSSPSPTSSNQAATATPPPPRPPPPLPETIQQLDFTEAPWDEADGFALRRYPSWEIDWDAILS

SEQ ID NO: 2732 - protein, 85 aa, Setaria poiretiana
ECQKVGAPPEVSARLTAMAQELEARQRTALSGLGAATEPELDQFMEAHHEMLVKFREELTRPLQEAMEFMRRVESQLNSLSISGR

SEQ ID NO: 2733 - protein, 185 aa, Arabidopsis thaliana
KLYRGVRQRHWGKWVAEIRLPRNRTRLWLGTFDTAEEAALAYDKAAYKLRGDFARLNFPNLRHNGSHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 2734 - protein, 224 aa, Glycine max
MEKVNFVKNGELRLPPGFRFHPTDEELVLQYLKRKVFSCPLPASIIPELHVCKSDPWDLPGDLEQERYFFSTKVAKYPNGNRSNRATNSGYWKATGLDKQIVTSKGNNQVVGMKKTLVFYRGKPPNGSRTDWIMHEYRLILNASQSQSHVVPMENWVLCRIFLKRRIGAKNGEESNSKVVFYDFLAQNKTDSSSSVASGITHESDEHEESSSSNTFPYTIRRKP

SEQ ID NO: 2735 - protein, 251 aa, Brassica oleracea
MGRGRVEMKRIENKINRQVTFSKRRAGLLKKAHEISILCDAEVSLIVFSHKGKLFEYSSESCMEKVLEHYERYSYAEKQLKVPDSHVNAQTNWSVEYSRLKAKIELLERNQRHYLGEDLESISIKELQNLEQQLDTSLKHIRSRKNQLMHESLNHLQRKEKEILEENSMLAKQIRERESILRTHQNQSEQQNRSHHVAPQPQPQLNPYMASSPFLNMGGMYQGEYPTAVRRNRLDLTLEPIYNCNLGYFAA

SEQ ID NO: 2736 - protein, 281 aa, Nicotiana tabacum
MVRAPCCEKMGLKKGPWTPEEDQILVSYIQTNGHGNWRALPKLAGLLRCGKSCRLRWTNYLRPDIKRGNFTREEEDSIIQLHEMLGNRWSAIAARLPGRTDNEIKNVWHTHLKKRLKNYQPPQNSKRHSKNNLDSKAPSTSQTFNNSDNFSNIQEDINGPVTGPNSPQRSSSEMSTVTVDSTAMTTITIDDQNMFKQLDEMDSSENFIPEIDESFWTDDLSTSDNSTFGMEGTGGELQVQFPFSSVKQESMDMVGAKLEDDMDFWYNVFIKSGDLLDLPEF

SEQ ID NO: 2737 - protein, 642 aa, Zea mays
MMGGGLLVDQSVVFPGVHNFVDLLQQNGDKNLGFGSLMPQTSSGDQCVMGEGDLVDPPPDSFPDAGEDDSDDDVEDIEELERRMWRDRMKLKRLRELQQTRGKDSLASGAGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCEPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYQKLNPGARPPASTGGIASAISFNTSSSEYDVDIIDECKGDEAGNQRTAVTDPTAFNLGAAILSDKFLVPTPMKEETADVEFIQKRNAPAAAEPELMLNNRLYTCNNVQCPRSDYSYGFLDRNARNSHQYTCKHKDPTPQSTENKPPSAPPQPQAFQPAFSQPNQALNSLDFSLPMDGQRSIAELMNMYDNNFVPNKNPSSDSVAVMERPNAMPQQRIQMDEGFFVQGNGAFDDVNNSMMQQQQQQAPVQQQQQFFIRDDTPFVSQMGDIAASAPEFRFGPGFNMSSGVDYPGAAQRNDGTNWFY

SEQ ID NO: 2738 - protein, 798 aa, Vitis vinifera
MEIDLNHAVTEVEKHAFCNGDCDKASCVCCLSSSSSSSSASNSSASPDSSSIYLELWHVCAGRLTSLPKKGNVVVYFPQGHLEQAASSSPFPPMDISTFDLPPQIFCRVVNVQLLANKENDEVYTQVTLLPQPELAGINLEGKELEGLGVDEEGGGGSPTKSTPHMFCKTLTASDTSTHGGFSVPRRAAEDCFPPLDYKQQRPSQELVAKDLHGVEWRFRHIYRGQPRRHLLTTGWSIFVSQKNLVSGDAVLFLRGEGGELRLGIRRAVRPRNGLPDSIIGNQNSYPNVLSLAANAVATKSMFHVFYSPRASHAEFVIPYQKYVKSITNPISIGTRFKMRYDMDDSPERRSSGVVTGIGDLDPYRWPNSKWRCLMVRWDDDIVSDPQERVSPWEIDPSVSLPPLSIQSSPRLKKLRTSLQATPPNNPINGGGGFLDFEESVRSSKVLQGQENVGFVSPLYGCDKVNRSLDFEMQNPSLASTGIEKANFCEFMRAPPTTYTGFLESDRFPKVLQGQEIGPLRSLAGKSDFNLGSWGKPNLGCNLFNMYQKPKPNFYPLASEGIRNMYFPYNDIYKGGQDPVMLSYASNFPRENVPFNPSSIRSGVIGTEVRKLNIPNEPKPPENISAPPNLETNLKHQKDDTFSGTAAGCKLFGFSLTGETPPNSQNSGKRSCTKVHKQGNLVGRAIDLSRLNGYGDLFSELERLFGMEGLLRDPDKGWQILYTDSENDMMVVGDDPWHEFCNVVSKIHIYTQEEVEKMTIGIISDDTQSCLEEAPVILDVSKSSSVGQPDSSPTVIRI

SEQ ID NO: 2739 - protein, 307 aa, Antirrhinum majus
MEILAPSSYFSSSSWFLEESRSTTRWTAAENKAFENALAVFDENTPNRWERVAERVPGKTVGDVMRQYKELEDDVSSIEAGFVPVPGYSTSSPFTLEWGSGHGFDGFKQSYGTGGRKSSSGRPSEQERKKGVPWTEEEHKLFLMGLKKYGKGDWRNISRNFVITRTPTQVASHAQKYFIRQLSGGKDKRRASIHDITTVNLSDNQTPSPDNKKPPSSPDHSMAQQQTSSTSIHKLPFQWDQTSNETIMGFASSGHHGNMFQSNPFGMNSYGFKMQGQQMQRGGFCDTYLGSQNMAFQMQSGLHFPNA

SEQ ID NO: 2740 - protein, 384 aa, Oryza sativa
MNGDSAPASALASPIASFDIISVQWPAAISCSSSNETRALFIIISSSCHRSIRAGCWPAGDPSYNFLACVMEKTSAGKEEGSESKTAAANNDGSSTSSTTEEEESGESQRRTSSSSSVRPYIRSKNPRLRWTPELHLSFVRAVDRLGGQDRATPKLVLQLMNVRGLSIGHVKSHLQMYRSKKIDESGQVIGGGSWRSSDEQQYHHLQMQGGGDGGQAYNLGHLSLPAALHHRHITAGSGTILQSRVANAWSPWRCHGSYWLRAGHHLLVGSKPYYPPPPAEARANTSSNHPDFVQGSSSSPDDHTMNHQRPVVLKEMIYNEGSNHQGGPLNLDLSLDICPRGEKRKRELISWRKHEEDHDHTTIAIGGDQEAESCATGLSLSLF

SEQ ID NO: 2741 - protein, 291 aa, Antirrhinum majus
MEILTPSSYFSNSNLFVEESWSPKWTAADNKAFENALAVFDEYTPHRWERVAEIVPGKTVWDVIRHYKELEDDVTSIEAGLVPVPGYNTSLPFTLEWGSGHGFDGFMQSYVVGGRKSSCSRPSDQERKKGVPWTEEEHKLFLMGLKKYGKGDWRNISRNFVITRTPTQVASHAQKYFIRQLSGGKDKRRASIHDITTVNLNDGQTFPRENKIKQSSPLAHQSNSAAATSKLHIQWNQTRNETITGFGSGNMFVSDPYNYMNSNEVGLQGRSPFGSRNMVFRMHPCFSYPSA

SEQ ID NO: 2742 - protein, 180 aa, Medicago truncatula
MGFPVGYPEVSVPNIFLYTLSLLSFLRSLTISFLSLLHLSDLLDTDFSTTTLPDSHIHRPTLSAILIRQFLPIITFNDLAEGDSSPPVGCAVCLNEFAGEEEIRCMANCRHMFHRTCVDRWIDHDQKTCPLCRTHFVPYHKMEDYNQRLWNDAASEDDIDDDVSLFSHRHDYYYIANASL

SEQ ID NO: 2743 - protein, 279 aa, Arabidopsis thaliana
MVKKSKGRQKIEMVKMKNESNLQVTFSKRRSGLFKKASELCTLCGAEVAIVVFSPGRKVFSFGHPNVDSVIDRFINNNPLPPHQHNNQVLSQLETEKKKYDELKKIREKTKALGNWWEDPVEELALSQLEGFKGNLENLKKVVTVEASRFFQANVPNFYVGSSSNNAAFGIDDGSHINPDMDLFSQRRMMDINAFNYNQNQIHPNHALPPFGNNAYGINEGFVPEYNVNFRPEYNPNQNQIQNQNQVQIQIQNQSFKRENISEYEHHHGYPPQSRSDYY

SEQ ID NO: 2744 - protein, 443 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTEETLTRSSFPAKYLPWDSECPRSTFSIVPPTPSYYFPTPNGSLGPNQSGVATHLPRGSSCAVPCTQVHSPIPMKGRPLFNDRDLEGKGTQKEGSSTGSNAESVDAEYLEIEAQSSRNVVEESVRVRASVPSLFERRANSTKRVKGFVPYKRCLAERGMSSSTLTGEEREEQRTRLCL

SEQ ID NO: 2745 - protein, 652 aa, Oryza sativa Japonica Group
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAVSSVPARAGVSIAHLPMFAAWTDA

SEQ ID NO: 2746 - protein, 443 aa, Solanum peruvianum
RMSVDVGAPSPRSIQVDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTEETLTRSSFPAKYLPWDSECPRSTFSIVPPTPSYYFPTPNGSLGPNQSGVATHLPRGSSCAVPCTQVHSPIPMKGRPLFNDRDLEGKGTQKEGSSTGSNAESVDAEYLEIEAQSSRNVVEESVRVRASVPSLFERRANSTKRVKGFVPYKRCLAERGMSSSTLTGEEREEQRTRLCL

SEQ ID NO: 2747 - protein, 244 aa, Crocus sativus
MGRGRVELKRIENTINRQVTFSKRRGGLLKKANEISVLCDADVAIIIFSTKGKLSEYSTDARMESILERYDRYSCAERDIVAPDPDSQESWRDEYGRLKAKLEALQTSQRHLMGAQLDMLSAKELQQLEQQLENALKNIRSRKNQLLFDSISELLKKEKTLTTQNKDMEMKLIEKKKVKSMARQGQQYTESSSPPSLLIQDPFPSLTIGINPASGSSEEDNEARLLPPVNRNRLPPWMVRSANE

SEQ ID NO: 2748 - protein, 446 aa, Solanum peruvianum
RMSVDVGAPSPRSIQMDEQVNPGEEYAPKIRKPYTISKQRERWSEEEHKKFLEALKLHGRAWRRIEEHVATKTAVQIRSHAQKFFSKVVRDSSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 2749 - protein, 446 aa, Solanum peruvianum
RMSVDVGAPSPRSIQMDEQVNPGEEYAPKIRKPYTISKQRERWSEEEHKKFLEALKLHGRAWRRIEEHVATKTAVQIRSHAQKFFSKVVRDSSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDLEGKETQKEGSSTGSNAESVDAELSGEKNMEIEAQSSRNVVEESVRAGVPSLFERRANSTKRVKGFVPYKRCLAERGMSSSTLTGEEREEQRTRLCL

SEQ ID NO: 2750 - protein, 95 aa, Physcomitrella patens subsp. patens
MASREEKGITKRRQAGQGVHFRGVRKRLWGRFAAEIRDPWKKTRVWLGTFDTAEEAARAYDSAARALRGSKAKTNFACAPSSDDQSTNLNFTLKS

SEQ ID NO: 2751 - protein, 102 aa, Cryptothladia chinensis
TAQGLRDRRMRLSLQIARKFFDLQDILGFDKASKTIEWLFTKSKKAIKEVTLKHPHLKNNLCNRVEKDDSITSEGEVESVIEDVYGEKGKAQKIVYDPVARE

SEQ ID NO: 2752 - protein, 154 aa, Physcomitrella patens subsp. patens
MEYSKQDFIRVRARRGQATDSLSVAEWVRCEKIRKRMKYLQDLVPGCRKVTGKTDMLDEIINYVQSLQCQAESLSMKLGAVHPAPLDHLTLESLLSIEEVLQSQWSNILCTSDSTSSPEFGLQQLPQQRGSMLDGHCNFDHFQANLGYSFNGSS

SEQ ID NO: 2753 - protein, 86 aa, Cryptothladia chinensis
TAQGVRARRMRLPLKIARKFFHLQDMLGFDKASKTIEWMLAKSKGAIKELTEKPIPITTNIGDQGISEYLSEGERNKMELGKAARE

SEQ ID NO: 2754 - protein, 565 aa, Oryza sativa Japonica Group
MGGEPRARAEAAWAAALPAALVALVRDTATYTRMMHRLRMETPRGPTCQLDPCCCCCTAHVIPPPPPVSRTHATRRDAEASVPPPPASAAVSSRSDGTGQMAAGVTLACAAPPPLRAPRASDGGRRRGVVKGGAGTDTCRSPQRLNVRPRERERVRACVRARAKNHEHGQRRREAAVDPAMSGEYQFQDELAPLFARPGGGAGEMQMLPSSWFADYLQAGTPMQMDYDLMCRALELPVGEDVKREVGVVDVVAAGGGGAPPLTPNTTSSMSTSSSEGVGGGGGGGAGAGAGEEESPARCKKEEDENKEEGKGEEDEGHKNKKGSAAKGGKAGKGEKRARQPRFAFMTKSEVDHLEDGYRWRKYGQKAVKNSPYPRSYYRCTTQKCPVKKRVERSYQDPAVVITTYEGKHTHPIPATLRGSTHLLAAHAQAAAAAAAAHQLHHHHGHHGHHGMAPPLPLGSGAAAQFGRSSGIDVLSSFLPRAAAAHHGMTTMGGAAATTTTSHGLNSAISGGGGVSSETTSAVTVAASAQPSSPAALQMQHFMAQDLGLLQDMLLPSFIHGTNQP

SEQ ID NO: 2755 - protein, 85 aa, Cryptothladia chinensis
AQGVRARRMRLPLKIARKFFDLQDMLGFDKASKTIEWLFAKSKGAIKELTKTIPVITNIGDQGISEYSSEGERNKRELGTKAARE

SEQ ID NO: 2756 - protein, 86 aa, Cryptothladia kokonorica
TAQGVRARRMRLPLKIARKFFHLQDMLGFDKASKTIEWMMAKSKGAIKELTEKPIPITTNIGDQGISEYLSEGERNKMELGKAARE

SEQ ID NO: 2757 - protein, 56 aa, Lolium multiflorum
CGKSCRLRWCNQLSPQVEHRPFTPDEDDAILRAHARFGNKWATIARLLSGRTDNHI

SEQ ID NO: 2758 - protein, 313 aa, Glycine max
MNTRKDMDRIKGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRKCTSTMIDDDNTPPLKRSLSAGAAIPVSTGLYMNPPTPGSPSGSDVSESSVLVASSSHVFRPVPRTGAVLPPVETTTTLSSNDPPTSLSLSLPGVDSSEVSNRTTEPIHAAPPPPPQPQPQPQPLNTIPLLPMMTVPSVSPTGMAPFNFSAEFLAVMQEMIRKEVRSYMELHNQKNGMCFQAAVNDGFRNASVKRIGISRVDS

SEQ ID NO: 2759 - protein, 277 aa, Nicotiana tabacum
MGRAPCCEKMGLKKGPWTPEEDQILISFIQQNGHGNWRALPKQAGLLRCGKSCRLRWTNYLRPDIKRGNFTKEEEDTIIQLHEMLGNRWSAIAAKLPGRTDNEIKNVWHTHLKKKLKDYKPPQNPKRHSKNHDSKGPTTSESSNNSHLTFIYTQKHIIDSSVPAPNSPQISSSTEMSTVTLVDDHQMVIKQEEMESSEYFPEIDESFWTDKLSTDNNWSNTHDHVMVTADQELQVQLPFSSLKEENVDMLTTKMEDDMDFWYNVFIKTDDLPELPEF

SEQ ID NO: 2760 - protein, 230 aa, Arabidopsis thaliana
MVKQERKIQTSSTKKEMPLSSSPSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 2761 - protein, 324 aa, Triticum aestivum
MEASKGGDGSSGASPSNDDSTVEEEGASRQEQEDACRGNSLSSSSVRPYVRSKNPRLRWTPELHHCFVRAIHRLGGQDRATPKLVLQLMNVRGLSIGHVKSHLQMYRSKKIDDSGQVIGHLPLPHAFHHRQSGAGTMLSRFGAAAWPPWRSFHEPYWAHGRPFLGSKTYNSLEAEAEAAFLRSRAQHVARAASSNPGLMMQSGCPSRNDHHTMNHQPKRLLQLTVRNDDDTHVLLDLDLGLSLGLPVPMREAKRRRSGCGWVKEGPDEKGADEEQVDETSTATMLSLSLFSPRDAPRKMSSTSASDHAVDEHATRRASTLDLTI

SEQ ID NO: 2762 - protein, 798 aa, Arabidopsis thaliana
MEAESSTPQERIPKLRHGRTSGPARRSTRGQWTAEEDEILRKAVHSFKGKNWKKIAEYFKDRTDVQCLHRWQKVLNPELVKGPWTKEEDEMIVQLIEKYGPKKWSTIARFLPGRIGKQCRERWHNHLNPAINKEAWTQEEELLLIRAHQIYGNRWAELTKFLPGRSDNGIKNHWHSSVKKKLDSYMSSGLLDQYQAMPLAPYERSSTLQSTFMQSNIDGNGCLNGQAENEIDSRQNSSMVGCSLSARDFQNGTINIGHDFHPCGNSQENEQTAYHSEQFYYPELEDISVSISEVSYDMEDCSQFPDHNVSTSPSQDYQFDFQELSDISLEMRHNMSEIPMPYTKESKESTLGAPNSTLNIDVATYTNSANVLTPETECCRVLFPDQESEGHSVSRSLTQEPNEFNQVDRRDPILYSSASDRQISEATKSPTQSSSSRFTATAASGKGTLRPAPLIISPDKYSKKSSGLICHPFEVEPKCTTNGNGSFICIGDPSSSTCVDEGTNNSSEEDQSYHVNDPKKLVPVNDFASLAEDRPHSLPKHEPNMTNEQHHEDMGASSSLGFPSFDLPVFNCDLLQSKNDPLHDYSPLGIRKLLMSTMTCMSPLRLWESPTGKKTLVGAQSILRKRTRDLLTPLSEKRSDKKLEIDIAASLAKDFSRLDVMFDETENRQSNFGNSTGVIHGDRENHFHILNGDGEEWSGKPSSLFSHRMPEETMHIRKSLEKVDQICMEANVREKDDSEQDVENVSLFLSFNHLNISCATGLHKLSSFRFCRQSCHFVTCVKIFIVLVSFNRHCSNRL

SEQ ID NO: 2763 - protein, 289 aa, Brassica napus
MDYDASRIGEIVEDEEQIDLPPGFRFHPTDEELITHYLKQKVFNTFFSATAIGEVDLNKIEPWELPRKAKIGEKEWYFFCVRDRKYPTGLRTNRATEAGYWKATGKDKEIFKGKSLVGMKKTLVFYKGRAPKGVRTNWVMHEYRLEGIYSIQHLSQTAKNDWVICRVFHKRADGTKVDMSHLMLLDSHVNRIEPVGLPSLMDSSQRDSFPGSSTHVTCFSDQETEDKRLIHLESKDGSGPLFYPDPLFLTDNDSLMKLLLNSHETQFPGTGTDPSALAGMGESGCFWNF

SEQ ID NO: 2764 - protein, 445 aa, Zea mays
SLTSSPPISEQAARTSRQPHSRSSSSSGGAPMSSGDFHYHDELAALFAQRPAPAGEMTMALQQQAPAASWFADYLHAGAPGMGMDMDYDLLCRALDLPVPGDEDGVVKRELLLVADTGGGGGGFAAPLTPNTTSSMSSSSSEAAGAAAGGGGGGSFGAAEEESQSLGRCKKEDDGDGEESKDKEAMKGEEDDADTGKKGSAAGKGKGKGEKRQRQPRIAFMTKSEVDHLEDGYRWRKYGQKAVKNSPYPRSYYRCTTQRCPVKKRVERSHQDPAVVITTYEGKHTHPIPSTLRGSSTHLLAAQLHHHHHHNIVGAFPPPPPPPQTMCLPFVGRTGDGGGVIDMLGLCLPPRNHAAVPPAATGLAPSPCCMSGPVGTVAGATTTTAPTTTTVTTTTTSSPPPPPSLQTMQHFMAQDDFGLLQDMLPSSSSSLSFVVPSNGSNVQLP

SEQ ID NO: 2765 - protein, 198 aa, Gossypium hirsutum
MAPKKAGVSKRVFNKGSWTAEEDRRLAKYIEIHGAKRWKTIAIKSGLNRCGKSCRLRWLNYLRPNIKRGNISDEEEDLIIRLHKLLGNRWSLIAGRLPGRTDNEIKNYWNSHLSKKMINHDVRTEQTSSSEQIVPHKAWETVQMEEEEVVKGSDEIENSEFSIDVDEFFDFSTEGCFGLDWVNKFLELDDQQDPLAMV

SEQ ID NO: 2766 - protein, 315 aa, Saccharum hybrid cultivar
MEDLYSIHPGISRVGGAASEASTAGVGAGGPSPSDLTELMKAQIASHPRYPSLLSAYIECRKVGAPPQVASLLEEVSRERSPGAAGAGEIGVDPELDEFMDSYCRVLVRYKEELSRPFDEAASFLSSIQAQLSNLCSAGSSPAATATHSDDMMGSSEDEQCSGDTDVPDIGQEHSSRLADHELKEMLLKKYSGCLSRLRSEFLKKRKKGKLPKDARTVLLEWWNTHYRWPYPTEEDKVRLAAMTGLDPKQINNWFINQKKKHWKPSEDMRFALMEGVAGGSSGTTSTSIQAQLDPESHTIWDDNWPIQSVVRPGM

SEQ ID NO: 2767 - protein, 188 aa, Saccharum hybrid cultivar
SSVVTAAAAIQADPAEKPRAPKAQVVGWPPVRSFRKNIMSVQSDKGAGGSKDADKSSPPPAAAAAVGGAAFVKVSLDGAPYLRKVDLKMYKMYKSYQELSKALEKMFSSTIGSCGSQGMNGMNESKLVDLLNGSEYVPTYEDKEGDWMLVGDVPWEMFVESCKRLRIMKGSEAIGLAPRAMEKCKNRS

SEQ ID NO: 2768 - protein, 765 aa, Triticum aestivum
  misc_feature (558)..(558): Xaa can be any naturally occurring amino acid
  misc_feature (569)..(569): Xaa can be any naturally occurring amino acid
MDTPDRPRAGAAAGFEDSPVFNFINNLSPIPPPKPQDTSHNVHLFKSSDLAPVSSIFASPHVNPPKESKLLIRDDSVQLSQDSNSPNSVRTRLGSAIRLIKCKNIVSENCSFTCHLNQGPIDSSANRSNSTSKLPQTIQFVGDSSECGKNQSADGKKDLARDQESIELEGVLLDHTGPDKIDSSQPGRIVHENQQCEQQKDGFTAYDGDYLITHESSMDMLRLAPPCEADTQLVNETLNADNVFSGNSLLTDGPSGSYINNAAHDPNLYWDGTVEGPTTDYTPQLLPGACQSQSVSNDQICNAVEEPSDHIPIDQSALSQNMRGMRRRCLFNEKAGAVNKAAKKTSDRHSANTTTPRCKTNSGDKPVRTPPCALPGIGLHLNALAPISTDKIVPQAAQSSINQASNFPCAVSSSTSESNIANEDSSQAIVVANADESGQGSPKKKRHKFDDGDGTSCKRCSCKKSKCLKLYCECFHAGVFCSEPCSCQGCLNKPSNMEIVLSTREQIESRNPLAFAPKVIRTSEPGQELGEYSNKTPASARHKRGCNCKKSSCLKKYXECYQGGVGCSXSCRCEGCKNAFGRREGLGPLSIEEAKQGNEENSACVKEEKKEDDNNQLVICPAANPAPAENVLTTPSAMDVRPLASRPPSSSKRPRSTTKVLGHPSRLCNSQAPLKTDTLLSPFENYAEIMFGVGTSDSLKGGLSPQTSVKVVSPNKKRVSPPRIGTGLSPICKSGRKLILKSIPSFPSLGGDVNNADTKTTLPAP

SEQ ID NO: 2769 - protein, 509 aa, Cucumis sativus
MAKKDDSATRPPLQRPTITLPPRPSMEAFFTGVPTGVSPGPMTLLSSYLADFADGAVDSPSFSQLLAGAMASPMAMGFFGTGSTPNYYAKDGPASELEFGMKQSKPVNLVVARSPLFSVPPGLSPSGLLNSPGFYPPQSPFGMSHQQALAQVTAQAALANSHMHMQQAEYQHSSVPAPTEPLVRDPSFSLDDASQLAIIPSTSDTKSLIAESTEVSHSDRKYQPPPPPHGSDKPADDGYNWRKYGQKLVKGSEFPRSYYKCTHLNCPRKKKIEGLPDGEITEIIYKGQHNHEPPPANKRARDNIEPAGCTNSLIKPECGLQNQAGILNKSSENVQLGSSDSEGRADTEITDDRDEDEPNPKRQNIDAGTSGVALSHKTLTEPKIIVQTRSEVDLLDDGYRWRKYGQKVVKGNPNPRSYYKCTSAGCNVRKHVERSSTDSKAVVTTYEGKHNHDVPAARNSSHHTVNNTVHHIKPLKVVAQKHPLLKEMEFGTNDQRPAVLQLKEEQITV

SEQ ID NO: 2770 - protein, 216 aa, Triticum aestivum
  misc_feature (179)..(179): Xaa can be any naturally occurring amino acid
  misc_feature (193)..(193): Xaa can be any naturally occurring amino acid
MAGVECGGGDWPFSAEEAYADSSALLAEIGWAAGFVDDGCAGELLPPLDPPPATPTGSMEGAGASSSSTDDGATREAADADGRPAAATEAASKPAPALAPGKTMKKQKRARQPRFAFMTKTEIDHLEDGYRWRKYGQKAVKNSPFPRSYYRCTNNKCTVKKRVERSSDDPSVVITTYEXQHCHHTVTFPRGAXAATLASQMVFSGHHHQQPRVQRL

SEQ ID NO: 2771 - protein, 235 aa, Chloranthus spicatus
  misc_feature (108)..(108): Xaa can be any naturally occurring amino acid
MGRGRVQLKRIENKINRQVTFSKRRSGLLKKAHEISVLCDAEVALIVFSAKGKLSEYSTDSRMDRILERYERISYAERELRSTDHRPDGNWNLEYSKLKAKLEGLQRXQRHYMGEDLEKLSLKELQPLENQLDNALKHIRTRKTQVMMDSIAELQAREKLLQEQNSMLEKKIQEKNALAHQAHWEQQNQTQSPPPFLLTHQHPTINNSTYQARGEEDRVRTNSLMPPWMLRHVNG

SEQ ID NO: 2772 - protein, 522 aa, Cryptococcus neoformans var. neoformans JEC21
MSSDKTNLFPTLGEVADRTGKAESLEQEGDDRQMQEIESLCMRCHENGTTRLLLTSIPYFKEIVVSSFRCDHCGHRDTEIQSAGEIQPKGVSYTVHLLTRADLDRQIVKSNWATITIPDIQLTIPPGRGQINTVEGIIRDTVRDLNISQPVRRVMDPETGKKIDELLEKLRAAIDMEEDDEDDGGVGMDDDVKPVHHEPSNSSSKEEKPFVPFSMIVDDPSGNSYFQFKGSQSDPQWNMRAYSRTFDQNVILGLVARPEDMSEEQPEGVPIVAADHKLSSAEEFESKRNKNVINRDDGTVVPDEIYSFPATCSSCGHQLETLMQQVNIPYFQDIIIMSSNCYACGYRDNEVKSGGSIAPKGKRITLKVEDEEDLSRDMLKSDTAGLSIPEIDLVLQPGTLGGRFTTLEGLLNEIYTELSTKVFRAGDSTTAGIGQTDSSAGEDEANFGDFLKGLKECMSAQRQFTLILDDPVSNSYLQNLYAPDPDPNMQIEVYERTFEQNEELGLNDMVVEGYNKEAEGTA

SEQ ID NO: 2773 - protein, 348 aa, Oryza sativa Japonica Group
MRGPLLLRAVVVVAMEHFNDWDLQAVVRSCSFPQSEPPRVGVGVPAAPGAGGAPVVVAPPARAPDGPDQMARASASALYDLEYLDLDHKPFLLPGSSSSSSSSRAVARARGEDDGKGRHEVMISFPAAAAASTSGAQPRSPSGRKPGIRTPRPKRSKKSQLKKVVYEVPVADGGVSSDLWAWRKYGQKPIKGSPYPRGYYKCSSMKGCMARKMVERSPAKPGMLVVTYMAEHCHPVPTQLNALAGTTRHKSAPTGDDDKPTSPGPAAGRAAAGEGVVKCEDVDGNELSAMAADGGAEDTAAAADDDGELWPEGMGLELDEFLGPMDDDVFEFDHVLEDDGVLGRRLSL

SEQ ID NO: 2774 - protein, 225 aa, Hordeum vulgare subsp. vulgare
MARERREIKRIESAAARQVTFSKRRRGLFKKAEELSVLCDADVALIVFSSTGKLSQFASSSMNEIIDKYSTHSKNLGKTDQPTLDLNLEHSKYANLNDQLAEASLRLRQMRGEELEGLSVDELQQLEKNLETGLHKVLQTKDQQFLEQINELHRKSSQLAEENKKLRNQVAQVPTAGKLVVVDTENVIAEDGQSSESVMTALHSGSSQDNDDGSDVSLKLALPWK

SEQ ID NO: 2775 - protein, 221 aa, Oryza sativa Japonica Group
MRKGPWTEQEDVQLVWFVRLLGERRWDFLAKVSGLQRSGKSCRLRWVNYLHPGLKRGRMSPEEERMVVQLHAKLGNRWSRIAKSIPGRTDNEIKNYWRTHLRKLKLKQQKQQQSDDHHNDNDDDDDRNSSSSSSSSNSNSNLQQQPQPEDESSASGSLQAQHHEDQHQLFLHPLWNDDIIVDVDCWSSSTNVVAPPPMPASPLWDIDDAFFCSDYSLPLWG

SEQ ID NO: 2776 - protein, 836 aa, Oryza sativa Japonica Group
MATAEVGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFWSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 2777 - protein, 379 aa, Oryza sativa Japonica Group
MYHPQCELLMPLESLEMDVGQSHLAAAVAAAMPGELNFHLLHSLDAAAAAASSTAASASSQPTVDYFFGGADQQPPPPAAMQYDQLAAPHHHQTVAMLRDYYGGHYPPAAAAAAATEAYFRGGPRTAGSSSLVFGPADDESAFMVGPFESSPTPRSGGGRKRSRATAGFHGGGPANGVEKKEKQRRLRLTEKYNALMLLIPNRTKEDRATVISDAIEYIQELGRTVEELTLLVEKKRRRREMQGDVVDAATSSVVAGMDQAAESSEGEVMAAAAMGAVAPPPRQAPIRSTYIQRRSKETFVDVRIVEDDVNIKLTKRRRDGCLAAASRALDDLRLDLVHLSGGKIGDCHIYMFNTKIHSGSPVFASAVASRLIEVVDEY

SEQ ID NO: 2778 - protein, 162 aa, Physcomitrella patens subsp. patens
GKGKVSSEDSKSMEAATEKTTPLKRQKSDTEDVKVVKTEQGSASENSGDSISPRSTLKGATSKPPQDLPKQDYIHVRARRGQATDSHSLAERVRREKISERMKFLQDLVPGCSKVTGKAVMLDEIINYVQSLQRQIEFLSMKLAAVNPPRLDHNYDLLSKDM

SEQ ID NO: 2779 - protein, 101 aa, Diervilla sessilifolia
TAQGLRDRRMRLSVQIARKFFDLQDMLGFDKASKTIEWLFTKSKKAIKEITLNHQQMKNSYRSREKSESFVSERELEFVTENVNDERGKAQKVANDPLARE

SEQ ID NO: 2780 - protein, 524 aa, Cryptococcus neoformans var. neoformans B-3501A
MSSDKTNLFPTLGEVADRTGKAESTGLEQEGDDRQMQEIESLCMRCHENGTTRLLLTSIPYFKEIVVSSFRCDHCGHRDTEIQSAGEIQPKGVSYTVHLLTRADLDRQIVKSNWATITIPDIQLTIPPGRGQINTVEGIIRDTVRDLNISQPVRRVMDPETGKKIDELLEKLRVAIDMEEDDEDDGGVGMDDDVKPVHHEPSNSSSKEEKPFVPFSMIVDDPSGNSYFQFKGSQSDPQWNMRAYSRTFDQNVILGLVARPEDMSEEQPEGVPIVAADHKLSSAEEFESKRNKNVINRDDGTVVPDEIYSFPATCSSCGHQLETLMQQVNIPYFQDIIIMSSNCYACGYRDNEVKSGGSIAPKGKRITLKVEDEEDLSRDMLKSDTAGLSIPEIDLVLQPGTLGGRFTTLEGLLNEIYTELSTKVFRAGDSTTAGIGQADSSAGEDEANFGDFLKGLKECMSAQRQFTLILDDPVSNSYLQNLYAPDPDPNMQIEVYERTFEQNEELGLNDMVVEGYNKEAEGTA

SEQ ID NO: 2781 - protein, 142 aa, Brassica napus
KGDQASVVGGAINYLKELEHHLQSMDPTVNTPATKEAGDGAGDLMNTIAASSSGPFSDFFAFPQYSRRPSSSSVAEGTAEIEVTMVESHANVKILAKKRPKQLLKLVASIQSLRLTVLHLNVTTRDDSVLYSISLKVHFLSP

SEQ ID NO: 2782 - protein, 94 aa, Dipelta floribunda
TAQGLRDRRMRLSLQIARKFFDLQDMLGFDKASKTIEWLFAKSKKAIKEVTLKHPQMKNNFRNREEKNESIMSECEVESTIENVYGEKEKAQKE

SEQ ID NO: 2783 - protein, 338 aa, Physcomitrella patens subsp. patens
MRVHCDVCEKNKAAVMCCADEAALCTACDTRVHAANKLANKHVRVPLVGQLEPPRCDICQDKAGFFFCLEDRALLCRDCDVSIHSSNKLSSNHQRFLITGTRVGLDAVSGQEGTERMSEESPRVSSLTTVTKSPSPPASKSSPSSASKMNMVSVKPQPAPTNATSNANPSWLSNGGRYTEREKTKLLSVGTTSANVVDPHSSSFGRRNSIPADLSDAVPVWGVDELLNLPELADGYHLGDIGSSKADMNNLGDCDWMADLSMFEEQIYAETLRKVPQMFAPAPTAGLSRGGRATVLSKGKGKQEAAIVPQFDDAFVVPDLGLSASALLPAPVAKRRRT

SEQ ID NO: 2784 - protein, 238 aa, Vitis vinifera
MAPVGLPPGFRFHPTDEELVNYYLKRKIHGQEIELDIIPEVDLYKCEPWELAEKSFLPSRDPEWYFFGPRDRKYPNGFRTNRATRAGYWKSTGKDRRVTCQSRAIGMKKTLVYYRGRAPQGIRTDWVMHEYRLDDKECEETSGIQDSYALCRVFKKNGICSESEEQGQCSSSLIESSQGVLNDYETMSPDVPLPSSSCMEEEDKDDSWMQFITDDAWCSSNTIMGGADEVSCPPAFTN

SEQ ID NO: 2785 - protein, 346 aa, Nicotiana tabacum
MSPPLLDVREEEGQSNVTLLASSASLGSICKKGSELKERNYMGLSDCSSVDSCTISTSSEDNNACGLNLKATELRLGLPGSLSPERGIETCPLASNEKLLFPLHPAKDSALAVSQKTVVTGNKRRFSDAMDGFSEGKFMPNSGLKAGDTKETSRVQPPKMKEATNQNTVPERTSAVNGASNRVGSGAPATKAQVVGWPPIRSFKKNTLASTSKNNEKVDGKAGSPALFIKVSMDGAPYLRKVDLKNYSAYQELSSALEKMFSCFTIGQYGSHGAPGKEMLSESQLKDLLHGSEYVLTYEDKDGDWMLVGDVPWEMFIETCKRLRIMKGSDAIGLAPRGMEKCRSRN

SEQ ID NO: 2786 - protein, 738 aa, Candida albicans SC5314
MSSPSNEASDTSNSSVRKRVVHIDPLEITQSLGFQTFRKGARKPWTKEEDSKLSSLVATEYPKPIDVEKVNWDSIAETLFPDGFRKGKECRKRWCNSLNPTLRRGKWSKEEDEKLVRAFEKYGASWLKVSQEIEGRTDDQCAKRYMEVLDPSTKNRLKPWSMEEDLRLIQQIKIHGTKWRTISNGFEGRPSLTCRNRWRKLVTDVVRGKADPLIKSQVENVTQKNMDDESNEDNILEVLSKKQQELTESNKETGPKNSKRPKKLKRDPDLSSNTPRPTSVNTPANEQSRTEVEWRYTLTPDGNKQARVGEDGYFSRNNIFGEENGGVIKNQQMVQQLVSYAKKRHLNITVHQHIHHHYASNTQQDTNSRTQPNRFNVEPEDQSSRFQHFNYLPPLIEVPKLNSSQSSPNNSSYEGASGTTPTTTQFHHHHHHHHHHHNNNEKDQRTKPASTNGSVIRSTTPAELDGTRESDLIKLLNNTDELNRRETTPISNPLTPLAQTVEYVEAEENQKLKRRKLGPTVESNADMVSKAQHLNNDKNHDIPSEDEEELDFWETMRNLTELPNNTLNNTTTKPTVTSSKNILSHDTTYHNSTTSSNNSKILTSTQFSQKPVSQHHPLHYYNSNTRENTPKPVLIQSQARKETGNAQGSNNNEGQEEGLDEEDKLLAREVAEVGVDQETLNSYGLFYNVYTREGSTFPELQPQQSSQQQQQQQQQQQQKYSAYDQWGGGFGMIPFNPS

SEQ ID NO: 2787 - protein, 147 aa, Brassica napus
MAREKRRIKKIDNLTARQVTFSKRRRGIFKKADELSVLCDADVALIIFSATGKLFEFSSSRMRDILGRYNLHASNINKVMGPPSPYHQLENCNLSRLSQEVEDKTKQLRQLRGGDLEGLNLEELQRLEKSLESGLSRVSEKKGECVM

SEQ ID NO: 2788 - protein, 552 aa, Chlamydomonas reinhardtii
MFAGALWTCAVRAMAEGVQAFGEIWLGGRGGVASGVLKLAPTGLTWRRKQGSKLVEVKKDEIEALSWTKVPRGCQLSVRRKGGPTVNFLGFRDKDLDTLQQYSRTTLALPEGVSEGALSTSGHNWGGVQLRGASLAFLVGGKDDVMLELHVDDTGGEVAEDMLTELAFYVPPGNEDFPAQGEEVPPAKVMLDALLPHADTEAAAADEPVCVFSEVGIVAPRGRFEVEMHLGYLQLGGQSQDFKVRYASIQRIFILPKHNTPHTLVVISLDPPIRKGQTYYAHLLCQFPTDDDISVELDITEEALAAKNEKNGGKLSADMTGPVWEVFAKLLRGLSGARITRPGHFKNAAGDGVNIQRSEWGNLFEFIRAKKIPIENFGSAQHGPGGAKPGMEDDDMDPGVAVDAIKKKRKKGDADGGEEGEAAAAPPPKKKPAKEKPATSPSGADAAPGSGGKGKKGKKAAATEEGEGGAKPKKERKKKDPNAPKKNLSAFMYFSNSNRDKVKAENPGIAFGEVGKLLGERWKAMSAEEKAPYDEMAAKDKAGADSTTAVRT

SEQ ID NO: 2789 - protein, 218 aa, Sisymbrium irio
MAAFEESTDLDAIQGHLFEDFMVSDGFMGDFDFNASFVSGLWCIEPVMNQVPKQEPDSPVLDPDSFVKEFLQVEAESSTSTGTTELNSSSQETDQSISTRKKSKRFEEQEEEEPRHYRGVRRRPWGKFAAEIRDPAKKGSRIWLGTFESDVDAARAYDCAAFKLRGRKAVLNFPLDAGKYEAPANSGRKRKRSDVQGELQRSQSNSSSSSSDGETTCE

SEQ ID NO: 2790 - protein, 324 aa, Arabidopsis thaliana
MHSLNETVIPDVDYMQSDRGHMHAAASDSSDRSKDKLDQKTLRRLAQNREAARKSRLRKKAYVQQLENSRLKLTQLEQELQRARQQGVFISSSGDQAHSTGGNGALAFDAEHSRWLEEKNRQMNELRSALNAHAGDTELRIIVDGVMAHYEELFRIKSNAAKNDVFHLLSGMWKTPAERCFLWLGGFRSSELLKLLANQLEPMTERQVMGINSLQQTSQQAEDALSQGMESLQQSLADTLSSGTLGSSSSDNVASYMGQMAMAMGQLGTLEGFIRQADNLRLQTLQQMLRVLTTRQSARALLAIHDYSSRLRALSSLWLARPRE

SEQ ID NO: 2791 - protein, 194 aa, Physcomitrella patens subsp. patens
MAKSKAAKKSLDSYTVKGTNKIVKVGDTVLMRGQDPEKPSYVARIEKIEADGRSNSNVKVRCRWYYRPEESMGGRRQFHGTKELFLSDHYDIQSADTIEGKCTVHTFKNYTKLESVGAEDYFCRFEYKASTGGFTPDRVAVYCKCEMPYNPDDLMVQCEICKDWFHPSCMSMTPDQVKKMEKFFCPDCLSQPGE

SEQ ID NO: 2792 - protein, 336 aa, Arabidopsis thaliana
METFCGFQKEEEQMDLPPGFRFHPTDEELITHYLHKKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKFSAHNLPKTAKNEWVICRVFQKSAGGKKIPISSLIRIGSLGTDFNPSLLPSLTDSSPYNDKTKTEPVYVPCFSNQTDQNQGTTLNCFSSPVLNSIQADIFHRIPLYQTQSLQVSMNLQSPVLTQEHSVLHAMIENNRRQSLKTMSVSQETGVSTDMNTDISSDFEFGKRRFDSQEDPSSSTGPVDLEPFWNY

SEQ ID NO: 2793 - protein, 196 aa, Solanum tuberosum
MAKTKPGKKDLDSYSIKGTNKVVRVGDCVLMRPSDSDKPPYVAKVDRIEADHRNNVKVRVQWYYRPEESVGGRRQFHGAKELFLSDHYDFQSAHTIEGKCIVHSFKNYTKLENVGPEDYFCRFDYKAATGGFTPDRVAVYCKCEMPYNPDDLMVQCEGCKDWFHPICMGMTIEEAKKLDPFLCSDCSSEDDAKRTF

SEQ ID NO: 2794 - protein, 362 aa, Oryza sativa Japonica Group
MVTSKEFARDQAAMDQKIKSDVGEVVLAGDEEEDGDVVLPGFRFHPTDEELVTFYLRRKVARKSLSIEIIKEMDIYKHDPWDLPNASTVGGEKEWYFFCLRGRKYRNSIRPNRVTGSGFWKATGIDRPIYSAAVNSNSGESIGLKKSLVYYRGSAGKGTKTDWMMHEFRLPPAIAAADASPCMQEAEVWTICRIFKRSITYRKQQQQQAWRPPATVTVKAPPPGDSSSNTGSFESDGGGDEFMNCGLTPAISQQQQHGGRHQMMSTMSCNGGYFFNDGIHHSHSHHKLHSQWGSLQMAPPEPKPEPEQKPLSSPAMTIAFHQNDHGFPAAAADFYKDGYLEEIARMMEVADPSPTGFYDCRY

SEQ ID NO: 2795 - protein, 231 aa, Zea mays
  misc_feature (117)..(117): Xaa can be any naturally occurring amino acid
MKVQCDVCAAEAASVFCCADEAALCEACDRRVHRANKLAGKHRRLSLLGPAAPSSSAQQTPPPPLCDICQEKRGLLFCKEDRAILCRDCDVPVHTASELAMRHTRFLLTGVRLSGSXAEPAARPPPSEEDENDSSGSSISEYLTKTLPGWHVEDFLVDETAAAATTIGVSTDVSYQAGGLARTGGPQDGYYSAWMAPEQIFCEGKGSRMPQMAMCSSSKRPRATSSSYSYW

SEQ ID NO: 2796 - protein, 449 aa, Triticum aestivum
  misc_feature (342)..(342): Xaa can be any naturally occurring amino acid
  misc_feature (353)..(353): Xaa can be any naturally occurring amino acid
  misc_feature (366)..(367): Xaa can be any naturally occurring amino acid
  misc_feature (384)..(384): Xaa can be any naturally occurring amino acid
  misc_feature (390)..(390): Xaa can be any naturally occurring amino acid
  misc_feature (395)..(395): Xaa can be any naturally occurring amino acid
  misc_feature (405)..(405): Xaa can be any naturally occurring amino acid
  misc_feature (410)..(410): Xaa can be any naturally occurring amino acid
GTRDGSPETSSPTPPEVCDKPAEILDELASGIDIPARTTSVDASEEVSSWIASLVDVQNNAAQAETDCGLPFGFRKQEDEGFSVTAGWPTSPVLVPEDKSFFPGFTKHEEYEAKGSPFSSDRSLSNSDKAIEKRRTKIEKTVSLQELRKHFAGSLKEAAKNLGVCPTTLKRICRHHGIDRWPSRKIKKVGHSLKKLQMVIDSVHGAEGTVRLSSLYENFTKTTWSERELQGDLSYPASEQKVQLEPSVPDRQCESRFSPHTSGSNSLSSTYSQSSNSSLGCSSEPKPQQQQSSAPQLAVKQEFFMEENQSSTQMKAASHDELRLFTEEKPVTLCRSQSHMLXSEHKPMANMSXMQEAKPDLSKIKXXYGEERCIFPVQPSWGFXKTKKKXPKAVXISSGNFMTSXYLDDXPEWVLLTCCKPSGSVPCVQNAKTLVSEPTSTGSVGPRVT

SEQ ID NO: 2797 - protein, 913 aa, Vitis vinifera
MEDGSFTPNSVFGAPSDSAMDLNFMDELLFEGCWLETTDGFSFLQPGASTSSALNDSSHHSLTFENPNTPEKSYGDDGQRSSLPENPPPFYPQAEGLVGTQSDNWKTFEAATASGQSESFLVERTELNRRLWIGPSANPGPVSSVKNRLILAIRNLREFTKERDVLIQIWVPIERGGKNDSKEQVGLPGRVFLGKVPEWTPDVRFFKSEEYPRINYAQRYNVRGSLALPVFERGSGVCLGVIEIVTTTQKINYRPELENVCKALEAVDLRSSEVLIPPVKACNELYQAALPEILKVLARVCRTHRLPLAQTWAPCIQQGKGGCRHSDKNYALFLSTVDHAYYVTDPKFKGFNEACFDHHLFRGQGVVGRALTTNQPCFESDITAFSKTEYPLSHHARMFGLRAAVAIRLKSIYNGSADFILEFFLPTDCQETEEQKQVLNSLSIVIQQTCQIFRVVTEKDLEKESILPVGEILFASDERVKQEGSVKLLSPPIKEPSREESSWIAHMMEAQKKGKGVSVSLEYQKEEPEEEFKVTTNWDNTEVELHHGQVFSEFGQPQQNSGAKGSVEGGGDSSFGGQHSSGSRKAREKRRTKTEKTISLQVLSQYFAGSLKDAAKSIGVCPTTLKRICRQHGITRWPSRKIKKVGHSLRKLQLVIDSVQGTQGAIQIGSFYTNFPELSSPNVPGTVPFSSSKMTDDSKQLNPQSEVLFSPGVTTSKSPSSSCSQSSSSSFCCSTGAKQQSTTVNASVSGDVLMAEDPVLLKRTRSDAELHVSNPDEPKLLVRSQSHKSFGEHPCVETLPPLPKSNSRALRDGGGFRIKATFGEENVRFSLQLNWSFKDLQQEIARRFGIDNMNSIDLKYLDDDCEWVLLTCDADLEECIDVYRSCQSRKIKLSLHHSSRLKLKSSAFSSGPS

SEQ ID NO: 2798 - protein, 199 aa, Oryza sativa Indica Group
MARERREIRRIESAAARQVTFSKRRRGLFKKAEELAVLCDADVALVVFSSTGKLSQFASSNMNEIIDKYTTHSKNLGKTDKQPSIDLNMRGEELEGLSVEELQQMEKNLEAGLQRVLCTKDQQFMQEISELQRKGIQLAEENMRLRDQMPQVPTAGLAVPDTENVLTEDGQSSESVMTALNSGSSQDNDDGSDISLKLG

SEQ ID NO: 2799 - protein, 119 aa, Metrosideros excelsa
NKINRQVTFSKRRCGLLKKAHEISVLCDAEVALIVFSTKGKLFEYATDACMEKILERYERYSYAERQILTNNAETNGNWTLEHAKLKARMEILQKNQKNLMGEELDSLSLKELQNLEHQ

SEQ ID NO: 2800 - protein, 292 aa, Oryza sativa
  misc_feature (114)..(114): Xaa can be any naturally occurring amino acid
MAAAIDLSGEELMRALEPFIRDASGSPPVCSQFSPTSPFSFPHAFAYGGGLAQQPELSPAQMHYIQARLHLQRQAAQAGPLGPRAQPMKASSSSASAAGAAATPPRPQKLYRGXVRQRHWGKWVAEIRLPRNRTRLWLGTFDTAEEAALAYDQAAYRLRGDAARLNFPDNAASRGPLHASVDAKLQTLCQNIAAAKNAKKSSVSASAAATSSAPTSNCSSPSSDDASSCLESADSSPSLSPSSAATTAETPATVPEMQQLDFSEAPWDEAAAFALTKYPSYEIDWDSLLAAN

SEQ ID NO: 2801 - protein, 221 aa, Oryza sativa Japonica Group
MCSNIPRPAAAATATATAKKGQKRARQPRFAFMTKSEIDHLEDGYRWRKYGQKAVKNSPFPRSYYRCTNSKCTVKKRVERSSDDPSVVITTYEGQHCHHTASFQRGVGCAAVGAQIHGAAAVALAEQMSAFVSPPPQPHMLYGLPRLHPPSSETAVSCSMPTTTSLQELNNSEGLQRPGYNNSPQAAVTIAQRPPSPSVPPAVSFDKGLLDDIVPPGVRLG

SEQ ID NO: 2802 - protein, 609 aa, Schizosaccharomyces pombe 972h-
MIQTASTISSNGGTNQGMESSSANSPEMNGTQNSMSVGMSGSGSSQNRKITQFSNKLYNMVNDSSTDSLIRWSDRGDSFLVIGHEDFAKLVLPRYFKHNNFSSFVRQLNMYGFHKVPHIQQGVLQSDSPNELLEFANPNFQRDQPELLCLVTRKKAGSQPVEESNTSLDMSTISSELQNIRIQQMNLSNELSRIQVDNAALWQENMENRERQRRHQETIDKILRFLASVYLDGKQKPPSKVMPKSRRLLLEAKYPTVSPTNEPSAHSRPSPQGTTANSSSASISSLHNTTPDGEGKYRSVQNGRALNYVSSFNSDSHSPKDYISQSYTNEPGLKKESADSFNNSIDSYISPNQSPNTDVPSLNRDDTTDPKVVNTGDIINMLDDANSIEGSNMNSLSPLLFDYPNSLYPVNNTSSEQHHNSYRGSVSNSQPSGNLSESTNLQPVQPVDYMSNSNPSYGSYNAEDQLTNFHPGYAMDQKRISKLSDGITKQDQNIQALADILGIPLGDGKIDDAGFSANSPTNLNLPVSSDLDSVLNIPPNEDVFPDSNPVFDEFTNISNLTSPIEASNGNTFGSNPVSLPNQQKSVNPSLMTVSSPRQVRKKRKSSIGA

SEQ ID NO: 2803 - protein, 490 aa, Ostreococcus tauri
MSAMRCAGGRGGGTWVDADARGEAEGAAASTRATRDERRIRGVGGGGRRARDRGVGDRRVGGSGARACAGTGGWGAAGRDERLTGAFRATQEGKGDKQSKKATTSQYRGVRQRPWGRYFLTTFCAIDSWAAEIRDPNRGARLWLGTFDTAEEAARAYDAAARHIRGPNAKTNFQLAPGEEPPPFVLPEPPSGGRGMGGGAGGGGRGRGSDMGLPSTGYGGAGPSRQPNMMKKQKPVKGGVSTIYGFGTPTGEKSGVPKRGSIGFGSGIDLSALANANLALANQNLASAGSARKESESGFMKLFANGSLGDTPSSTGGSPLIMPESIEFRDGIFGMSGEIPVISTKRDRGPSSAFFGTSFGVAGSFGSMFPPDMGLSSTPDAGDGSNFSGFPMSPNTGIDGDFNVGSLGTIGDLGDALPAVGSFELGSPVDLDSMMNSMSRNSGGKAQPMASILGKPKKQEHDSPLGRASTRSSRDTRSKSAQLDALSALK

SEQ ID NO: 2804 - protein, 516 aa, Oryza sativa Japonica Group
MRSSSSKATPTTSPAFRVLCSPPSAKSPRPNKGEDGGGEAEASHRRGKGDAMWDLNDSPAAEAAPPPLSPSADDSGASSSSAAAVVEIPDDADDDSAAVVVVTRQFFPPAVPGGGGDPAPGNARAGWLRLAGAAPPVAATGPAASAAVSKKSRRGPRSRSSQYRGVTFYRRTGRWESHIWDCGKQVYLGGFDTAHAAARAYDRAAIKFRGVEADINFSLEDYEDDLKQMSNLTKEEFVHVLRRQSTGFPRGSSKYRGVTLHKCGRWEARMGQFLGKKYVLIDHRFFLFRSIVRSWAISRKSSCGFLVHCRYVYLGLFDTEEEAARAYDRAAIKCNGKDAVTNFDPSIYAGEFEPPAAATGDAAEHNLDLSLGSSAGSKRGNVDGGGDDEITGGGGGGAGSDQRVPMAFDLDWQTAAARSTKAKFLSNGDPGTAGGLSLTIGAGMAGHWPPQQQQGWGNAGGMSWPHPPHPPPPPTNAAAAATATAAAASSRFPPYIATQASTWLQKNGFHSLTRPT

SEQ ID NO: 2805 - protein, 419 aa, Oryza sativa Japonica Group
MSGGGGGGEGFPFHDELASLFAERPPNGAMPGMLQQQQPWSFIDYHHHLMQESAPTTPPLDYEAFAGEFDDDVAPLEEVKRELVVDGVGLFPGGGASAAAAAAAVAGPMTPNSMSVSSTSSEACGVGGGAGGDEESAGKCKKEEEGDGGDDDGKEGSSTTKGDGDGEDKNKKGGKGKGKGEKRPRQPRFAFMTKSEVDHLEDGYRWRKYGQKAVKNSPFPRSYYRCTTQKCPVKKRVERSYQDAAVVITTYEGKHTHPIPATLRGTAHLLGAAAAAHHHGGLQYHHPGHFAAAVGHRLPPQPHDALGGGLLAPPHAQHLHAMQHQMQLAAAAAASGGSLHAAAMQQMPQPDHAGLVAIIASTTGASTTPPPPPATGSAAAATTPLRMQHFMAQDYGLLQDMFIPSPFLHNDDANNNNHR

SEQ ID NO: 2806 - protein, 226 aa, Thalictrum dioicum
MGRGKIEIKRIENTTNRQVTFCKRRNGLLKKAYELSVLCEAEVALVVFSSRGRLYEYSNNSVKKTIERYKKASTDSPNSGSVYEANVQFYQQEASKMRNQIASLQNHNRNLLGESLSNLNIRELRQIEKKIEGGISKIRAKKNELLFSEIEYMQKREIDLQTDNKYLGAMIAANERVPPEHMNLMPANEYHIMSSAPFDSRNFLPANLLDHNNNYSHSDQTTLQLG

SEQ ID NO: 2807 - protein, 843 aa, Glycine max; identical to SEQ ID NO: 265

SEQ ID NO: 2808 - protein, 321 aa, Antirrhinum majus
MVRSPCCDKVGVKKGPWTVDEDQKLLAYIEEHGHGSWRSLPLKAGLQRCGKSCRLRWANYLRPDIKRGPFSLQEEQTIIQLHALLGNRWSAIASHLPKRTDNEIKNYWNTHLKKRLTRMGIDPVTHKPHTHNILGHGQPKDVANLNHIAQWESARLQAERRLVRESRLAQNNNKIGTIQRRLTWPLCLDNEQSNHYHSALLNSTSAVGLNQDNSFTNYSARPDNNNIYDDYEVNNIMGMIEFNNNSNYFADSLRLPGFVEGITDISSSNIVLGAGVLPSNSDNVVGYFEENWSSVLNNVASSSSMDSPDVLVNASSSYKMY

SEQ ID NO: 2809 - protein, 243 aa, Glycine max
MKPKTCELCHQLASLYCPSDSAFLCFHCDAAVHAANFLVARHLRRLLCSKCNRFAAIHISGAISRHLSSTCTSCSLEIPSADSDSLPSSSTCVSSSESCSTNQIKAEKKRRRRRRSFSSSSVTDDASPAAKKRRRNGGSVAEVFEKWSREIGLGLGVNGNRVASNALSVCLGKWRSLPFRVAAATSFWLGLRFCGDRGLATCQNLARLEAISGVPAKLILGAHANLARVFTHRRELQEGWGES

SEQ ID NO: 2810 - protein, 291 aa, Nicotiana tabacum
MNDDDALTSNWNDIMLDTGIADAEPKMQYQEQKQPSNFPVHQGQPLQQVPTASVETSAIVPASSTASGASSKQRMRWTPELHEAFVEAVNKLGGSERATPKGVLKLMKVEGLTIYHVKSHLQKYRTARYKPEALEGSSEKKESSIGDLSALDLKTGIEITEALRLQMEVQKQLHEQLEIQRNLQLRIEEQGRYLQEMFEKQCKSIPSTDLVKASSSIAEDASAQSTDAVQRSSNKNDPAVPPSNPQEAGDYITQKVGEKQKEQEREDLGNLETNNSSSSNTPPTKRAKLDE

SEQ ID NO: 2811 - protein, 85 aa, Stenotaphrum secundatum
ECQKVGAPPEVSARLSAMAQELEARQRTALGGLGAATEPELDQFMEAYHEMLVKFREELTRPLQEAMEFMRRVESQLNSLSISGR

SEQ ID NO: 2812 - protein, 329 aa, Oryza sativa Indica Group
MALEAVVYSHGDHFGGYGGGLMGGAPAAPWDVFAAAAAGGGGSWDDPGLFAAEASLDVIQGVDEWEVDQDQHASSSSKVAARPPVKAAAAAGKRKRRRAKAAKNREEIESQRMTHIAVERNRRRQMNEYLAVLRSLMPPSYAQRGDQASIVGGAINYVRELEQLLQTLEARRTIKDHIDGGAGESPSPFAGFFAFPQYSTATSGHGGGGDAHSRIVVKPAETTTTAAGGGAGAAIADIEASMVEGHASVKVQARRRPRQLLKLVAGLHQLGLTTLHLNVTTVAAMAMYSFSLKVEDGCKLGSVEEIATAVHEILERMQEQAFADAKTSL

SEQ ID NO: 2813 - protein, 85 aa, Zuloagaea bulbosa
ECQKVGAPPEVSARLTVMAQELEARQRTALGGLGAATEPELDQFMEAYHEMLVKFREELTRPLQEAMEFMRRVETQLNSLSISGR

SEQ ID NO: 2814 - protein, 85 aa, Zuloagaea bulbosa
ECQKVGAPPEVSARLTAMTQELEARQCTALGGLGAATEPELDQFTEAYHEMLVKFREELTRPLQEAMEFMRRVETQFNSLSISGR

SEQ ID NO: 2815 - protein, 993 aa, Oryza sativa
  misc_feature (235)..(235): Xaa can be any naturally occurring amino acid
  misc_feature (439)..(439): Xaa can be any naturally occurring amino acid
MESLLDLRRLLKKEKSAMNQKGDDLSMGKRLKALLTIVMRTTGPTRRSTKGNWTPEEDAILSRAVQTYNGKNWKKIAECFPDRTDVQCLHRWQKVLNPELVKGPWSKEEDEIIVQMVNKLGPKKWSTIAQALPGRIGKQCRERWYNHLNPGINKEAWTQEEEITLIHAHRMYGNKWAELTKFLPGRTDNSIKNHWNSSVKKKVNSYMSSGLLTQVSCLPLNEYSANCNSSPAMTXQNSEDSGCFAVREVENSSGCSQSSLAKVSCSQVHDNTVPLGCDLQVNTNFDKNEAHDSQSSMGPQACYTSAEAVASALPAVHCHVSSSNLDPDQHLQEDFAQGLNLDMTIDEMPTVPSFADNQTVCSIENHERSLEPYDVAMEVPLSMLSSDSGAEQKLHFMSEADFNSPNCLKSELWQDISLQGLLSGPDAVEADSISRSNHXNRDVYSSEADTHLLAPTYMPQTSNSSSVMGLADDQSPQMSVPPSLICSNAMTDDAPFDNRPGRKEMPLSQAEVVTQSSSSSGDAEMFANPGCSNDRHVPSSTMESIPECGDQQVTNAEEPEASLEKEPSLTQSVTAPDEQDKGALFYEPPRFPSLDVPFVSCDLVTSGDLQEFSPLGIRQLMHSTMNVCTPMRLWGSPTHDESTGVLLKSAAKSFICTPSILKKRHRDLLSPIPDKRIEKKYGTEKDRGVSDTSSTGIQTSSINATKDDALITTVLRIERSASSKSLEKKLVFSDENKENLGYTTEQTKDGQSAGNDEHMDEQTTGERSSATNVATNDDLSGNLQPAGILIEHSGDDPISPDYGKNTMNQKLNTNVKSLSVCKEGVCAKSKPTELIVEKSSPCINADYEYVNILADTPGIKRGLESPSAWKSPWFVDMHFQGSYFTSPADSYDALGLMKQINVQTAAALVEAREVLASGGQCDNISSDKENTGNPDAKKEPGTTKLQTKIMAEGRVLDFECTTPERSSDKNAGSNLGRYLSSPIPSSHLLKSFR

SEQ ID NO: 2816 - protein, 279 aa, Zea mays
MGRAPCCEKMGLKRGPWTPEEDKILVAHIQSFGHSNWRALPKQAGLLRCGKSCRLRWINYLRPDIKRGNFSKEEEDAIITLHEQLGNRWSAIAARLPGRTDNEIKNVWHTHLKKRLEPTTKQLEQEQHGAHAGGDAARKRSRPKRAGARTKTTTAAVAPATTAPASPERSAASSSVTESTEQEQGNTGTSSPGFPKEESFTSSSEAAEEFQFDDTFWSETLSMPLDSFDDVPMEPCSSGAFGDVAASSSSSSVGADADLDYWLGVFMKSGDAHQQLPQV

SEQ ID NO: 2817 - protein, 281 aa, Nicotiana tabacum
MVRAPCCEKMGLKKGPWTPEEDQVLVSYIQTNGHGNWRALPKLAGLLRCGKSCRLRWTNYLRPDIKRGNFTREEEDSIIQLHEMLGNRWSAIAARLPGRTDNEIKNVWHTHLKKRLKNYQPPQNSKKHSKNNLDSKAPSTSQTFNNSDNFSNIQEDINGPVTGPNSPQRSSSEMSTVTADSTAMTTITIDDQNMFKQLDEMNSSESFIPEIDESFWTNDLSTGDNSNFDMEGTGEELQVQFPFSSVKQESMDMVGTKLEDDMDFWYNVFIKSGDLLDLPEF

SEQ ID NO: 2818 - protein, 280 aa, Vitis vinifera
MSDYSWRVGGTSGISDSENGVGAVYLRKLTSSKYKGVVPQPNGRWGAQIYEKHRRIWLGTFNEEGEAAKAYDVAARRFRGHAALTNFMGIQDDIETTFLNSHSKAEIVDMLRKHTYNDELEQSAHNYGSKESGADVMESKPSVCERVQLFDKAVTPSDVGKLNRMVIPKQHAEKHLPLQLASSSKGGLLNFEDNGGKIWRFRYSFWNSSQSYVLTKGWRRFVKEKNLKAGDIVSFHRSTGSDKRLFIEWEQRDSSRKPSMKQVESGQMVRLFGVNLFSKS

SEQ ID NO: 2819 - protein, 546 aa, Oryza sativa
  misc_feature (227)..(227): Xaa can be any naturally occurring amino acid
MSSSASPAAWWARSRVRILLPVIFLAPALYFLLSPPSSPPFFFTLPTSREESPSASGSRVIWAQRRVAEWRSCGWWRAAMPAPSRRNGYIRIDCYGGLNQLRRDLCDGIAVARLLNATMVLPKFEVAAYWNESSGFADVFDVDYFIEQTRGYVEVVKDMPEEIASKEPFKVDCSKRKGHFDYVETVLPALLEHQYISLTPAMSQRRDSAIEAARGEDRKALTELCIXAIKGTRVDRLREASDTGHHRGRHKRARSSPPRHDDEPPPPPPLSPAVTGGAHGGAAWHSTVLAEDVESAVIVAALTHVISSTAAEVTTAVPPVTVAPQRAATATMFGQQVMQQPPRGFPPLPSSSGSAATAPEQQQPRRRYRGVRQRPWGKWAAEIRDPVKAARVWLGTFDTAEDAARAYDAAAVRFKGSKAKVNFPDEVAGASIAAVQLPRHHQHHPPTSLPPLPVPAHLRPHFSLAGGQSTTPAPAAAAVAAPPREEFPDLSSYAHILQSGDLEYDFHAAVSAGLTTTAGRSSSSSSLSMPPPSEDLDYKPPFGPSN

SEQ ID NO: 2820 - protein, 225 aa, Elaeis guineensis
MAREKIQIRKIDNATARQVTFSKRRRGLFKKAEELAILCDADVALIIFSSTGKLFEFSSSSMKEILEKHSLHSKNLQKVEPPSLDLNLENSNYTRLDKQVAEASLQLRQMRGEELQGLTMQELQQLEKNLETGLSCVLERKGQQIMEQINHLQQKGMHLMEENERLRKQVVEMARAGRRVLTDSENVMYEDGQSSESVTNASQLVVPPNYDDSSDTSLKLGVAGP

SEQ ID NO: 2821 - protein, 225 aa, Meliosma dilleniifolia
MGRGKIEIKRIENTTNRQVTFCKRRNGLLKKAYELSVLCDAEVALIVFSTRGRLYEYANNSVKATIDRYKKACADTSNTGSVSEANAQFYQQESSKLRQQIVILQNSNRHLMGEALSAMTVKELKQLEGRLEKGISRIRSKKNEMLFAEIEYMQKREIDMQNDNMYLRAKIAENERAQQHMSMMPTSEYEAMPPQQFDSRNFLQVNLLEPNHHYSRQEQTALQLG

SEQ ID NO: 2822 - protein, 88 aa, Brassica napus
QRRKKNPVIEKRAKVEFLKGKAEEEKSKHEKAVSVTRAMTLNNLQMGFLHVFQAMVGFSSVCMQAFESVYNQAKCIGEEQEEVKRLLP

SEQ ID NO: 2823 - protein, 250 aa, Zea mays
  misc_feature (32)..(32): Xaa can be any naturally occurring amino acid
MAGGDHEEGEEVVLVVGDEEEEEEEDVLPGFXFHPTDEELVTFYLRRKVAGKRLSIEIIRDFDIYKHDPWDLPKSSSISGEKEWYFFCLRGRKYRNSIRPNRVTGTGSGFWKATGIDRPVHSSGRAGGGPVVVVGLKKSLVFYRGSAGKGTKTEWMMHEFRLPPRADDTAHATPASEREAEVWTVCRVFRRNFTYKKHPQQQQQQQQMAAGGSEVSAGAGAATVAQPGESSSVTGGVESDTGDEYTNTIP

SEQ ID NO: 2824 - protein, 212 aa, Chloranthus spicatus
IENTTNRQVTFCKRRNGLLKKAYELSVLCDAEVALIVFSTRGRLYEYANNSIKSTIERYKKASADSSSTTSIAEANTQYYQQEASKLRQQIHILQNSNRHLMGDALSSLSIKELKQLENRLERGITRIRSKKHELLFAEIEYMQKREADLQNDNMYLRAKIAENENAQQANMLPGPEFDTLPTFDSRNYFQANILEAAPQYSHQDQTALHLG

SEQ ID NO: 2825 - protein, 207 aa, Arabidopsis arenosa
MASFEESSDLEAIQSHLFEDLLACDGFMGDFDFDASFVSGLWCIESQVPKQEPDSPVLDPDSFVNEFLQVEGESSSSSSPELNSSSSTYETDQSVKKAERFEEEEEARHYRGVRRRPWGKFAAEIRDPAKKGSRIWLGTFESDVDAARAYDCAAFKLRGRKAVLNFPLDAGKYEAPANSGRKRKRSDVQEELQRTQSNSSSSSCDAF

SEQ ID NO: 2826 - protein, 213 aa, Chloranthus spicatus
IENTTNRQVTFCKRRNGLLKKAYELSILCDAEVALVVFSSRGRLFEYSNNSVKTTIDRYKKAHADSNSASVSEANTQFYQQEAAKLRQQLGILQNSNRHMMGESLSSMNIKELKSLEVKLEKGISRIRSKKNELLFSEIEYMQRREMDLQNDNMYLRSKIAENERAQQHMNVLPGPEYDVMPAFDGRNFLPVNLLGSNHHQFSHQDQTALQLG

SEQ ID NO: 2827 - protein, 88 aa, Zuloagaea bulbosa
  misc_feature (52)..(52): Xaa can be any naturally occurring amino acid
ECQKVGAPPEVSARLTAMAQELEARQRTAFGGLGAATEPELDQFMEAYHENXEMLVKFREELTRPLQEAMEFMRRVESQLNSLSISGR

SEQ ID NO: 2828 - protein, 452 aa, Oryza sativa
MVVQPPSVWAYACPNHRTFSSLSPFCSRNPPAAASGGGARSSSSSSLRFVSSGARRSKNCWGGSEVDAVGEPSCMDAAHWHQGLGLVKPMEEMLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 2829 - protein, 226 aa, Saruma henryi
MGRGKIEIKRIENTTNRQVTFCKRRNGLLKKAYELSVLCEAEVALIVFSSRGRLYEYANNSVRTTIDRYKKASDSSNPASVSETNSQYYQQEATKLRQQIGILQNANRHLMGESLSSMSVKELKQLETRLEKGISRIRSKKNELLFAEIEYMQKREVELQNDNIFLRGKIVENERAQQNMNMLPGGGGYEVMSQHPPYDSRNYLPVNLLEHNQHFSHQEPTALQLG

SEQ ID NO: 2830 - protein, 85 aa, Zuloagaea bulbosa
ECQKVGAPLEVSARLTAMTQELEARQRTAFGGLGAATEPELDQFMEAYHEMLVKFREELTRPLQEAMEFMRRVESQLNSLSISGR

SEQ ID NO: 2831 - protein, 637 aa, Oryza sativa Indica Group
MAGARSAPSVAAAPLPMPLPRPSSSGSTLQKLVGPAAPSLAPLTLRAAFVSFPALLPRPGTSGSALPRPARAGFPPRCPLSHASTAAPFPTQPPSPSSLPLPSSTRFGQPDPLAGRLGRQIRKPSLMRGGTGRRWREKGRRREEGEGWERGVERREAEGPREEGESRREFGGCWILIASKFILQWRPLPTVSENPIFAGGHLREREENTTNTELNQAFAAAAAAACVKLKGVKPMSFGNLGGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGAHGGGAGSARLLLADGKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLDGWFELKSKLLVKLLDLDVLLPRAVNFIVSGFGNQACLVKHLEIMYTFPDDN

SEQ ID NO: 2832 - protein, 85 aa, Zuloagaea bulbosa
ECQKVGAPPEVSARLTAMAQELEARQRTSFGGLGAATEPELDQFMEAYHEMLVKFREELTRPLQEAMEFMRRVETQLNSLSISGR

SEQ ID NO: 2833 - protein, 85 aa, Zuloagaea bulbosa
ECQKVGAPPEVSARLTAMAQELEARQRTSFGGLGAATEPELDQFMEAYHEMLVKFREELTRPLQEAMEFMRRVESQLNSLSISGR

SEQ ID NO: 2834 - protein, 242 aa, Arabidopsis thaliana
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKARPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 2835 - protein, 323 aa, Vitis vinifera
MALEAVVFQQDLFGYNGKDLYSLFGGNWSCEFGLEKEDEKSCCFDTLESQTETSHHYENWNSPSQPPPPSIVPHLNEWHHHNSSPEGLIPKQVPEFDSTLPTATSSSSRPKRRRSKSKKNQEEIENQRMTHIAVERNRRKQMNEYLSVLRSLMPESYVQRGDQASIIGGAINFVKELEQRLQWLGGQKEKENGEAGSSAPFSEFFTFPQYSTSSTVSDNSVSMADTVGGNQAVIADIEVTMVESHANLKIRSRRRPKQLLRMVSGLQSLHLTILHLNVTTIDQTVLYSLSVKVEDDCKLTSVDDIATAVYQMLGRIQEEAMIN

SEQ ID NO: 2836 - protein, 85 aa, Zuloagaea bulbosa
ECQKVGAPPEVSARLTAMTQELEARQRTAFGGLGAATEPELDQFMEAYHEMLVKFREELTRPLQEAMEFMRRVESQLNSLSISGR

SEQ ID NO: 2837 - protein, 205 aa, Arabidopsis thaliana
MSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 2838 - protein, 278 aa, Arabidopsis thaliana
MALNMNAYVDEFMEALEPFMKVTSSSSTSNSSNPKPLTPNFIPNNDQVLPVSNQTGPIGLNQLTPTQILQIQTELHLRQNQSRRRAGSHLLTAKPTSMKKIDVATKPVKLYRGVRQRQWGKWVAEIRLPKNRTRLWLGTFETAQEAALAYDQAAHKIRGDNARLNFPDIVRQGHYKQILSPSINAKIESICNSSDLPLPQIEKQNKTEEVLSGFSKPEKEPEFGEIYGCGYSGSSPESDITLLDFSSDCVKEDESFLMGLHKYPSLEIDWDAIEKLFG

SEQ ID NO: 2839 - protein, 241 aa, Glycine max
MEKLNFVKNGVSKLPPGFRFQPTDEELVFQYLKCKVFSYPLPASIIPEINVCKYDPWDLPGNCDLQERHFFSPKEAKYRNGNRMNRTTKCGYWKATGSDKRISSSTCNNGIVGVRKTLIFYEGKSPKGSRTHWVLHEYRLVSVETGAANSSHNNYVNEIGDWVLCRLSMKKRSLESDGSATHQKHRQNNTVQTSRPRLMFDFMMVGKTNSSTSSSCSSSSNIMEVSSNASDHEETSGYAHF

SEQ ID NO: 2840 - protein, 238 aa, Picea glauca
MEHLNTAAAQASSSLYGVGMAEYGDAGVSSMMALITQHEPHDSESIMSTRMPSSFSSFHGHADCLLSAAMFQASQGDHKLKRQPGMDQLVSEQTGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 2841 - protein, 220 aa, Arabidopsis thaliana
  misc_feature (70)..(70): Xaa can be any naturally occurring amino acid
  misc_feature (87)..(87): Xaa can be any naturally occurring amino acid
SHCQLHLTYYFHISFSYLYINPPGSSLISFIVKTYQMVNDPSTDWLITWGPAHNSFIVVDPLDFSQRILXKLETGDYELMILSLFTXGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTPARAAARAL

SEQ ID NO: 2842 - protein, 77 aa, Triticum aestivum
ILRKRRAGKLPGDTTTILKQWWQEHAKWPYPTEDDKAKLVEETGLQLKQINNWFINQRKRNWHNNSQTSTLKSKRKR

SEQ ID NO: 2843 - protein, 350 aa, Coccidioides immitis RS
MPRPPSPPEQSKDMAVSYSSGHSPGHTPKLPSFRELLPDYLHDEIDSASYHLQTGSHQQQHPHHQHSSRLPPVSRQEPPSRRGSGTRHHPGSVGRGQDYDSSLMRQNAYLEGQSRYHSHHLPQERQYYDDRAPLTPSSRSSSRHLDPSDPRNFLPPLRNYEALPGQIPSPVGRHDDRGYERAYDAERASYASSRSSTLSSMTHGTAGPYPSAYNSPIHGSYQGYYGGDLESTAHSAYMDTKPTKYDPLGDTADSKSKKRRGNLPKPTTDILRAWFYEHLDHPYPSEQDKQMFMTRTGLTISQISNWFINARRRHLPALRNQGRIPDPDRMRPSSSMSEDDPDYDTSPSRR

SEQ ID NO: 2844 - protein, 160 aa, Physcomitrella patens subsp. patens
TSTSSVVSDGKNSKSLEANEQTSLKRQRSGLVKAERSASENSGDSASPRSLKATSKPPQDLSKQDYIHVRARRGQATDSHSLAERVRREKISERMKFLQDLVPGCSKITGKAVMLDEIINYVQSLQRQIEFLSMKLAAVNPRLDYSYDLLGKDMLQSRSP

SEQ ID NO: 2845 - protein, 229 aa, Oryza sativa Japonica Group
MADEQYMDLGGGGAAAAPGRGGAGERKRRFTEEQIRSLESMFHAHHAKLEPREKAELARELGLQPRQVAIWFQNKRARWRSKQLEHDYAALRSKYDALHSRVESLKQEKLALTVQLHELRERLREREERSGNGGAATTAASSSSCNGSGSEEVDDDDDKRNAAAGCLDLEPPESCVLGGATCATPADVSVESDQCDDQLDYDEGLFPESFCATPELWEPWPLVEWNAVA

SEQ ID NO: 2846 - protein, 229 aa, Hordeum vulgare subsp. vulgare
MAGKRERIAIRRIENLAARQVTFSKRRRGLFKKAEELSILCDAEVGLAVFSATGKLFQFASSSMNQIIDRYNSHSKILKKVDEPSQLDLHEDSNCARLRDELAEASLWLQQMRGEELQSLNVQQLQALEKSLESGLSSVLKTKSQKIMDQISELEKKRVQLIEENARLKEQLQASKMEMQVAADPLVVVYDEGQSSESVTNTSYPRPPLDTEDSSDTSLRLGLSLFNSK

SEQ ID NO: 2847 - protein, 252 aa, Zea mays
MESDLRWCSGSSNNDWDLHAVVRFASCSGGSCVPSPRASDESFSCLPLPPPPPQKDDVTDATTALSQQLPIGPAIDDSCLQQAFFATPQSRNEAPAPPLQPPAKLRIGGATRSKRKKKSKKEVKRVPVVGASPDPWAWRKYGQKPIKGSPYPRGYYRCSTDKDCRARKQVERCRTDPSTVIVSYTGEHSHPVPLHRNALAGTTRNKPQPASSICNSPAEQPPAASPIGDDDLGAAPAAINVVTDEKCPFSQA

SEQ ID NO: 2848 - protein, 227 aa, Hordeum vulgare subsp. vulgare
MAGKRERIAIRRIENLAARQVTFSKRRRGLFKKAEELSILCDAEVGLAVFSATGKLFQFASSSMNQIIDRYNSHSKILKKVDEPSQLDLHEDSNCARLRDELAEASLWLQQMRGEELQSLNVQQLQALEKSLESGLSSVLKTKSQKIMDQISELEKKRVQLIEENARLKEQASKMEMQVAADPLVVVYDEGQSSESVTNTSYPRPPLDTEDSSDTSLRLGLSLFNSK

SEQ ID NO: 2849 - protein, 393 aa, Triticum turgidum subsp. durum
MTVDRKDAEAAAAAAAPFEIPALQPGRTCGAEESTRSHVLVKPIGSSNLPCNEYALLARQNPKGDALPVASILRKKRPRRSRDGPNSVSETIRRWKEVNQQLEHDPQGAKRARKPPAKGSKKGCMQGKGGPENTQCGFRGVRQRTWGKWVAEIREPNRVSRLWLGTFPTAEDAARAYDEAARAMYGALARTNFPAHPAQAPAVAVPAAIEGVVRGASASCESTTTSTNHSDVASNLPRQAQALEIYSQPDVLESTESVVLTSVEHYSHKDSVPDAGSSIARSTSEEDVFEPLEPISSLPDGESDGFDIEELLRLMEADPIEVEPVTGGSWNCGTNTGVEMGLLEPLYLGGLDRRMLDGMLYAEYPYQMWISHDRALHDPAFNDADMSEFFKRL

SEQ ID NO: 2850 - protein, 1223 aa, Physcomitrella patens subsp. patens
MLTRGGKTAAEKVVREFENGADLGSPDKRESIPPLTDMQDSPVFKFLCNLSPIKPAKTVHHAQTYNELTFPPEPRIFASPRSARRSSSSSLKRVVAAERLSALAQAEGRESLTWQSSISRGALSDNAPSPSPLSRRSDDRLVTLCSRIQTEQVPASQSSGENLVGQGMFAMNSTQLNSEPTNCETDRIAATTANFQTQFTDYQPLDQVASAAMPSDMARYTEDIGEKPGGARSERSDPSERRQSTSSLISQTNDSVMPSILSQESKCAEYDDQRRVSMTCSSVNEDHGFSYSPIAKGSLELDQDTAAMTYLLAGNRDVGQINGKEWSENSSEVDVSRLPYQAASVSSENQADTMNEGTEKQERRVLDAMTSQSGFGASTDVRRDTETNLTTEDAGREHSLPPQRADTAGQRGFRRRCLDFDVARRKSFGSMGGRKSLGSRLKDCSGIDGNNTSVLGDGMRPASDATRTRVQIHVDASRTATDSVMHTGGVLAREDNLGTMTRMQQLTNSTYQNKMDIMYAKTGESHARNSQYSGVTPGVNSPDGVRRSPRVHKSGIGLHLNSLTSSMSFKRNPPSTEGESSKGVLATVLGLQPLTSPSPREDSGGEGLSSAGYPANLNQSFNSGMGSSLERRIEIETNSADAAFSSDKKVVIPTPDFTGLNIENLAPLEDSLPLTPVTTSPRDQERSQPYQQELTWQAEGEVTHELLDSPQSSKNRRLSRRKSTASSQGEKPGDGCKRCNCKKSKCLKLYCECFAAREFCVGSCACRNCFNKPEYEATVLNTRQQIESRNPLAFAPKIVQAPESSPIPGDEALDTPASARHKRGCNCKKSLCLKKYCECYQAGVGCSEGCRCEGCRNMYGRKEGPEEGEAKEKDQVNLTVDKSQAEDPIELFNSMSGKPDRLRDHGKSNPSPITPTFEYDGLGEPMSRLRSTGRKRASSDDQCGSPLAQPASRPPKSPTRFSSTLDAFDLVPYPQEDTDFSICGAGDSPMTTPTFARIAHISRWEGLSDLSTLTPLSMTTLQPTPGSCVTTERPDTSPAFTSQMTETSFHSASATSAHHHASSRYFYISETLYSDFRIWSSQIPEFRHPDPQSPNRFDTPHQAQLSSTDDLDSTTRTSTVHPGKNLHNELESVKTAADDDGTPYFLKYGDDFSSPTRSTVTKSNSPKQKRVTPPRYADSRDQASSGGCGNSLASPPGLRNTKKFILQALPSLPSAAPSSFSNG

SEQ ID NO: 2851 - protein, 545 aa, Zea mays
MPIKFALENMSTQASNRSYRYPDRTQLPYHNGNPMHVGGNGNYCVQQNHDDVNYISSDDGSQSSSSRVQDFQAQFCTLDSSSANCVYPAHSSTSSQSISGSPLSQQESHSDHAYGSSPSASCITQVPTWTLKDLENVMLGPDSDIGSPDSSFLLDTALHGNNWRELLGIQTGDLRQVIVACGKAVDENAVYMDALMSELREMVSVSGEPMQRLGAYMLEGLIARLSFTGHALYKSLKCKEPVATSSELLSYMHLLYEICPFFKFGYMSANGAIAEAVKGEDIIHIIDFQIAQGSQWMTMIQALASRPGRRPYLRITGIDDSNSAHARGGGLDMVGQRLHRMAQSCGLPFEFNAVPAASHEVVFEDLCLRSGEAIVVNFAYQLHHTPDESVGIENHRDRILRMVKSLSPKVVTLVEQEANTNTAPFFLRYMETLDYYTAMFEAIDVACPRDDKKRISTEQHCVARDIVNLIACEGAERIERHEPFGKWRARLVMAGFRPYPLSPVVNRTIKTLLDSYHSHYRLEERDGILYLGWKNRKLVVSSAWC

SEQ ID NO: 2852 - protein, 380 aa, Populus tremula x Populus alba
MCGGAIISGFIAPTTTARSSRRLTSGFEWLEPKKPFNNKHLKPVVADPEDDFEADLQEFKDESDVDEDYDVFADAKPFAFSASASEPAKKRGLPRGSTAVKSAGFSGLAKNSAKRKRKNQFRGIRQRPWGKWAAEIRDPRKGVRVWLGTFNTAEEAARAYDSEARRIRGKKAKVNFPDEAPCASARHPIKENSQKRLTKANLSQDFSYLSNPETDYNNMGFVEEKPQVSQFGIMNSIPVNGDSGVTPLTPSDNASMYFNSDKGSNSFDCDFGWGEQGAEILSVLAATPEVDESVFVEANPKKLKSYTEYAVPVEERNGKSLSEELLAFDNQLMNLQMPDLVGNWEASLDSFLNGDTTQDGTNAVDLWSFEDFPSMVGGVY

SEQ ID NO: 2853 - protein, 374 aa, Oryza sativa Japonica Group
MEATPISVKPPSPVAAAPPPPPVQVPVPPPPPPPLPPAAAAVEPLPPQPVAVVVAEAEPCSMNQLALTPTPKRQKVEESADGNGCKHCACKKSRCLKLYCPCFAGGGYCSEKCGCQPCFNKALYAETVQTTRKVLLSRQKRMSLKINRRSEANAEAVEDAHHSSSSTPPRRGCNCKKSSCLKKYCDCYQDGTGCSLFCRCEDCRNPFGKNEGIMAEESKRFLYTGADLDHSEDEQDFIVERSPRLQSPISKESSFQQTPPHIRATNRDTHMFPQAISQWQPRSWHCSKRQSNDRVIDDSGEYKNSNHDWQLAKPEDSYSISRCVQILNGMAELSQVEKSVAPDVFLQAGNREIFISLNGDVRALWLKRKIQNLT

SEQ ID NO: 2854 - protein, 85 aa, Selaginella moellendorffii
EVVSLSPKTLMESDRYICEICNQGFQRDQNLQMHRRRHKVPWKLLKRATPEVRKRVYVCPEPSCLHHDPCHALGDLVGIKKHFRR

SEQ ID NO: 2855 - protein, 224 aa, Nymphaea sp. EMK-2003
MGRGKIEIKRIENTTNRQVTFCKRRSGLLKKAYELSVLCDAEVALIVFSSRGRLYEYANNSVRGTIERYKKAYAESSSSGAVAETNAQYYQHEAHKLRQQISKIQQDNRQMLGEGVSEMSLRDLKSLENKLERSISKIRGKKNDLLNGEIQYMQNWNEDLQKENTFLRAKVCENERAQQQHISILAAGPAEYELPPAVPFQHINLMESSHHQYSHQERTALQLG

SEQ ID NO: 2856 - protein, 452 aa, Coccidioides immitis RS
MANSESAAVAKTSAGLQEDSTQHLSAKLEETSLNKSGKEEGKDENEDDVGPMQLESLCMNCHKNNNSIKAAGQIQEQGSRYTLEVESPRDFERQVIKSDSAVFRLETLGIEMPKGDGQLTNVEGILSKILEQLESDQPARKIADPELYQSLETVIQKLKKMVHREAFPFTISLDDPSGNSWIAPAPHDEGNKYQRKDYRRTREQNEELGIGGGEETGNMMVSAGDPNDLDIIDGKVYSLPAECPGCTKVCSVNMQKVDIPHFKEVFIWSTVCDHCGYRTNEVKTGGAVPEKGRRITLQVEGIKDLSRDILKSDTCAVASEELDLSVQPGTLGGRFTTVEGLLTQVRDQLHGQIFEIGDEDLAPGDSMAAEERSTWERFFSRLDAAIKGELKFKILLEDPLANSYVQNLHAPDPDPQLHIEDYTRTDEEEDELGLKDMKTEGYEEDNQKDEAS

SEQ ID NO: 2857 - protein, 498 aa, Zea mays
MASSGNEGRVVVDLGSAAESVAADEEAHATPLHEIESLCMRCGENGITRLLLTLIPHFREVVLMAFECPHCGERNNEIQFAGQLQPKGCCYSLEVPLGQSEMLNRQVVKSDSATIKIPELDFEIPPEAQRGTLSTVEGIIMRAVDELQALQDERKKVDPQKAEAIDQFLLKLRSLGSGEAAFTFILDDPAGNSFIENPHAPLLDPLLSVRFYERTREQQAALGFLAEPPKEQPGEAVLPASAVESNSDGLQSVPHGSVGAVAGRRAIAQGNPDEVAAALCRYSAPEEVDTLPSTCGACGTECVTRFFATKIPYFREVIVMATTCDMCGYRNSELKPGGEIPAKGKKITLRVQNAQDLTRDVIKSDSASVKVPELELELSCGTLGGMVTTVEGLIVKICEALERIHGFQLGDSTLEWKKKKWDDFKERLSKLLSLQEAWTLIIDDGLAASFVAPATDSLEDDSQLTIEEYQRSWEQNEELGLNDMDTSSADAAYNTTNT

SEQ ID NO: 2858 - protein, 224 aa, Malus x domestica
MAREKIQIKKIDNATARQVTFSKRRRGLLKKAEELSVLCDADIALIIFSSTGKLFEYASSSMKEILERHNLHSKNLEKLEQPSLQLQLVENSNYTRLSKEIAAKSHQLRQMRGEEIQGLNLEELQQLEKSLETGLGRVIEKKSEKIMKEIGDLQRNGMQLMEENERLRQQVAEKSDGRRLVQVDSENMFTEEGQSSESVTNPCNSNNGPQDYDSSDTSLKLGCV

SEQ ID NO: 2859 - protein, 85 aa, Zuloagaea bulbosa
  misc_feature (42)..(42): Xaa can be any naturally occurring amino acid
ECQKVGAPSEVSARLTAMTQELEARQRTAFGGLGAATEPELXQFMEAYHEMLVKFREELTRPLQEAMEFMRRVETQLNSLSISGR

SEQ ID NO: 2860 - protein, 386 aa, Brassica juncea
MEMMSSSSSSTTQVVSFREMGMYEPFQHLSGWENAFNTIGSSNQNNNNNNNPSSSTVVEVDAARAEADDNNKANYTALYNSVEAEPSSNNDQDEDQINDKMKRRLAQNREAARKSRLRKKAHVQQLEESRLKLSQLEQEFARARQQGLCVHNSSDNSYLGPAGTMNTGIAAFEMEYTHWLEEQNKRVSEIRTALQAHISDIELKMLVDTCLNHYANLFRMKADAAKADVFFLISGMWRTSTERFFQWIGGFRPSELLNVVMPYIEPLTDQQLLEVRNLQQSSQQAEEALSQGLDKLQQGLVENIAVDIRVVKSVSHGAQMASAMENLQALEGFVNQADHLRKQTLQQMGKILTTRQAARGLLALGEYFHRLRALSSLWAARPRERS

SEQ ID NO: 2861 - protein, 360 aa, Glycine max
MTRRCSHCTNNGHNSRTCPSRGGGGVKLFGVRLTDGSIIKKSASMGNLNLSSSSSSAAAAHLQFRSSPSSSNLPAASSPNPSSPCSDPPQGYLSDDPAHVSTFANRRGDRKKGVPWTEEEHRLFLIGLQKLGKGDWRGIARNFVVSRTPTQVASHAQKYFIRQSHATRRKRRSSLFDMVPDMSSDQPSVPEEQVLLPPPENSQPCNGKSQPSLNLSLKSEFEPMETTSQENVQQTNEPMMGSNRLTPMAPHGCFPAYLPVPFPVWPSTWVHPFEEVKGGETCHHQIHKPIPVIPKEPVNVDELVGMSHLSIGEAQVRDREPSPLSIKLLGEPSRQSAFHANVPVGSSDLNNGKDNAIQAV

SEQ ID NO: 2862 - protein, 226 aa, Zea mays
MGAEAAERDRIRGPWSPEEDEALRRLVERHGARNWTAIGRGVPGRSGKSCRLRWCNQLSPRVARRPFTADEDAAIARAHARLGNRWAAIARLLPGRTDNAVKNHWNCSLKRKLGAAARRVRREDPLTALSLSLPGTDQRFHHHSAAADSHFQELPPSPSSPAPSAYPFSPEFAAAMQQLIRTEVQRYMASAGLRAGCGAVGATDLCMPQLVDGVMRAAAEQVGRMQ

SEQ ID NO: 2863 - protein, 204 aa, Capsella rubella
MATIEESSDLEAMQKHLFEDFLVSDGFLGDFDFDASFVSGLWCIEPQVPKQEPDSPVLDPDSFVNEFLQVEAKSSPELNTSSSSTYETDQCVKKAERFEEEVETRHYRGVRRRPWGKFAAEIRDPAKKGSRIWLGTFESDVDAARAYDCAAFKLRGRKAVLNFPLDAGKYEAPANSGRKRKRSDAQEELQRTHSNSSSSSCDAF

SEQ ID NO: 2864 - protein, 627 aa, Vitis vinifera
  misc_feature (173)..(173): Xaa can be any naturally occurring amino acid
  misc_feature (557)..(557): Xaa can be any naturally occurring amino acid
MGCCYSRIEREEMVSRCKARKRYMKQFVKARQAPVCSPHLPPPRPISHYHHHHHHHLTPIPPSPPPQQPSPPPPRLLPPPPMSPSSDTWTSITASPSHLPPPPPPPPPPPPPPAQSSWDFWDPFVPSSSRSVTEEEWEATTMASEAPATTAVSASVTAPPSVVSGFSKDTSSXLAMVVSRNSKDLAEIVKEVDDYFLKAADAGSEVSLLLEIPRSTFSNQTGGKVYSCGKSSNPLWCPWVSNSKLNGFGRLCEEMVVTDIAGGGIISGSGSHCSTVERLYAWEKKLFQEVKNAESIKIEHEKCVAQLRKLEVKRAADYVKTEKTKKEVEKLESRMMVASQAIETTSTEIIKLRESELYPQLLDIVKGLMSMWRSMYECHQVQMHIVQQLKYLNAIPSTEPTSEIHRQSTLQLELEVQQWHSTFCSLVKTQRDYIQALTGWLRLSLFQFSKNPLSKTRQESMIYSLCEEWHLALDRVPDKVASEGIKSLLTVIHAIVVQQADEQKQKKRSESAFKDLEKKLVELRALECKQSPFSTPESSAITRSKDPIAEKRAKVAXLRAKAEEEKSKHEKAVSVTRSVTLNNLQMGFPHVFQAVTGFASVCTHAFESVHNQAKCMDQELDVKRILP

SEQ ID NO: 2865 - protein, 248 aa, Physcomitrella patens subsp. patens
MVEKNVGPDGRVTAARYNLSVTKKEFKTKEAKPASPKYKGVRMRQWGKWVSEIREPNKRSRIWLGSFPTAEMAARAYDAALVCLRGPTASLNFPDSPPQALPVCNSPKDVQVAAAAAAAAAEPCTPVSLPAQPAAQSLEAQLNEMETETKESESHDLEESSASSTANSSPSTPGSITTLEDVDLAFLADMDFIDLPPLEPFDINQSHQSSFPESAALTQGDNPPYCRVSSGPILATDLELYKLLYGVK

SEQ ID NO: 2866 - protein, 323 aa, Oryza sativa Japonica Group
MAVESSDERKADEDGAHEELEGQLLYRVPVFDPSLAEFCSPPPIDDAAAASSSCFKEDAADGAVEDAKYPAAAASSPVQQLPDSFVNFEPTDAELREFAADMEALLGQGLDDSNELQDSFYMETLGLITPPVEESGRVKMELDGGVASNSRVSLPSCRAHPKPEDVESADVLDIDFNCTSPDEQKSSASNGAAADSQFFHRSLDLRLNYEAIIESWGNSPWTDGRPPHGQLDDFWPNDHHYSGLWAAGGGGHGAEVGMMTVRPRMDGPGREARVTRYREKRRTRLFSKKIRYEVRKLNAEKRPRMKGRFVKRPSAAAAPCAVT

SEQ ID NO: 2867 - protein, 85 aa, Zuloagaea bulbosa
ECQKVGAPPEVSARLTAMAQEPEARQRTALGGLGAATEPELDQFMEAYHEMLVKFREELTRPLQEAMEFMRRVESQLNSLSISGR

SEQ ID NO: 2868 - protein, 219 aa, Antirrhinum majus
MGRSPFCDKTGLKRGPWTPEEDQKLLACIQEHGHGNWRALPAKAGLERCGKSCRLRWNNYLRPDIKRGKFSSQEEQTIIQLHALLGNRWSAIATHLSRRTDNEIKNYWNTHIKKKLAKMGIDPVTHKPQRDHALSSNNAHVQSKNAANMSHLAQWESARLEAEARLARQSKLQANSECGGGSDTGGGGSDCCGDNKNYWDNILDLVNFSPSDSPIFRVF

SEQ ID NO: 2869 - protein, 346 aa, Triticum turgidum subsp. durum
MTVDRKDAEAAAAAAAPFEIPALQPGRKKRPRRSRDGPNSVSETIRRWKEVNQQLEHDPQGAKRARKPPAKGSKKGCMQGKGGPENTQCGFRGVRQRTWGKWVAEIREPNRVSRLWLGTFPTAEDAARAYDEAARAMYGALARTNFPAHPAQAPAVAVPAAIEGVVRGASASCESTTTSTNHSDVASNLPRQAQALEIYSQPDVLESTESVVLTSVEHYSHKDSVPDAGSSIARSTSEEDVFEPLEPISSLPDGESDGFDIEELLRLMEADPIEVEPVTGGSWNCGTNTGVEMGLLEPLYLGGLDRRMLDGMLYAEYPYQMWISHDRALHDPAFNDADMSEFFKRL

SEQ ID NO: 2870 - protein, 167 aa, Triticum aestivum
MSPAEMESHKMVEVEAAADPEERTASGDPKACDDCNTTKTPLWRGGPNGPKSLCNACGIRYRKRRRVAMGLDPEAKRKPKRDDAILSKAEASSTKEEEEEDNKASTNKIKTKTTTHTVELHMVGFAKDAVLKQRRRMRMRRRKPSCLGEEERAAILLMSLSSGVIYA

SEQ ID NO: 2871 - protein, 242 aa, Oryza sativa Japonica Group
MVTVREEIRKGPWTEQEDLQLVCTVRLFGERRWDFIAKVSGLNRTGKSCRLRWVNYLHPGLKRGRMSPHEERLILELHARWGNRWSRIARRLPGRTDNEIKNYWRTHMRKKAQERKSNMSPSSSSSSLTYQSCHPETPSMIIGIEEQELHGGSGCITSIMKSTPVDMDGYPMDQIWMEIEAPNVLPGPCFDEAKDSASNSLSGPLLPYPMWDYYCPETCLRMDDEIKVAPQFGYGKGVGPCY

SEQ ID NO: 2872 - protein, 170 aa, Oryza sativa
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLRQPGGPYSP

SEQ ID NO: 2873 - protein, 537 aa, Nicotiana benthamiana
MTIDEPEPNSNSDPISEWLDTLSDVPTFLDEPYNCPEDLNFYGDSWWIPPNQDEHIISHGIIHNDIRTSFNYSSPVNTATSTTPPEPIILDHPQPLDLSKKRKTSGPDHNPKVSRKNQNRQMNEADEIKKSTGQKRVTNKSTGNNGTNKEGRWAEHLLNPCAAAITVGNMNRVQHLLYVLHELASFTCDANHRLAAHGLRALTHHLSSPGSSSSPVDVTNFASSATHKFFRDSLINFNDISPWFRIPNSIANSSVLQILGEQDKLNNLHILDIGVSHGVQWPTLLKELTRRSGGPPPLVRLTVITPTTENGEFRGTPFVIGPPGYNFSSQLLAFAKAINVNLQINRLDNFPLQNLNSQILKSSSDDETLVICAQFRLHNLNHSIPDERTELLRILKNLDPKGVVLSENNIDCSCNSCGDFATTFSRRVEYLWRFLDSTSVAYKGRESEERRMMEGEAAKALTNMGEMNERKEKWCERMTSVGFVKEVFGEDAIDGARALLKKYDSNWEIRVEERDGCVDLWWKGQPISFCSLWKIDS

SEQ ID NO: 2874 - protein, 931 aa, Zea mays
  misc_feature (701)..(701): Xaa can be any naturally occurring amino acid
MPSDKAKAPKKKGEEDPGIPPAPCEGEISHEPHRQRSLNGRTTGPTRRSTKGNWTPEEDAILSRAVQTYQGKNWKKIAESFPDRTDVQCLHRWQKVLNPELVKGPWSKEEDEIIVQMVNKYGPKKWSAIAQALPGRIGKQCRERWHNHLNPAINKEAWTQEEEITLIHAHRMYGNKWAELTKFLPGKGAKNTQYYLLMLYYQLITQRTDNAIKNHWNSSVKKKVDSYISSGLLSQVPCLSLIECPAQCDSLSAMDQQNNGGTDCNDQNTSVVLSSDLQVNVDANKKEAHDSHSSLCQGVCYPSTETVGSVLPDDLEMDMDEGSGNSIFADDQTLCSTSNQEQSMVPFVVAQEMPVSVLSSVSSAEQKLHLISDAKSLKSELWKGVCLQTLITGDTVDPDASSRLNNPDSSKMDTNFLKEAYPLHTPNPSSVIETVYEPMALVTISPPFICSDGLSFAPEIRSKPGEMSDCEAEMVTCSNNFFGNAEQSAKLASSDDRPEAFTMTESTTNCGGEQLTDVKEPVASTAKEQLSKDIETMPDKKKGEGALFYEPPRFPGLDVPFISCDLVTSADLQEFSPLGIRQWMRSTMNVPTPLRLWGSPTHDESPDALKTAAESFPCTSSIMKKRQRSLLSPTPDERIEKKSGIAKGVTDISYMITATCSMNATNDEDIVTESAVCAKQPSLKHLDKKLEFSDINKEKLXDGASEQAKDAQNAQLVDEQHSSPNVVNPNTDLQDNIQPVQILVEQSSNNLISSDHGAKPSCKEVISSKSKPTKLLVEKSSPCINVDYEYVNLLADTPGIKRGLESPSAWKSPWYVDMHMHFQGFVSPADRTYDALGLVNRLSKHSAAAAVEACEMLASGNTTSDKENKDNTDGKELVTRKSQIKIMAEARVLDFDESPTPARTADKKLGSCHRRSVSSPILPSPNLRSFR

SEQ ID NO: 2875 - protein, 455 aa, Chlamydomonas reinhardtii
MATAAAAAADAAGAGGAAGGGGADVSSAAEAQAKAAYEWQQYQLQLEQYHQQQQQYEQYQQQQRQYELYQQQQQQQQQQQQQQYGQYGNAAATAAATEHPPREGGDHQPPPPPGYEPYSSAPYGDPNLYSIANAQDPSSQPPPLESRPTAAAAASAPPPPHAAAGFAAASNSLAAATASASGLGIAGNLSGGGATAGAAGPGGGRPGAMNWTSLQGRVAAGALAYGTSVAAPSRMINGRGLGFKASTTAAAVAAAPGHGGVGGGGGGGSGAGGSGGGAGGGAAAGAGVSGGGGAGAGAGAGAGAGVTSSAVTGSGAGGGAGGGGGGGSGPGSKKGRENLPKNAVTALKQWVYAHIVHPYPSEDEKEVLCAHTGLDLLQLNNWFINARVRIWKPLITQVFNSNHPRMAAEAQARGDGELLTKMQAARNSPTAQLALVAADASALQNLEQVGGWVGG

SEQ ID NO: 2876 - protein, 533 aa, Physcomitrella patens
MMAFNNLSHDVSLQQFPELWESSRFSQRHDTLDADQHTQGFDDTQFPKEPLEPNTNLHQVAMEIQPNATIIGDESSRGRNPVVNESDDREDDNHLLGTEDGIVKNGRTWLNSALLREQNQASEDRSGYGDHNAAERWCPVCSASGSQSCMCGMPMHAGDSSTISFPNQSTYTHWLSMQGANMLASQHRTGGEVDAKAAGFTVSPQSTKMATELNLSPAGHGRDNHALFTDPRHSVAQGGSRYAEDYERTEHQTDWEGATQKMEWEQARDKFLIVAHPLYPDLLNAHASCLRVGTPVDQLPHIEAQLTQARHVTSKYSVLHPDHLEITEDEKTELDQFMAQYIMLLCSFKDHLQQHVYYDVTEAMMSCWELEQALHNLTGVSAGESTGATMSEEDEDYDSDYGAYDAHMDPQDSGGFGPLVPTESERTLMERVRQELKYELKQGYRARIVDVREEILRKRRAGKLPEGTTTVLKAWWQAHSKWPYPTEDEKERRIQETGLELKQVNNWFINQRKRNWHSNPLSSSSELKSKRKK

SEQ ID NO: 2877 - protein, 246 aa, Oryza sativa
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQLQWDQTQPQTISSSSSFMMREALPTTNISNYPAAAGERIEDVPAGQPQHVRIGLPPWMLSHING

SEQ ID NO: 2878 - protein, 216 aa, Helleborus orientalis
IENTTNRQVTFCKHRNGLLKKAYELSVLCDAEVALIVFSSRGRLYEYSNNSVKKTIERYKKASTDSSNSGSASEANAQYYQQEAAKLRNQIAALQNSNRNLLGEQLSNLSIRELKQIEKKIETGINKIRSKKNELLFAEIEYMQKREVDLQNDNMFLRAKISENERTQQHMSLMPGTNNYEVISSGPFDSRNFLQVNLLESNNNYSRSDQTALQLG

SEQ ID NO: 2879 - protein, 214 aa, Aquilegia alpina
IENTTNRQVTFCKRRNGLLKKAYELSVLCEAEVALIVFSNRGRLYEYANNSVRKTIDRYKKTCGEGSSTLTVSEANLLFYQQESSKMKQQIEILQNSNRHLMGEALSCLSIKELKQLESRLEKGISRIRSKKNEMLLAEIEFMQKREIELHNDNIYLREQITANERAQQHMNSLPGNVYEAITSAPYNSRDFLQVNLRESKPNQYCDSTALQLC

SEQ ID NO: 2880 - protein, 325 aa, Vitis vinifera
MEEERKEETLPPGFRFHPTDEELITCYLINKISDATFTGRAIADVDLNKCEPWELPGKAKMGEKEWYFFSLRDRKYPTGVRTNRATNTGYWKTTGKDKEIFNSVTSELVGMKKTLVFYRGRAPRGEKTNWVMHEYRIHSKSAFRTSKDEWVVCRVFQKSAAGKKYPSNQSRGMNPYSLDIGPSVMPPPMLQADSSQFPMGRNYVSNAELAELTRVLRGGSTGGLNLPIQSQLNYPLGGGCFTISGLNLNLGGTSTQPVLRPNSLPQPMQMNQQDHMMTSPMLTSGSIPTDQTGYGAEVNNGNGHNSRFMNMVDHCVDLDNYWPPY

SEQ ID NO: 2881 - protein, 85 aa, Zuloagaea bulbosa
ECQKVGAPPEVSARLTAMAQELEARQRTALGGLGAATEPGLDQFMEAYHEMLVKFREELTRPLQEAMEFTRRVETQLNSLSISGR

SEQ ID NO: 2882 - protein, 257 aa, Zea mays
MDSNRSMATSGVAPFVAKTYRMVDDPATDGVVAWGRDNNSFVVADPFALSQTLLPAHFKHSNFSSFVRQLNTYGFRKVDPDRWEFAHVSFLRGQTHLLGQIVRRSSGGKRKDDGNGAGAGSADDEDAVAMEVVRLRREQRAIEEQVAAMWRRVQETERRPKQMLAFLVKVAGDPQVLRRLVSGAGGDAVFAAAEPEDGASIKRARLLLDAGSGGDGAVDFSGLYSTTAGSEDDGVGFGSDYLQPPPPYVFPVNSGGY

SEQ ID NO: 2883 - protein, 85 aa, Zuloagaea bulbosa
ECQKVGAPPEVSARLTVMAQELEARQRTALGGLGAATEPELDQFMEAYHEMLVKFREELTRPLQEAMEFTRRVETQLNSLSISGR

SEQ ID NO: 2884 - protein, 562 aa, Brassica napus
MESFCDNDDNDHSNTTNLLGFSLSSNMLKIGGSEGEALYSSSSSSVATCSVPPQLVVGDNSSSYGVCYGSNSAAGDIYSQMSVMPLRSDGSLCLMEALNRSSYSNHHHHTQVSSPKIEDFFGTLHSNTNHKETMDLSLDSLFYNTTHEADNNTNFQEFFSFPQTRNHHEEESRNYESVPGLTHGRGPFNVGVYGEFQQSLSLSMSPGSQSSCITGPHHHQNQNHQGHNQTQNHHQISEALVETNVGFETTTMAAARKKKRGQEEVVVVGQKQQTVHRKSIDTFGQRTSQYRGVTRHRWTGRYEAHLWDNSFKKEGHSRKGRQVYLGGYDMEEKVARAYDLAALKYWGPSTHTNSSVEIYQKEIEDMKNMTRQEHVAHLRRRSSGFSRGASIYRGVTRHHQHGRWQARIGRVAGNKDLYPGTFGTQEEAGEAYDVAAIKFRGTNAVTNFDITRYDVDRIMSSNTLLSGELARRNSNSIVVRNNNDEETALNAVLDGGSNKKVSGPERVLGFPGNFSLPQDGPKMFGANVVGNMSSWTTNPNAELKAVSITLPQMPVFAAWADS

SEQ ID NO: 2885 - protein, 238 aa, Picea glauca
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPSVKTEVCSGLRNQFEFHREQTGNCYTDQSSNAPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 2886 - protein, 252 aa, Malus x domestica
MCGGAIISDFIAVKRALKLTAEDLWSDLDTISDLLGIDYSNSINKQPENHKVVQKPKPSITKVVTSDEKPKQASGSAAAAKGKRVRKNVYRGIRQRPWGKWAAEIRDPYKAVRVWLGTYDTAEEAARAYDEAAVRIRGDKAKLNFAQPPSSSPLPSLAPDTPPPTKRRCIVAESTRVEPTQPSFQTGSYYYDPLYHGGGGGEMYAKKEVAGGDEVVVEQLSQVVSGSGESDSLYLWMLDDLVAYQQQGQLLY

SEQ ID NO: 2887 - protein, 435 aa, Arabidopsis thaliana
  misc_feature (302)..(302): Xaa can be any naturally occurring amino acid
MDNEDECTYGGEGGQTSADTSQSKSLVSASRFKRSRTSDMWDYFTLEDENNLVIFPPKKRNLVIFPPKKHDPVIFPSQNCLFDPLRTLFFFSLQGNAEEVRIKQVLHIEDLMSYRLLSVDKDELVTSPCLKERNYLGLSDCSSVDSSTIPNVVGKSNLNFKATELRLGLPESQSPERETDFGLLSPRTPDEKLLFPLLPSKDNGSATTGHKNVVSGNKRGFADTWDEFSGVKGSVRPGGGINMMLSPKVKDVSKSIQEERSHAKGGLNNAPAAKAQVVGWPPIRSYRKNTMASSTSKNTDEXVDWGNLGLWVFWFVKVSMDGAPYLRKVDLRTYTSYQQLSSALEKMFSCFTLGQCGLHGAQGRERMSEIKLKDLLHGSEFVLTYEDKDGDWMLVGDVPWEIFTETCQKLKIMKGSDSIGLAPGAVEKSKNKERV

SEQ ID NO: 2888 - protein, 363 aa, Oryza sativa Indica Group
MAAIDLYKYQLSSSSSSSSSDQELMKALEPFIRSASPTSTNTSTSTSTPLFYSSSSISTTTTTPFSYSSPLPQESYYLPASSSYAAIVPPPTTTTNTTTSFSELPPLPPSSSSFASPANAAAVGLAHLGPEQIQQIQVQFLMQQQLQQRGMAASASASAAASYLGPRAQPMKQAGAAAAAAGGKMYRGVRQRHWGKWVAEIRLPKNRTRLWLGTFDTAEDAALAYDKAAFRLRGDAARLNFPTLRRGGAHLAGPLHASIDAKLTAICHSLAAAPPASSKKAAAAAAHPDSPKGSASTTTTTSEGDESAISACSPPLPPPPPPPPPALPEMANLDFTEAPWDESDAFHLYKCPSWEIDWDSILS

SEQ ID NO: 2889 - protein, 70 aa, Zea mays
LGFQKAWPLIIDDGLGASFVAPAFDSLEDASPLPLEEYQRGWEQNEELGLNDMDTSSADGAFNPANPKFF

SEQ ID NO: 2890 - protein, 305 aa, Zea mays
MVRTTVVGRERSGGVRQYNRSKVPRLRWTPDLHHCFVHAIHKLGGPDRATPKRVLQLMGVGGLTISHVKSHLQMYRNMRNDLGMQGTEDQEHVYVGGGGMHTNIQQQRDHGCGDAPCCICCRHSPNKPAKEEEEATLFQRQLKRSRTETRRGRGQREEIDDGSASPKRRLLLLRGGRGRPGICESDGSGSPSSGTLASGYDNYMRMMQAAMGQHLARPGADGGEHAPPSSRQLFTFLGFVVAPGPPPPPCCSRDHPFEMVGTALTHRSLQTPPTKAAVAQQVGGDPCWSSAAALEYPSRGPSLRV

SEQ ID NO: 2891 - protein, 502 aa, Medicago sativa
MDGASGASGGGEGSTTQIPAPTPMQNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPMSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 2892 - protein, 219 aa, Ageratina adenophora
MATLIPFNTPYTSLSADNIPTTESSSTSDYSTGTSFSDEEVMLASKNPKKRAGRKKFRETRHPVYRGVRRRDSGKWVCEVREPNKKTRVWLGTYPTADMAARAHDVAALAMRGRSACLNFADSLWRLPIPESSNVKDIQKAAVKAAEAFRPTETDVAVIEESNELTGNVFCVDDESIFEMQGFLADMAEGMMLPPPRTIEYDNCQDDLEFFVDASLWSF

SEQ ID NO: 2893 - protein, 245 aa, Zea mays
MVTVREETRKGPWTEQEDLQLVCTVRLFGERRWDFIAKVSGLNRTGKSCRLRWVNYLHPGLKRGRMSPHEERLILELHARWGNRWSRIARRLPGRTDNEIKNYWRTHMRKKAQERKRNMSPSSSSSSLTYQSGYPDTPSTIGVEGQELHGGSGCITSILKGTPPDMDGYPMDQIWMEIEAPQMPSEESFVGGNHNVCSSLATPLPPPTVWEYYPEACWKVDDEIKMAPQFQFGYSEGVGPLLLMP

SEQ ID NO: 2894 - protein, 315 aa, Saintpaulia velutina
MFGKNSYLHPPQVSRPLQTRGPTSSVDLSDGAEILLHHHQDDVLSGHYLAENTPFLGVSTLYSQDLGVGSEDPSSLTNTLSRRQVVKKDRHSKIVTSQGPRDRRVRLSIGIARKFFDLQEMLGFDKPSKTLEWLLTKSKVAIKDLVLAKKSSSSRSTSSPSECEVVLNGETFEDGSCLLPPDSKRKSASTARDPAQSASTLAKESRAKARARARERTKEKLCIKKLNESRNMNNNLFASNSQPVLHCPITNEATATQQDLIQESSVIKRMLRHHQSFFGFHCAALPSPGVDENWDAGSLTSQSNLCDILDQHKFI

SEQ ID NO: 2895 - protein, 319 aa, Saintpaulia velutina
MFGKNSYLHPPQVSQPLQTRGPTSSIDLIDEAEILLHHHHQDGVLASHYLATNTPFLGVSTLYSQDASEGTEDPSALANALSRRQTVKKDRHSKIVTSQGPRDRRVRLSIGVARKFFDLQEMLGFDKPSKTLDWLLTKSKVAIKDLVLTKKSSSSRSTSSPSECEVVLNGEAFQDGNCLRHPDSRKSSSKNANKCKDPAQSASNLAKESRAKARARARERTKEKMCIKKLNESRNMDNNLFASNSRPVLQCPITNEATATHEDLIQESSVIKRMLRHHQSSFFGYHCGLPSPNVNENWDVGSLTSQSNLCDILDQHKFI

SEQ ID NO: 2896 - protein, 238 aa, Triticum aestivum
  misc_feature (110)..(110): Xaa can be any naturally occurring amino acid
  misc_feature (133)..(133): Xaa can be any naturally occurring amino acid
MAPRTSDKTATPPAAGAAATGLALGVGGGNGGGVGPHYRGVRKRPWGRYAAEIRDPAKKSRVWLGTYDTAEEAARAYDAAAREYRGNKAKTNFPFAPASAPPAAAAALTXGTAAGSSNSSTVESFGGDVQGPXWQAMPLPPSLDLDLFHRAATSTAGAGMRFPFSGYPVSHPYYFFGQAAAAAAAGCHMYSQAPKVTVASVSPSDSDSSSVVDLAPSPPTRKPVPFDLDLNCPPPAEL

SEQ ID NO: 2897 - protein, 85 aa, Setaria verticillata
ECQKVGAPPEVSARLTAMAQELEARQRTALGGLGASTEPELDQFMEAYHEMLVKFREELTRPLQEAMEFMRRVESQLNSLSISGR

SEQ ID NO: 2898 - protein, 133 aa, Oryza sativa
  misc_feature (55)..(55): Xaa can be any naturally occurring amino acid
  misc_feature (66)..(66): Xaa can be any naturally occurring amino acid
  misc_feature (88)..(88): Xaa can be any naturally occurring amino acid
MAGAIHRSKEVFLSDHYDSQSADTIEGKCYAHTFRDYTKLRSVSAEDFFRRFEYXSGTGSFVAERXIVFCKCEMPYNPDKLMIPCEDXCSDWVPPSCVEITLQEAQKLEPFYCESCVAAHGQGPQSSKGVLAN

SEQ ID NO: 2899 - protein, 406 aa, Populus trichocarpa
MGSLSSELSLDFARPSTAKALPFLPKTIADFLKEVSVIGDSAVKVLKVDGFIKDLEEEKRKIDAFKRELPLCMLLLNDAIQVLREELMQLGASKNQQPVLEEFIPLKKNIDDHHENDGLIEEKDSKDKKNWMSSVQLWNADDHHPSTDYLFDPKQNLKLESKTNKKGNQYGNEDAFQAGIGRTAARTFMPFKACSGLSSKEEKLPVPSLSLSTPGIKSLKEESNSTGSRSSCSRSVSTISGPNSDSNLRNGPQSQQQTARKQRRCWSPELHRRFVNALQQLGGSQAATPKQIRELMQVDGLTNDEVKSHLQKYRLHTRRVTPATAAAPANQSVVVLGGLWMTQDQYGDSSKATSSQSGSPQGPLQLAVNTGGTSTTGGDSMEDDEDAKSEGYSWKSHSHRSGKDDV

SEQ ID NO: 2900 - protein, 412 aa, Malus x domestica
MTAPNGAVPKQADDRPGTEAELNEGAVPNGKVRGPWSPEEDAVLSRLVSNFGARNWSLIARGIPGRSGKSCRLRWCNQLDPCVKRKPFSEEEDRIIVSAHAIHGNKWAVIAKLLPGRTDNGIKNHWNSTLRRKCFDKGRFNTGPGEMMEDDTFDRKNASSEETLSVGNISSFKTHEGREVLMENRPNQFDVRSHAKEGSGAAESKHNSTLIAEPRDHPTLQSTICCPVARVSAFSVYNRPSVPANASSLSRTVPSHGPLVPITKLDFGFDNFLEGACNEPTVPQRCGHGCCDRIEGHSQSSLLGPEFVEYDEPLPFSSHELISIATDLNKIAWIKGGLESNGIRMPEHVASQRVFQAAATTLQMGLPANTPMNDHMRFEEGRNKLMGMMTDVLSTQVPRQTFAMPTEVEGLS

SEQ ID NO: 2901 - protein, 207 aa, Olimarabidopsis pumila
MATFEDGSDLEAIQKHLFEDLLVCDGFMGDFDFDASFVSGLWCIEPQVPKQEPDSPVLDPDSFVNEFLQVEAESSPSSPELNTSPLSTYETDQSVKKAERFEEEEEARHYRGVRRRPWGKFAAEIRDPAKKGSRIWLGTFESDVDAARAYDCAAFKLRGRKAVLNFPLDAGKYEAPANSGRKRKRSDVQEELQRTQSNSSSSSCDAF

SEQ ID NO: 2902 - protein, 228 aa, Arabidopsis thaliana
MPKQKAPRKQLKSYKLKHINKSIQEGDAVLMRSSEPGKPSYVARVEAIETDARGSHAKVRVRWYYRPEESIGGRRQFHGAKEVFLSDHFDFQSADTIEGKCKVHSFTSYTKLDSVGNDDFFCRFEYNSTTGAFDPDRVTVFCKCEMPYNPDDLMVQCEECSEWFHPSCIGTTIEEAKKPDNFYCEECSPQQQNLHNSNSTSNNRDAKVNGKRSLEVTKSKNKHTKRPG

SEQ ID NO: 2903 - protein, 502 aa, Medicago sativa
MDGASGGSGGGEGSTTQIPAPTPMQNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPVSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 2904 - protein, 66 aa, Physcomitrella patens subsp. patens
MHYRGVRQRPWGKFAAEIRDSSRQGSRLWLGTFDTAEEAALAYDDAALRLRGSRALLNFPLRAASG

SEQ ID NO: 2905 - protein, 502 aa, Medicago sativa
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPVSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 2906 - protein, 324 aa, Solanum tuberosum
MVFSSFPVYLDHPNLHQLQQPDGHQQGNTGLENPTLQPPPMQVGASPGSIRPGSMVDRARLAKIPLPEAGLKCPRCDSTNTKFCYFNNYNLSQPRHFCKTCRRYWTRGGALRSVPVGGGCRRNKRSKSNNNNNSSKTAGSNVNTNTIASGTSTSASPSSCSTEIMNGRHHFSHEQPPQLTPLMAAFQNLNHHYGGFQPPPLVSTHHGNGTGALGHHHEMGFQIGSSTNTNNLPVPPGGGSDHQWRLPSLAANTNLYPFQHGTDQGIHESSSVNNNNINAHDDQGLNSTKQFLGTMENNTNQYWGGNAWTGFSGLNSSSSASHLL

SEQ ID NO: 2907 - protein, 2137 aa, Arabidopsis thaliana
MMKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEFSRPLFSPRRRPHAGGRKFLPALMPKKKKKPIRGAVPGSSKFAAVYARAVAPLVSKSRVVAARSREESASRPHPSLVSDLSLTPVSDLVLTPDPQSAASAPVPTVDGSASGVATSVNSEANSALSSASLDQSTVNETDLVSSSQVGVIAQLPPKSVLSSPLPAEQGITVGTSPVEAPVIGSQPVSSGSALWVDRVKGSAKKLAKKGSSFTLPSGELCVKIPNSVIERNKKSWDFFILGQFYSDPPAQGTIHNIANGIWSRQFRDISVSKMEGNSFLFRIPNANTRNRVLTQRLWLIEGQTMFVEKWEPGVIPVKPELSSAPIWLELRNVPYQFFHEEGLERIASLVGEPKFLHPSTANKTNLVVAKVFTIIDPRKPLPEAVNVQFDTGEIRRVLVSSPWMPPVCAHCKEIGHSLRHCRQAPVLCSNCSSTTHLTGSCPNLTEPGLKKRRNQRRRRSKTPVQIPVSSKEPSKSTIASGQEWQVKSITETPSKPGPEETVSLASAKLGAVPKEVSIGESSKSDPSSALSMTALVASSSLPSMSANETEDDSSDVLSSDEDVARFTQWVKANKPIFGGVIETHVKQPKDRKFINALLPGWSFVENYAFSDLGKIWVMWDPSVQVVVVAKSLQMITCEVLLPGSPSWIIVSVVYAANEVASRKELWIEIVNMVVSGIIGDRPWLVLGDFNQVLNPQEHSNPVSLNVDINMRDFRDCLLAAELSDLRYKGNTFTWWNKSHTTPVAKKIDRILVNDSWNALFPSSLGIFGSLDFSDHVSCGVVLEETSIKAKRPFKFFNYLLKNLDFLNLVRDNWFTLNVVGSSMFRVSKKLKALKKPIKDFSRLNYSELEKRTKEAHDFLIGCQDRTLADPTPINASFELEAERKWHILTAAEESFFRQKSRISWFAEGDGNTKYFHRMADARNSSNSISALYDGNGKLVDSQEGILDLCASYFGSLLGDEVDPYLMEQNDMNLLLSYRCSPAQVCELESTFSNEDIRAALFSLPRNKSCGPDGFTAEFFIDSWSIVGAEVTDAIKEFFSSGCLLKQWNATTIVLIPKIVNPTCTSDFRPISCLNTLYKVIARLLTDRLQRLLSGVISSAQSAFLPGRSLAENVLLATDLVHGYNWSNISPRGMLKVDLKKAFDSVRWEFVIAALRALAIPEKFINWISQCISTPTFTVSINGGNGGFFKSTKGLRQGDPLSPYLFVLAMEAFSNLLHSRYESGLIHYHPKASNLSISHLMFADDVMIFFDGGSFSLHGICETLDDFASWSGLKVNKDKSHLYLAGLNQLESNANAAYGFPIGTLPIRYLGLPLMNRKLRIAEYEPLLEKITARFRSWVNKCLSFAGRIQLISSVIFGSINFWMSTFLLPKGCIKRIESLCSRFLWSGNIEQAKGIKVSWAALCLPKSEGGLGLRRLLEWNKTLSMRLIWRLFVAKDSLWADWQHLHHLSRGSFWAVEGGQSDSWTWKRLLSLRPLAHQFLVCKVGNGLKADYWYDNWTSLGPLFRIIGDIGPSSLRVPLLAKVASAFSEDGWRLPVSRSAPAKGIHDHLCTVPVPSTAQEDVDRYEWSVNGFLCQGFSAAKTWEAIRPKATVKSWASSIWFKGAVPKYAFNMWVSHLNRLLTRQRLASWGHIQSDACVLCSFASESRDHLLLICEFSAQVWRLVFRRICPRQRLFSSWSELLSWVRQSSPEAPPLLRKIVSQVVVYNLWRQRNNLLHNSLRLAPAVIFKLVDREIRNIISSRRLRKRWRKLMLLWIR

SEQ ID NO: 2908 - protein, 502 aa, Medicago sativa
MDGASGASGGGEGSTTQIPAPTPMQNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPVSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 2909 - protein, 561 aa, Medicago sativa
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPIMKWDTPRVESFNKNPDNYLIGDGTSPSSAMDSSSSTSWNSGVTLQEVPPSSVQSTQIPMSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 2910 - protein, 347 aa, Zea mays
  misc_feature (260)..(260): Xaa can be any naturally occurring amino acid
MGAMTLPPGFRFHPTDDELVGYYLKRKVDNLKIDLEVIPVVHLYKSEPWELPEKSLLPRRDLEWFFFCPRDRKYPNGSRTNRATSTGYWKATGKDRRIACDGGVYGLRKTLVFYRGRAPGGERTAWVMHEYRLCQDLAHGTCNFIGAYALCRVIKRHEGGLPQGESYAKGAAGSARSGQMSKVSSSSSLVSNDQLSASFTPPPTLDVGTMAGSGNAFQSPVGYGYGVTTTATATATTAGLPSSALATPLLIVPSPHDTFXSAATATSSPPRPSRARSHAHLFDTVGMGMGGVSEQELKWDSFACPSTFSSGADMAAASPATLCRQASDGFDDLLAAFFFSDDNRIVF

SEQ ID NO: 2911 - protein, 330 aa, Arabidopsis thaliana
MADTSSRTDVSTDGDTDHRDLGSDRGHMHAAASDSSDRSKDKLDQKTLRRLAQNREAARKSRLRKKAYVQQLENSRLKLTQLEQELQRARQQGVFILSSGDQAHSTGGNGALAFDAEHSRWLEEKNRQMNELRSALNAHAGDTELRIIVDGVMAHYEELFRIKSNAAKNDVFHLLSGMWKTPAERCFLWLGGFRSSELLKLLANQLEHMTERQVMGINSLQQTSQQAEDALSQGMESLQQSLADTLSSGTLGSSSSDNVASYMGQMAMAMGQLGTLEGFIRQADNLRLQTLQQMLRVLTTRQSARALLAIHDYSSRLRALSSLWLARPRE

SEQ ID NO: 2912 - protein, 739 aa, Solanum lycopersicum
MGGFDDHVAIMGDWMPPSPSPRTFFSSLLGDDGGSRLSFDGTNETSGNLASGPQEHVGNSDGVDTAPAAISEPQPVKLSVPSDQKMNSRGGGLLERIAARAGFNAPKLNTESLRPADLRQNQGVRSPYLTIPPGLSPTTLLESPVFLSNSLVQPSPTTGKFLFSSGIDNRNSALMMEDTDKRKDNALESINSSSFSFKPVPETAPSLFPGTTSRSWLQVNPSNFSQQGFPNIEVSVHSQNSLVSHRVEATQNPTQNGTLQQSSDFPRFSAEKDVMANNVTLDSRTFQTVGSAVDHSPPLDEPQDEDIDQRGGGDPNVAGAPAEDGYNWRKYGQKQVKGSEYPRSYYKCTHPTCPVKKKVERSPEGHITEIIYKGAHNHPKPPPNRRSALGSTNSLGDLQVDGAEQGASGVNGDLGQANFHKAPGGGGGFDWRNNNLDANLGSEHCNRSAPFSAQNNTRLESGDAVDVSSNFSNDEDEDDRGTHGSVSQGYEGEGDESESKRRKLETYSADMTGATRAIREPRVVVQTTSEVDILDDGYRWRKYGQKVVKGNPNPRSYYKCTSAGCNVRKHVERASHDLKSAITTYEGKHNHDVPAARNSSHVNSGASNTHPASVTAPAQNHLHRPEAAQLQNAMARFDRQPSLGSFGLSGRPPQLGPNPGFSYGMNQQGGLSSLAMAGFHPNQNKPGEVPMHPYLGQPRPMHDMGFMFPKEEPKVEPLSDPGPTAYQQFLNSLLLGPQM

SEQ ID NO: 2913 - protein, 269 aa, Oryza sativa Japonica Group
MPPPSPHPPHRNGNHVPAPSGESFAKFFECWISEQSRDLAALRSAASAATNPAAPPDDAELHRLVNRVLGHYEHYYRTKSAAASTDVLRMFSPSWTSTTENLYLWCGGWRPTAALHLLYSKSGAQLETQLPVFLAGGGLGAGDLGDLSAEQLQAADQLQRITVSKEREIENAAASAQESLATVKMVELAGGGGMDAEGMEMEMRSKADGMRRVLEMADGLRLETMREVVALLRPSQAVHFLIAAAELHLAVHEFGRRKDGDGAASPPPA

SEQ ID NO: 2914 - protein, 136 aa, Brassica napus
  misc_feature (108)..(108): Xaa can be any naturally occurring amino acid
KVSNMTLAVTARGRTLWSRAILSKAVKVKLKFRKHNRLRTSNPPPTVVSITGNSRLKKKRATVLRLKGNGFTAVQRKVKLLSRLIPGCRKQPLPVVLEETTDYIVCNXCRILALNAIISAVGSSSAVPETGNDGEE

SEQ ID NO: 2915 - protein, 407 aa, Brassica rapa
MVEVEELEPLTPVEEEEEEVISYDDLKRRMWKDRNLMEKLKQQKRHSNDVVSLASHRAEASRRKKMARSQDSRKGFVYGIVPDKGKPITGSSDSLRRWWKETVQFDQTAPNAVSDYLTIAAAAAAEMIEKEPSSLLHMLQELQDTTLGSLLSALMQHCVPPQRRFPLEKGIAPPWWPTGTELWWGEQGEAHEHGVPPYRKPHDLRKSWKVSVLAAVIKHMSPDLGRVRRLATQSKCLQDKMMAKETDTWSRVLNQEEALLNIKDRKISDQDQEASGSKTKRKCDFMEPSKRPRSDVTQEPRQITGDMISMLVTSPSIGTNTTSEDDYSVSSSAMGKPDDYDSNWMDYLWFERMQPEFNSSRRFDDDEDNPMVLNQSTESNQSDNVSQSIFSVWDMGCEDKDIYMFDY

SEQ ID NO: 2916 - protein, 452 aa, Oryza sativa
MSCSSEKAAGAVGGKAARACDSCLRRRARWYCAADDAFLCQGCDTSVHSANPLARRHERLRLRVSSPPPVTARASVEEEAAAAVGTTTTTTSKREGGVSPAWSKRKARTRRPQVKSVGQLLSRRLVVPEMAVESSDERKADEDGAHEELEGQLLYRVPVFDPSLAEFCSPPPIDDAAAASSSCFKEDAADGAVEDAKYPAAAASSPVQQLPDSFVNFEPTDAELREFAADMEALLGQGLDDSNELQDSFYMETLGLITPPVEESGRVKMELDGGVASNSRVSLPSCRAHPKPEDVESADVLDIDFNCTSPDEQKSSASNGAAADSQFFHRSLDLRLNYEAIIESWGNSPWTDGRPPHGQLDDFWPNDHHYSGLWAAGGGGHGAELGMMTVRPRMDGPGREARVTRYREKRRTRLFSKKIRYEVRKLNAEKRPRMKGRFVKRPSAAAAPCAVT

SEQ ID NO: 2917 - protein, 113 aa, Pelargonium zonale
WSKYGQKMAKGNPCPRAYYRCTMAAGCPVRKQVQRCAEDRTILITTYEGNHNHPLPPAAMAMASTTSSAARMLLSGSMPSADGIMNSNFLTRTLLPCSSSMATISASAPFPTV

SEQ ID NO: 2918 - protein, 267 aa, Oryza sativa
  misc_feature (222)..(222): Xaa can be any naturally occurring amino acid
  misc_feature (229)..(229): Xaa can be any naturally occurring amino acid
MGLPEQPSGSSGPKAELPVAKEPEASPTGGAAADHADENNESGGGEPREGAVVAAPRRRPRGRPPGSKNKPKPPIFVTRDSPNALRSHVMEVAGGADVADAIAQFSRRRQRGVCVLSGAGTVANVALRQPSAPGAVVALHGRFEILSLTGTFLPGPAPPGSTGLTVYLAGGQGQVVGGSVVGSLIAAGPVMVIASTFANATYERLPLEEEEEGSGPPMPGGXAEPLMAXGHGIADPSALPMFNLPPSNGLGGGGDGFPWAAHPRPPY

SEQ ID NO: 2919 - protein, 384 aa, Brassica rapa
MELKEGSNQISEIEEGENKRDRYKRSANMRRSPCSDDSGLKKGPWTPEEDEKLVNYIQKHGHSSWTALPKRAGLNRCGKSCRLRWTNYLRPDIKRGRFSPEEEQTILNLHAVVGNNQRFCVPVLLAYVDNVIRWSTIANNLPGRTDNEIKNFWNTHLKKKLIQMGVDPMTHRPRPDIFSSLSQLVSMSSNLRGFVDMQLQFQTDQEQTILKLQTEMAKLKLLHDLLQPPSMNNNTNPNDFDTRSLLHSIASLKETYTTSNNPDLGPYLQDFSSIPSLETLNTNMVPSSISPRDLEDSHFKFFSQRDNLPVSPVWLSDPSSSNQSLLPSLDHSSVVSGDLIRNQYIIEDVNSNLMTSSSGQESGASASPVWPDHLLDDSIFSNIL

SEQ ID NO: 2920 - protein, 739 aa, Solanum lycopersicum
MGGFDDHVAIMGDWMPPSPSPRTFFSSLLGDDGGSRLSFDGTNETSGNLASGPQEHVGNSDGVDTAPAAISEPQPVKLSVPSDQKMNSRGGGLLERIAARAGFNAPKLNTESLRPADLRQNQGVRSPYLTIPPGLSPTTLLESPVFLSNSLVQPSPTTGKFLFSSGIDNRNSALMMEDTDKRKDNALESINSSSFSFKPVPETAPSLFPGTTSRSWLQVNPSNFSQQGFPNIEVSVHSQNSLVSHRVEATQNPTQNGTLQQSSDFPRFSAEKDVMANNVTLDSRTFQTVGSAVDHSPPLDEPQDEDIDQRGGGDPNVAGAPAEDGYNWRKYGQKQVKGSEYPRSYYKCTHPTCPVKKKVERSPEGHITEIIYKGAHNHPKPPPNRRSALGSTNSLGDLQVDGAEQGASGVNGDLGQANFHKAPGGGGGFDWRNNNRDANLGSEHCNRSAPFSAQNNTRLESGDAVDVSSNFSNDEDEDDRGTHGSVSQGYEGEGDESESKRRKLETYSADMTGATRAIREPRVVVQTTSEVDILDDGYRWRKYGQKVVKGNPNPRSYYKCTSAGCNVRKHVERASHDLKSVITTYEGKHNHDVPAARNSSHVNSGASNTHPASVTAPAQNHLHRPEAAQLQNAMARFDRQPSLGSFGLSGRPPQLGPNPGFSYGMNQQGGLSSLAMAGFHPNQNKPGEVPMHPYLGQPRPMHDMGFMFPKEEPKVEPLSDPGPTAYQQFLNSLSLGPQM

SEQ ID NO: 2921 - protein, 657 aa, Arabidopsis thaliana
MEDDGGSDGGEGNGGFSPNSSFGAFADTAMDLDFMDELLFDGCWLETTDSKSLKQTEQSPSASTAMNDNSPFLCFGENPSQDNFSNEETERMFPQAEKFLLEEAEVGKSWWIAPSASEGPSSSVKERLLQAISGLNEAVQDKDFLVQIWVPIQQEGKSFLTTWAQPHLFNQEYSSLAEYRHVSETYNFPADEGMKDFVGLPGRVFLQKFPEWTPDVRFFRRDEYPRIKEAQKCDVRGSLALPVFERGSGTCLGVVEIVTTTQKMNYRQELEKMCKALEAVDLRSSSNLNTPSSEFLQVYSDFYCAALPEIKDFLATICRSYDFPLALSWAPCARQGKVGSRHSDENFSECVSTIDSACSVPDEQSKSFWEACSEHHLLQGEGIVGKAFEATKLFFVPEVATFSKTNYPLAHHAKISGLHAALAVPLKSKSGLVEFVLEFFFPKACLDTEAQQEMLKSLCVTLQQDFRSSNLFIKDLELEVVLPVRETMLFSENLLCGAETVESLTEIQMQESSWIAHMIKANEKGKDVSLSWEYQKEDPKELSSGRENSQLDPVPNNVPLEAEQLQQASTPGLRVDIGPSTESASTGGGNMLSSRRPGEKKRAKTEKTIGLEVLRQYFAGSLKDAAKSIGGKRMLYTAGDIAPFFMNFDSYCFLGKA

SEQ ID NO: 2922 - protein, 812 aa, Magnaporthe grisea 70-15
MFASMSPPNPRKRAAPGAIPAVQIPTTVQQYQSPYATPLDQVSRWNGAEVYATDPITPGPKNIPQFNMTEPHSSYPNATTHQSYQHQAIATPGPTNAIARRPAGSSRALVTRQQYDGLSTEPWPSFSDETALMPASGVVNPLDENDNIALLEERAARAKRDAQANRKQIPPFVQKLGSFLNEEKNTDLIRWSQKGDSFIVLDEDEFAKTLIPELFKHNNYASFVRQLNMYGFHKRVGLSDNSMKASERKNKSPSEYYNPYFQRGHPNLLWLINKPKSGNSKKRSAKNNDGAEVESDEDATPTVEDINGAGYVGAAQNSSRSGGPAQGDPGSQALQKKDFQVVKDQLNQLQTQQRAISNMIQRLRSDHTALYNQALAFQNMHERHENSINAILNFLANVFRKSLEEQGGNSNHTMQDLLASIIPNGGSGSQMHKGSVVDLGDFVQQQSVDHSNVADNTPKRGQRLLLPSRGGRASATSTAAKSPSASYATSPRGQMGSVTELFDNSPNEVTSPPDYLSNDLRQSPQQMMRIIDATNAAGATADIDLPDIAAKTPVTLSSDQRNQMLNLMASQATAPQSTSSIPATASPLPATTTATSPQPIPAMQQRQQQHRATPPPVPAQAASGMVSSPVNSALGASPPRSLSPLMSSMPPPPSLHDITMTQEELDSLQRLQDEQKHKIDEISHFLAPLSPSGRVPGVDEAGNPTTVSPEASGSYFPDMTDNMDIEQFLDSSAFGAFDASGTGGSADDFNFSLDANYDGSTPVAAYSLAAPITESHSNTPSSAATEEYVIRKDFAENDGSAVGPDAKRRRMG

SEQ ID NO: 2923 - protein, 233 aa, Allium sp. AL-2003
VQLKRMENKINRQVTFSKRRNGLLKKAHEISVLCDAEVALIVFSAKGKLYEYSTDSSMEKILERYERYCFAEKSSTMSDIDSQEDWSLEYHKLKAKVESLNNRQRHLMGEQLESLSLREIGQLEQQLENSLKTVRTRKSQELLSSISELQDKEKTLRDENKALENELMKRARAKAILEQQARWKHHNHKQQDNLHNPNINIGNYQTRNNEGGVEPATDVQVRVVRNLLPHWML

SEQ ID NO: 2924 - protein, 256 aa, Brassica oleracea var. italica
MGRGRVQLKRIENKINRQVTFSKRRAGLFKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRSRKNQLMYDSVNELQRKEKAIQEQNSMLSKQIKEREKVLMAQQEQWDQQNHGQNMPSPPPPQQHQIQHPYMLSHQPSPFLNMGGLYQEEDPMAMRRNDLDLSLEPVYNCNLGCFAA

SEQ ID NO: 2925 - protein, 181 aa, Brassica napus
CFCQDIASKVLSFSQQGPRATCVLSVSGAASTATILQPSPSNGAIKYEGRFELLSLSISYLNATDNDYSNRTGNLSVSLASPDGRVFGGGIGGPLIAASPVQVIVGSFLWAVPKGKVKKRDEASEDVQDTDGLEKNDHNTAPTSPPQQSQNLDQTRRPTRPTGSRSMDMHHAHMDIDLMRG

SEQ ID NO: 2926 - protein, 330 aa, Ostreococcus tauri
MRSDFRERGQDGIYVRGDDISPTASREFSIAPELEPELKDFIDEEMFRLFAVVEKRNVRSTSSMRGAHIWESGKQVYLGGFDSEEQAALAYDVIAVKCRGIKAQTNFDMRNYAQELANLDGIEKDDLVLSLRRQSKGHAKGSSKFRGARIGQMVGKKYRYLGLFDTESEAAVAYDIACVREKGLQAVTNFDISEYSDVLAQHYNGGTTSSKRKRHYSASATPVESKICEKNFRDELAGTHIDISSRALKPGRAIERDPSDKAVDLVRHFFDTESKHHANTAIECRPDSELEDREHADDAIEELQALVSQAQTALRDSKARLREARAQRKS

SEQ ID NO: 2927 - protein, 384 aa, Glycine max; identical to SEQ ID NO: 224

SEQ ID NO: 2928 - protein, 690 aa, Marchantia polymorpha
MKFRGRDAMTNFRPVQVTDPEAVFLLEQSKRQASMRVTSPQTPAGMVPNPPNESDDPPSLPPKPTMQREHLFEKAVTPSDVGKLNRLVIPKQHAERCFPLDLALNVPCQTLSFEDVSGKHWRFRYSYWNSSQSYVFTKSWSCFLKGKKLEAGDTVSFERGPNQELYIDFRRRLNNQVAQMLPGPSTSASDFARNREHLFEKAVTPSDVGKLNRLVIPKQHAERCFPLDLALNAPCQTLSFEDVSGKHWRFRYSYWNSSQSYVFTKGWSCFLKGKKLEAGDTVSFERGPNQELYIDFRRRLNNQVAQMLPGPSTSASDFARNRPWVPRLPNPAGGLNPAVWHQLSLQNPQSSLESREQLQMLYVRQAFPQRQQQQHMESGVSLPHQTRTGDDFFSLLTHGRVAAMDRTVVGASTTVVKQQQLLAEGPVSTPSAAPAGASGGTRLFGVDLENTSSSSAQGSTEREYAVVSGLNDWKSQTYAQQLQSLSRASYHQGESSFQQQQQQQHLPTARILPSFQGSLHGQSPAPVLMAASAKQQQQQQEQSPFMGLSIVRGRAGEQSLGTRLAASHSDLQLASSTNMNSGSAARAAGAGAELQEAGARTVVALGLAGPQQFAGDSRKRKVGILECLKNSGTADSYARVGAPDTSLSLAQHSESTTQVSFTTESSHFSSSTQPSGSSSTAEDRELKSPK

SEQ ID NO: 2929 - protein, 679 aa, Glycine max
HASADECLPPLDMSKQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAILTGTMFTVYYKPRTSPAEFIVPYDQYMESLKNNYTIGMRFKMRFEGEEAPEQRFTGTIVGIEDADTKRWPKSKWRSLKVRWDETSNIPRPERVSQWKIEPALAPLALNPLPMPRPKRPRSNVVPSSPDSSVLTREASKVSVDPLPTSGFQRVLQGQELSTLRGNFAESNESDTAEKSGVWPPATDDEKIDVSTSRRYGSDSWMSMGRHEPTYPDLLSGFGAHGDHSSHPSFVDQNGPVANLSRKHLLDREGKHNVLSPWPGVPSSLSLNLLDSNLKGSAQGGDTAYQVRGNLRYSSAFGEYPVLHGHKVEHSHRSFLMPPPPSTQYESPRSRELLSKPISGKPCEVSKLKDSDCKLFGISLLSSRPIASEPSLSQRNVTSESVGHMHTASHHQRAIENDQKSEHSRGSKPADGLLIDDHEKVLQTSQPHLKDVQAKSHSGSARSCTKVHKKGIALGRSVDLTKFSDYGELITELDQLFEFGGELTSPQKDWLIVYTDNEGDMMLVGDDPWQEFVAMVRKIYIYPKEEIQKMSPGTLSSKNEENQSASEGAADAQEIECQLNHSSSDT

SEQ ID NO: 2930 - protein, 58 aa, Santalum album
KKKGKLPENAKTTLLDWWSTHYRWPYPTEEEKMKLSEITGLDPRQINNWFINQRKGSR

SEQ ID NO: 2931 - protein, 608 aa, Arabidopsis thaliana
MGCCQSRIDSKEIVSRCKARKRYLKHLVKARQTLSVSHALYLRSLRAVGSSLVHFSSKETPLHLHHNPPSPSPPPPPPPRPPPPPLSPGSETTTWTTTTTSSVLPPPPPPPPPPPPPSSTWDFWDPFIPPPPSSSEEEWEEETTTATRTATGTGSDAAVTTAPTTATPQASSVVSGFSKDTMTTTTTGSELAVVVSRNGKDLMEIIKEVDEYFLKAADSGAPLSSLLEISTSITDFSGHSKSGKMYSSSNYECNLNPTSFWTRGFAPSKLSEYRNAGGVIGGNCIVGSHSSTVDRLYAWEKKLYQEVKYAESIKMDHEKKVEQVRRLEMKRAEYVKTEKAKKDVEKLESQLSVSSQAIQSASNEIIKLRETELYPQLVELVKGLMCMWRSMYESHQVQTHIVQQLKYLNTIPSTEPTSELHRQSTLQLELEFSKNPLVRSSYESKIYSFCEEWHLAIDRIPDKVASEGIKSFLTAVHGIVAQQADEHKQKKRTESMLKDFEKKSASLRALESKYSPYSVPESRKKNPVIEKRVKVEMLKGKAEEEKSKHEKSVSVTRAMTLNNLQMGFPHVFQAMVGFSSVCMQAFESVYNQAKSIGEDQEEVKRLLP

SEQ ID NO: 2932 - protein, 131 aa, Picea mariana
DFQEVNHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 2933 - protein, 501 aa, Oryza sativa
IRKQQARRVGGRVGELAKRIAMVEPGRARETKVTASASSSAGSDAAVMKKKKKKKKKLVVASRKVDEKDKKQVDYKCSRSSGRDECCKVESRHQQCTEPESPSYRLALRSLFSCRNSSSSSHAGHHHHRAADGKKLGCNSASICKVKQDNPMQQHMRRAEDELKVKDKPPVAEPYCKRRASVSACNISSERSVKKSVKQQQQEASSSLQSSASISASSCSSTAGGGGSFRGMQQLSLRRLSGCYECHMVVDPISGVFRDSSSMRATICSCPDCGEIFVRPDSLHLHQSIRHAVSELGAEDTSRNIISIIFQSSWLKKQSPVCAIDRILKVHNAARTLARFDDYRAAVKAKAMAHRHPRCTADGNELLRFHCATLSCDLGLHGATHLCDHLSCAACAIIRHGFRPPAPGAGIRTMATSGRAHDAVVSSGSEGDRRAMLVCRVIAGRVRREEAAAAAAEEEEEEEEEYDSVAGTTPGLYSNLDELDVFNPTAILPCFVVVYRA

SEQ ID NO: 2934 - protein, 588 aa, Oryza sativa Japonica Group
MPSSWDFWDPFAPSSSRSATEDAEWDDAATTIVDAPNAPPVVTVAAAAAPPPSVVTATTTTSTASELTVVAVPRGGGGAGKKDLAEIATELDEYFLKAADAGARVAALLEAPNCEPPETNNSSFPGKTISKSVTRLSSILLTFHLFLTNYLLHATEIDECCREGTELRQELEADGMVMGRKRVQQSGILSHSSTVEKLYAWEKKLFLEVKCSVASVSMICAMLLEFIEVKGSFQLYYYHGRDFLVLSMTAQLAQSYEGLKQEHDKKIGLLRKQEVKGVDYLKMEKNKMEIESLDSKMLVATQSIETTTSEIMRLRESELFPQLLELVAGLMSMWRGMYECHQVQTHMVQQLEYLNNSLSTNPTSNVHRQAALQLEIEVDRWYSAFCSLVKSQRDYVYSLTGWLRLSLFQSYHDPYNKAHQNSDIYSLCEEWQLAIDRIPDKVASEGIKTLLTVIHAVVVQQAEEQKQKKRSESAFKELEKKAEELRSLESKYGPYSGAEGYGDMSRKSPVSDKRAKVEALRCRADEEKSKYEKSIGVTRAMTLNNLQTGFPNVFQAMTGFASVCMEAFESVYNFKSSDRILDSKRLLT

SEQ ID NO: 2935 - protein, 608 aa, Oryza sativa
MAPKRPTPPPPPPPVASSEETASGSDSDESEEEEEESPLAQPAPVVSNKGAESDSSGEEESEEEEEEDLVRSSATKSRDPPQENREEDDSSDEEEDESSESEKAEAPPPPPPNPAPKQGAEGNGPKVSSPKRQAFHRIWSTEDEVRILEALAAHRREHGSLPQTDALIATLAGSLDNTGYGRKELQGKVSTLKRRYESTAKKKGDLPSKGHDRRLYDLSKSVWGSEAAAAAVNGTTTAPREFGEMCELYPHLAEEVKLLEAAHPGLFKRDFGKLDDDKAHALDMKIKKQRIAEISVVLRRGDLTKEVTKVLAELVEAASSCRMGDSTVAGALVPSVPKQEQAPSGDASTAALAVAGEGEEDAGARASAGGNGEAAADRDLLCPICMAVIKDAFLTACGHSFCYMCIVTHLSHKSDCPCCGNYLTKAQLYPNFLLDKGNDMAVKELDSLMTLIAEKKRHMEQQESETNMQILLVFLHCLRKQKLEELNEIQTDLQYIKEDISAVERHRLELYRTKERYSMKLRMLLDEPAASKMWPSPMDKPSGLFPPNSRGPLSTSNPGGLQNKKLDLKGQISHQGFQRRDVLTCSDPPSAPIQSGNVIARKRRVQAQ

SEQ ID NO: 2936 - protein, 256 aa, Brassica oleracea var. italica
MGRGRVQLKRIENKINRQVTFSKRRAGLMKKAHEISVLCDAEVALVVFSHKGKLFEYSTDSCMEKILERYERYSYAERQLIAPESDSNTNWSMEYNRLKAKIELLERNQRHYLGEDLQAMSPKELQNLEQQLDTALKHIRSRKNQLMYDSINELQRKEKAIQEQNSMLSKQIKERENVLRAQQEQWDEQNHGHNMPPPPPPQQHQIQHPYMLSHQPSPFLNMGGLYQEEDQMAMRRNDLDLSLEPVYNCNLGCFAA

SEQ ID NO: 2937 - protein, 207 aa, Arabidopsis arenosa
MASFQESSDLEAIQSHLFEDLLVCDGFMGDFDFDASFVSGLWCIEPQVPKQEPDSPVLDPDSFVNEFLQVEGESSSSSPELNSSSSSTYETDQSVKKAERFEEEEEARHYRGVRRRPWGKFAAEIRDPAKKGSRIWLGTFESDVDAARAYDCAAFKLRGRKAVLNFPLDAGKYEAPANSGRKRKRSDVQEELQRTQSNSSSSSCDAF

SEQ ID NO: 2938 - protein, 340 aa, Magnaporthe grisea 70-15
MSPAEAETKAAGTTPSQAQLFEAIGAQVDQVASTTTDAAQDDADDGIPPVEEIESLCMNCHENGTTRLLLTRIPFFREVVLMSFRCDHCGFQNSEIQNAGAVQPPSCPGCMHPCVTHMKMVDIPHFKQVVLMSTVCEHCGYRSNDIKTGGAVPEKGRKLTLQVKSDVDLARDILKSESCALECPELNLSVNPGTLGGRFTTVEGLLTQVRNDLKAQIFEADSTPNPTNAEGAISMEGGDSLSTEDRARWQAFFTELDKAIAGEREFSIVLADPLSSSYIQSLADDPSKPDFQMTVEDYDRTDEEEEELGLKDIKVGGYEEDDKKKEDKAETADAAPSSTA

SEQ ID NO: 2939 - protein, 203 aa, Clarkia concinna
RHELSMLCDAEVALIVFSTKGKLFEYSTDSSMEKILERYERYSYAERQLATNDSDPQGSCWTFECPKLMAKIEVLQRNIRHYVGEDLDPLSQRELQSLEQQIDTAIKRIRTRKNQLMHETISELHKKEKVLQEQNNLLSKKLKDNENALAERAQREQEFGQNTSNFMFPPATPPLLLHSLTIGGTFQGNVAPGKENEAQVRPS

SEQ ID NO: 2940 - protein, 298 aa, Oryza sativa Japonica Group
MTTTTAEGGGGVAPFVAKTYRMVDDPATDGVIAWGRDSNSFVVADPFAFSQTLLPAHFKHSNFSSFVRQLNTYGFRKVDPDRWEFAHVSFLRGQTHLLRRIVRRSSGGGGAKRKEEAGGCGGGGEAAAGDVDEESAVVALEVARLRREQREIEGRVAAMWRRVQETERRPKQMLAFLVKVVGDPQVLRRLVDRDNTNAAASNADDSAVHHQVKRPRLLLDSSSTTTTHGDRHLVTAAADGFYAGGCGPEAAAAAAFVPDDAVDFTGLYTGGDGFGNAVVDAGVDYPPAYAFPVVDSGY

SEQ ID NO: 2941 - protein, 217 aa, Chelidonium majus
  misc_feature (211)..(211): Xaa can be any naturally occurring amino acid
VKKAHEISVLCDAEVGLIVFSTKGKLFEFSSESSMDNILERYERQCFVEEELKATHPESEGNWSLEHTKLKARIEILQKNQRHFMGEDLDPLSLKELQNLEHQLDIALKHVRSRKNQLLYASIAELRKKEKALHEQNILLGKKIKQKEEQIAQWSAQQNDAQNSSSFLTQAPQNSQSFLTQALPSLTLRTGYYQTARVVVCEEDGARSNMXMPPWML

SEQ ID NO: 2942 - protein, 244 aa, Triticum aestivum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHVAQQDQTQPQTSSSSSSFMLRDAPPAANTSIHPAATGERAEDAAVQPQAPPRTGLPPWMVSHING

SEQ ID NO: 2943 - protein, 219 aa, Chelidonium majus
  misc_feature (12)..(12): Xaa can be any naturally occurring amino acid
GLVKKAHEISVXCDAEVALIVFSTKGKLFEYSTDSGMERILERYERYSYAERELVASELDQGNWSLEYTKLKAKIEILQKNQRHFMGEDLESMSLKELQNLEQQLDTALKQIRSRKNQLMYESISELQKKEKVLQEQNNQLGKKLKEKEKEVAQQQAQWDQQSQGQSSPSFLLSQSLPSLNIGGSYHMRGSNGSEEEGVRPQTTRTNTTLMPPWMVHHL

SEQ ID NO: 2944 - protein, 148 aa, Triticum aestivum
  misc_feature (23)..(23): Xaa can be any naturally occurring amino acid
  misc_feature (31)..(31): Xaa can be any naturally occurring amino acid
  misc_feature (40)..(40): Xaa can be any naturally occurring amino acid
  misc_feature (42)..(42): Xaa can be any naturally occurring amino acid
  misc_feature (45)..(45): Xaa can be any naturally occurring amino acid
  misc_feature (51)..(51): Xaa can be any naturally occurring amino acid
  misc_feature (57)..(57): Xaa can be any naturally occurring amino acid
  misc_feature (70)..(70): Xaa can be any naturally occurring amino acid
  misc_feature (83)..(83): Xaa can be any naturally occurring amino acid
  misc_feature (96)..(96): Xaa can be any naturally occurring amino acid
  misc_feature (110)..(110): Xaa can be any naturally occurring amino acid
  misc_feature (117)..(117): Xaa can be any naturally occurring amino acid
CRGTREGCLTSVARVRRDGRAPXAAIGARAXRACDGCMRXRXRWXCAADDXYLCQAXDASVHSGNPLARXHHRVRLPSSVLAXRHLLPSATPNPDXPAWLHGLKAPGRAXRGSKPRXWWAKHGGAPPKGRGVASGGSPDSRGPGSSVG

SEQ ID NO: 2945 - protein, 261 aa, Zea mays
MPSSDGEGGADVPRGPDGRSSPSNSSTVELDGDGGGGRKAGASPSSSVRPYVRSKNPRLRWTPELHLCFLRAVDRLGGQDRATPKLVLQLMNVKGLSIGHVKSHLQMYRSKKIDGSGQVIGGGGGSWRGRLHRQLQDGGQAAYSLGHLSLHHGAGQTTAASSAILSARRRLLLLRNDEDDDTQRQRDPLVDLELALDIGPRRPDKRVIIERSSACDQQEAEKNVGDQQVDSATDDDVRLSLSLFPSPPCARTGNGGRHKKS

SEQ ID NO: 2946 - protein, 218 aa, Corylopsis sinensis
GLVKKAHEISVLCDAEVALIVFSTKGKLFEYSTDSCMEKILERYERYSYAERQLVATDPNSQGNLSLEYSRLKAKVELLQRNQRHFLGEDLDSLSLRELQTMEQQLDTALKRIRSRKNQLMYESISELQKKEKAMQEQNNMLAKKIKEKEKTMTQQAQWEEQNQDPGAASFLLQQPLPCLNIGNTYNQGVGGGAPEVRRNELDLTLEPVYPCHIGCFA

SEQ ID NO: 2947 - protein, 217 aa, Glycine max
FGSSKGVRMRKWGKWAAEIRDPFKGTRIWLGTFSTAEEASQAYETRRLEFEVMAKALSDEKSNNGSSNNNSVLSHTSPSSVLELDTSASNLIGSGKVSSNEIVETKGLEAEVAETKSLAAEFAELEIQDLSMLNVPSPSAVAAATSEYELDLLAFDSFKYGFDYEHGFDDDFAALEDIHICSFDDNEPSELPDYDFDDFGADEFAGWIEEPLNIPCV

SEQ ID NO: 2948 - protein, 229 aa, Corylopsis sinensis
VQLKRMENKINRQVTFSKRRAGLLKKANEISVLCDAEVGLIVFSTKGKLYDMERIFDRYERYSYAERQLVVTNHESQGSWTIEHAKLKARMEVLQRNQRHFMGENLDSVSLKELQNLEHQLDNALKHIRSRKNLLMQESISELQRKDKSLQEENNSLSKKIKEKENALAHRAQWEQQNQGLNSFPILLSQPPQSLNIGTYQTGCSEGEEGTPFQQRPNTLLPHWMVSHL

SEQ ID NO: 2949 - protein, 202 aa, Lolium perenne
MAASLGLNPESLFSSAYAYSSSSPFLANHYAPPAGDGDICAQSFNLHDDHQQHYPRFDDQFENSPPTAPPPITFTGAGEDEHRSSEKTMEERMSAGRIGFRTRSEAVEILDDGFKWRKYGKKAVKNSANPRNYYRCSSEGCGVKKRVQRDQEDPRYVVTTYDGVHNHATPGAAVAEYYCYSPARGSSGSPPAAYSAAGPLYF

SEQ ID NO: 2950 - protein, 142 aa, Brassica napus
MDPSIKGDQEMLKIKKRCYQDLELGLTLLPRGTTSSELNLIDSFKTSSSSTSHHHPNRQEHVEDPRTFSCNYCQRKFYSSQALGGHQNAHKRERTLAKRGHYYKMSLSSSSSSSSSPSSAFAFGHGSVSRFASMASLPLHGS

SEQ ID NO: 2951 - protein, 874 aa, Oryza sativa Japonica Group
MESLLDLRRLLKKEKSAMNQKGDDLSMGKRLKALLTIVMRTTGPTRRSTKGNWTPEEDAILSRAVQTYNGKNWKKIAECFPDRTDVQCLHRWQKVLNPELVKGPWSKEEDEIIVQMVNKLGPKKWSTIAQALPGRIGKQCRERWYNHLNPGINKEAWTQEEEITLIHAHRMYGNKWAELTKFLPGRTDNSIKNHWNSSVKKKVNSYMSSDQHLQEDFAQGLNLDMTIDEMPTVPSFADNQTVCSIENHERSLEPYDVAMEVPLSMLSSDSGAEQKLHFMSEADFNSPNCLKSELWQDISLQGLLSGPDAVEADSISRSNHQSDVYSSEADTHFLAPPYMPQTSNSSSVMGLADDQSPQMSVPPSLICSNAMTDDAPFDNRPGRKEMPLSQAEVVTQSSSSSGDAEMFANPGCSNDRHVPSSTMESIPECGDQQVTNAEEPEASLEKEPSLTQSVTAPDEQDKGALFYEPPRFPSLDVPFVSCDLVTSGDLQEFSPLGIRQLMHSTMNVCTPMRLWGSPTHDESTGVLLKSAAKSFICTPSILKKRHRDLLSPIPDKRIEKKYGTEKDRGVSDTSSTGIQTSCINATKDDALITTVLRIERSASSKSLEKKLVFSDENKENLGYTTEQTKDGQSAGNDEHMDEQTTGERSSATNVATNDDLSGNLQPAGILIEHSGDDPISPDYGKNTMNQKLNTNVKSLSVCKEGVCAKSKPTELIVEKSSPCINVDYEYVNILADTPGIKRGLESPSAWKSPWFVDMHFQGSYFTSPADSYDALGLMKQINVQTAAALVEAREVLASGGQCDNISSDKENTGNPDAKKEPGTTKLQTKIMAEGRVLDFECTTPERSSDKNAGSNLGRYLSSPIPSSHLLKSFR

SEQ ID NO: 2952 - protein, 578 aa, Arabidopsis thaliana
MVSHKCVEEFGYASYLVPSNARAPRSARKRRSIEKRISKEDDNMCAIDLLATVAGHLSFESGSSLMSIDKLIEDHRVKEEFPEEEKPLMPVALSPYRGSLSPCGFSSVINGKVENEVDGFSYSGGSDACQVGNFSQDVKPDIDGDAVVLDARPNVVVSLGSSSRTEVPSIGNCVSHGVRDDVNLFSRDDDENFSKYIHPRVTKHSPRTVPRIGDRRIRKILASRHWKGGSRHSDTKPWRNYYLHQQRSYPIKKRKNFDHISDSVTDDYRMRTKMHRGSRKGQGASFVASDSHVKLRIKSFRVPELFIEIPETATVGSLKRMVMEAVSTLLSDGHRVGLMVQGKKVRDDNKTLHQTGISQDNSHLDSLDFSLEPSSEMPQLLTSHPLGHACEELLPVCQATKIDNVLESDHHDSALFPSDSLGNNNVTEDSKAMISVALNELSSQSQPPSRKSRRSEQQQQQAAQRRIRRPFSAAEVEALVQAVEKLGTGRWRDVKLCAFEDADHRTYVDLKDKWKTLVHTAKISPQQRRGEPVPQELLNRVLNAHGYWTQQQMQQLQQNVNKLEQETQSQTTEGLLLL

SEQ ID NO: 2953 - protein, 197 aa, Arabidopsis thaliana
MDDCRDKRRRRCTKLTCGTDNNDMEKMMHRETERQRRQEMASLYASLRSLLPLHFIKGKRSTSDQVNEAVNYIKYLQRKIKELSVRRDDLMVLSRGSLLGSSNGDFKEDVEMISGKNHVVVRQCLVGVEIMLSSRCCGGQPRFSSVLQVLSEYGLCLLNSISSIVDDRLVYTIQAEVNDMALMIDLAELEKRLIRMK

SEQ ID NO: 2954 - protein, 603 aa, Oryza sativa Japonica Group
MSSAAGGGGGYGGGGGEHQHQQQQHHLLLGQAAGQLYHVPQHSRREKLRFPPDHPAESRLPPPPGSWPLPPAFYSYASSSSSYSPHSPTLAHAQLVAHGMAPGAATSGGAQIPSQNFALSLSSASSNPPPTPRRQFGGGGGGGGAAGPYGPFTGYAAVLGRSRFLGPAQKLLEEICDVGGRPAQLDRGSDEGLLDVDAMDAAGSVDHEMDGSDRAVADAVTVSGAEQQWRKTRLISLMEDFKALLSSLLKLAGGDPQFIYNQKVCKRYRQYYQQLQAVVSSFETVAGLSNAAPFASMALRTMSKHFKYLKGIILNQLRNTGKGATKDGLGKEDTTNFGLMGGGAGLLRGNNVNSFSQPHNIWRPQRGLPERAVSVLRAWLFEHFLHPYPTDSDKQMLAKQTGLTRNQVSNWFINARVRLWKPMVEEIHNLEMRQLQKNPSLDKNQLSMQHTQHSSDSSGKPCDPSNSLQGQSSSMTRNHSISASRHIEDGLSQMPHDISGQVSFAYNGLAAHHSIAMAHHHQPDLIGTGGAANAGGVSLTLGLHQNNNRAYIAEPLPAALPLNLAHRFGLEDVSDAYVMSSFGGQDRHFTKEIGGHLLHDFVG

SEQ ID NO: 2955 - protein, 110 aa, Chlamydomonas reinhardtii
RGPWTPEEDKQLTDLVLSCGAQRWSTIAESIPGRSGKSCRLRWWNHLSPQVKKGPFSDFEDAVIVRSHEKYGNKWSVIAKLLPGRTDNAVKNRWNSTLKRKHTGNTLSNK

SEQ ID NO: 2956 - protein, 454 aa, Populus trichocarpa
MFSSSSSFNPFDQYANHTMIAGTENPSSIESCSQTFLQHFPDPFLDVDDLLVGELLSQQQQEHQEEEEVLGSNTALAVEAHDPQTIPTASNEETKINNKKKRSNVDTSKQPIRQRRTGKDRHSKIHTAQGPRDRRMRLSLQISRKFFDLQDMLGFDKASKTIEWLFTKSKAGIKELTDSVPGGRRRCSICADGKSVCSTPESEVVSGIKLTPETNGDKRGTKAKNDSLVSNPKEKRSKKVHKPVFNLVDRDSREKARARARERTRERMKNQGIDTSSDRSSQANPNKLEKFESSGPLEYGENLAPVNQEMSSPLKVGDVKESSNHDLLPHQMDYVSITGNFFWITNSPRSSSIFDFSESVALPGGTNCKDEFPGFPFNSNMTNDRIQYKYNALTNMKLPPLNAHEESPNSIFVNMPNPNDQNSISILMTTTTNGNANQSSSNSFFAEDNFDCLY

SEQ ID NO: 2957 - protein, 454 aa, Populus trichocarpa
MFSSSSSFNPFDQYANHTMIAGTENPSSIESCSQTFLQHFPDPFLDVDDLLVGELLSQQQQEHQEEEEVLGSNTALAVEAHDPQTIPTASNEETKINNKKKRSNVDTSKQPIRQRRTGKDRHSKIHTAQGPRDRRMRLSLQISRKFFDLQDMLGFDKASKTIEWLFTKSKAGIKELTDSVPGGRRRCSICADGKSVCSTPESEVVSGIKLTPETNGDKRGTKAKNDSLVSNPKEKRSKKVHKPVFNLVDRDSREKVRARARERTRERMKNQGIDTSSDRSSQANPNKLEKFESSGPLEYGENLAPVNQEMSSPLKVGDVKESSNHDLLPHQMDYVSITGNFFWITNSPRSSSIFDFSESVALPGGTNCKDEFPGFPFNSNMTNDRIQYKYNALTNMKLPPLNAHEESPNSIFVNMPNPNDQNSISILMTTTTNGNANQSSSNSFFAEDNFDCLY

SEQ ID NO: 2958 - protein, 563 aa, Brassica rapa
MAPMTNWLTFSLSPMEMLRSSDQSQFVSYDASSAASSPYLLDNFYGWTNQKPQEEEEAQITASMADSTILTSFVDSQNHSQNHIPKLEDFLGDFRYSDNSQTETQDSSSLTHIYDPRHHQNQTGFYSDHSHDFKAMTGFQTAFSTNSGSEVDDSVSMSRTHLAGEYLGHVVESSGHELGFIHGGANTGGALSLGVNINNTNNHASNDNNKISEYNYRGNNNGERIINNNNREKTDSEKEKPVVAVERSDSSNKKVADTFGQRTSIYRGVTRHRWTGRYEAHLWDNSCRREGQARKGRQGGYDKEDKAARAYDLAALKYWNTAATTNFPITNYSKELEEMKHMTKQEFIASLRRKSSGFSRGASMYRGVTRHHQQGRWQARIGRVAGNKDLYLGTFATEEEAAEAYDIAAIKFRGINAVTNFEMNRYDVEAIMKSALPIGGAAKRLKLSLESEQKPIIGHHQLHHFQQQHQQLQSSPNDSSINFALCPSSAAQSQMIPCGIPFEAASLYHHQQQQQQQNFFQHFPANAASDSTDSNNNSNVQSSMGLMAPNAAAEFFLWPNQSY

SEQ ID NO: 2959 - protein, 120 aa, Capnoides sempervirens
FFDLQEMLGFDKASRTVEWLLTKSKGAIKELTRSIKGSSNTCGGSTSTSSECEVVSMYDHTTNADNDDDENKVQISNTISSNSKEKRIRITRRPTFHPPPLAKDYRAKARARARERTKEK

SEQ ID NO: 2960 - protein, 412 aa, Vitis vinifera
MQDPSNPNPISHSHNAHQPPSTSFPNTATSLRGGHHRRAHSEVNFRIPEDLHLVSDPFDVPSASFEEMGSEDDLFCTYIDIDKFGSRPEGDARIDIAGGGLAAESGDGEKSSRPRHRHSNSVDGSSMSRGESLFVDTIEAKKAMAPDKLAELWTLDPKRAKRILANRQSAARSKERKARYILELERKVQTLQTEATTLSAQLTLFQIFFAEISVISGAYTMPNNFVHIRSTLGNIGDIFRRNFGYQWSLHHAEQLRPYPRDTTGLTTENTELKLRLQAMEQQAQLRDALNEALKKEVERLKIATGEIMTSSDAYNLGMHHVPYTQSSFFSHQSQPGPSESQNIQMPQFHPFPSNMLTHHQPLLGVAHSNALSDMLQQDPLGRLQGLDISSRGPSLVKSEGPSISASESSSTF

SEQ ID NO: 2961 - protein, 247 aa, Solanum tuberosum
MYQLPISTELPPTFFPAEFPVYCRSSSFSSLMPCLTESWGDLPLKVNDSEDMVIYGLLQDAFSIGWTPSNLTSSEVKPEPREEIEPVMSTSVSPPTETAAAPAALQPKGRHYRGVRQRPWGKFAAEIRDPAKNGARVWLGTYESAEEAALAYDKAAFRMRGTKALLNFPHRIGLNEPEPVRVTVKRRLPEPASSSVSSASESGSPKRRRKGVAAKQAELEVQSRGPNVIQVGCQMEQFPVGEQLLVN

SEQ ID NO: 2962 - protein, 532 aa, Oryza sativa Japonica Group
MSRAARRACHWVWVGSLSLSVSPSWLLPQGRNCIPAGRVIERGGQRGERREIDLIEGKETHKAFKPQNPNPPSPHPLAMAPKRPAAASGSASEASDCEAGGAGRRRSPSRSRSPSRSASPSRSRSKTPPHNAAVLSSTPASAAVDFVAASDSDAGADADARLASPRRSRERSPRLHSDSDNSAAATAEAAEAAAAAAFDDGDDEGNATPPPRSRRSSRVEATGVKPISSRPMDASRRPAAASSQSQRRSKRPRSSPTQHSPEQHKRPPRVWNPQDEVTILRALISYRAKNGALPGSSQDTGKLHNMIRGQLSVKASTTQLSDKVRRLKHKYNLILTRVTKSGRDPDLPTEHDREVYELSKKVWGTKSGGAGAGSGGGGGGGGGRVYENAEVVQSDEEQGSRDDSDEDMESGWDDRDHRNRRLKAIVVANGNGNAVTGGRSVHGNGSGKGDVADKGKDMYPYLWEAVEELSKEHPSGTAFRKAFGVLDGSRARAMEEKLNRFRLSEIRQQLRRMDLMKETIKMVLDALEGSDL

SEQ ID NO: 2963 - protein, 610 aa, Vitis vinifera
MMMFDEMGICGNLEFMSVPFMEGDMAASQPEQVAPVDDEYTDEEMDVDELQRRMWRDKLRLKRLKEQKEDQNGADTVKQRQSQEQARRKKMSRAQDGILKYMLKMMEVCKAQGFVYGIIPEKGKPVSGASDNLREWWKDKVRFDRNGPAAIAKYQADNLIPGKQEGCNSVGPTSHTLHELQDTTLGSLLSALMQHCEPPQRRFPLEKGIPPPWWPTGNEEWWPQLGSPKDQGPPPYKKPHDLKKAWKVSVLTAVMKHMSPDISKIRKLVRQSKCLQDKMTAKESATWLAIINQEEALARKLYPDYRPPLSSASGSGSFSIKDCGEYDVEGVQDELSFEIQECKPDSSNFSNLNVEKMSPRLPVPQLPYPMKGEVVTNLDFLHKRKPSHDLEMMMDHKIYTCEFLQCPHSEPQFGFHDRISRDNHQLTCSYRSNSSEFGMLNLHVNEVKPVAFPLPFGQPKPAAPAANSASASFDLSGLGVPEDGQKMIGDLMSFYDTNIQGSKVSNPRSIAVTNDQNLQHPKRQHHQNNSFHGFLQESNMTHNHHMFPREESQFDRSKLLNSRFETSPNENAFQFIYGPAFDLSSIDYVEDIPATTATDISSKQDASIWY

SEQ ID NO: 2964 - protein, 343 aa, Oryza sativa Indica Group
MKRGCEDELGAGDVILRGVEEVEEEDDDDLVLPGFRFHPTDEELVTFYLRRKIAEKRLSIEIIKEMDIYKHDPSDFLKTSTVGSEKEWYFFCLRGRKYRNSIRPNRVTGSGFWKATGIDRPICSAAGGGGGDCIGLKKSLVYYRGSAGKGTKTDWMMHEFRLPPPPADDLAAGRSSPPPSLQEAEVWTICRIFQRNITHKKQPQPQLAVAAAAVPAPVPDATSSITGSLESDSAGDDVVEYMNTLQPPPASNVNGGYSNQHYFQEQWNSSSNDNTTVFHQHAAAAPPPEPSPATAMAGFGHDQSVLSSPAPSDFYYKDGCNDDIYRMVMELADPSLFYDHIYA

SEQ ID NO: 2965 - protein, 345 aa, Zea mays
MAEHFNDWDLQAVVRSCGSVAHPEPAAAAPRADQPDAAPEPVPAPRRDEAPAARATPTTVPVRRQGRASPPAAKAAALLYDLEYLDLDHRPFLLPAAPSPSPSPGPRAGAGGREREVMISFPAAAAASTSGTQQRASPPGRKPGARTSRPKRSKKSQLKKVVREMPAADGGSSSSDPWAWRKYGQKPIKGSPYPRGYYKCSSMKGCMARKLVERSPAKPGVLIVTYMAEHCHPVPTQLNALAGTTRHKPSSGAAAEHSAASSPKSHEHGGQAAGRGTGDREHGSSETSTVAGEIGGEEIAAVDDDSEFWPEGLDLDELLAPVDDDFDFEQVIEAEDGVLGRRLSL

SEQ ID NO: 2966 - protein, 548 aa, Arabidopsis thaliana
MSSSSNPPVCSPEKEERSEMKIEIQCMENKQPLAASCSSASEGSGCFFLKSPEIATPATVSSFPRRTSGPMRRAKGGWTPEEDETLRRAVEKYKGKRWKKIAEFFPERTEVQCLHRWQKVLNPELVKGPWTQEEDDKIVELVKKYGPAKWSVIAKSLPGRIGKQCRERWHNHLNPGIRKDAWTVEEESALMNSHRMYGNKWAEIAKVLPGRTDNAIKNHWNSSLKKKLEFYLATGNLPPPASKFIVLKDIADGDRDSKQSSATKPFKDSDSLTQTSSGNTDSNEVGRDHFDSSSALLEEVAASRRIGVNEYACSPVEYKPQLPNLEPISEEVRINSKAYFERSIQRKVENGFGTPKHGNLYYKSPLDYYFPSEADLQHMYGYECGCSPGAASPVSLMTTPCNKDSGLTATRSPESFLREAARTFPNTPSIFRKRRKVVLAAKTDAVVVVNGVVKEVDRKEESKDMRKSLLLETTDNCSDDEELGLNGNAFNLSPPYRLRAKRTAVIKSRQLEFTSEKEKQPDNEIEFTSAKEKQPDNEIKTSEEDKPV

SEQ ID NO: 2967 - protein, 535 aa, Physcomitrella patens subsp. patens
MGSPIDLTLGCNTQAPSSNGRYNDHRNSSACLEDCLESLRKAEDYVRTLEEERRKVEGFKRELPLCIQLLEDAIRTSKEKLLRGKDLPQQLKANSMDSGKDQHGVSSGPGCRHTLEEFMPLKRRWERDQPSVSSDGERGEDRSSKRPAWMTEALLSKRTPASPEKETRLTQEHSELSVSEQEHSWVTSSQMLLGANQRPTGAFLPFIREQHGVNSFLSRPTPRPAGSGADLSLSLCEPTTTQTGHTLRPSGSEVGSIDAGRQTVDVPVAEDMGVISNGTSGAGSSSVGGNPSRKARRCWSPELHRLFVNALHQLGGSQIATPKQIRELMKVDGLTNDEVKSHLQKYRLHTRRPSSSPQPAGAGQSPKLVVLGGIWVPPQYAASGSQPSSGVYDPSIAHPPQPTEFCPTSLPQDYFACINNDTSSVSLQMHRQPIFEQPIFEQPKQAGTSQSQNSPQGPLHVTSQLSSATQGPSSEVYHDESPGEEEAKSEGTSWQREDLKSEEPTKPNVRFSLGAGSGDVQSHAHASEEEENQIE

SEQ ID NO: 2968 - protein, 236 aa, Heuchera americana
VQLRRMENKINRQVTFSKRRGGLVKKAHEISVLCDVEVALIVFSNKGKLFEYSTDSCMEKILERYERYSYAERRLVATGSESQENWSLEYTKLKAKIELLQRSQRQFMGEDLDLLSLRELQNLEQQLDTALKHIRSRKNQLMNQSISDLQKKEKAIQEQNNLLAKKIKEKEKAMSQQAEWEQQNNGASTSNFLNPQPLPCLNISSTYQGGAQPEAMRRNELDLTLEPIYSCHLGCF

SEQ ID NO: 2969 - protein, 654 aa, Arabidopsis thaliana
MEDDGGSDGGEGNGGFSPNSSFGAFADTAMDLDFMDELLFDGCWLETTDSKSLKQTEQSPSASTAMNDNSPFLCFGENPSQDNFSNEETERMFPQAEKFLLEEAEVGKSWWIAPSASEGPSSSVKERLLQAISGLNEAVQDKDFLVQIWVPIQQEGKSFLTTWAQPHLFNQEYSSLAEYRHVSETYNFPADEGMKDFVGLPGRVFLQKFPEWTPDVRFFRRDEYPRIKEAQKCDVRGSLALPVFERGSGTCLGVVEIVTTTQKMNYRQELEKMCKALEAVDLRSSSNLNTPSSEVYSDFYCAALPEIKDFLATICRSYDFPLALSWAPCARQGKVGSRHSDENFSECVSTIDSACSVPDEQSKSFWEACSEHHLLQGEGIVGKAFEATKLFFVPEVATFSKTNYPLAHHAKISGLHAALAVPLKSKSGLVEFVLEFFFPKACLDTEAQQEMLKSLCVTLQQDFRSSNLFIKDLELEVVLPVRETMLFSENLLCGAETVESLTEIQMQESSWIAHMIKANEKGKDVSLSWEYQKEDPKELSSGRENSQLDPVPNNVPLEAEQLQQASTPGLRVDIGPSTESASTGGGNMLSSRRPGEKKRAKTEKTIGLEVLRQYFAGSLKDAAKSIGGKRMLYTAGDIAPFFMNFDSYCFLGKA

SEQ ID NO: 2970 - protein, 216 aa, Heuchera americana
ELSVLCDADVALIVFSTKGKLFEYSTDSSMEKILERYERYSYAERQLIATDSELQGNWSLECPKLMARIEVLQRNIRQYMGQDLDPLSLRELQNLEQQLDSALKRIRTRKNQLMHESIAELQKKEKALQEQNNQLAKKIKENEKTVGENAQWQQPNQGHTSSSFMLAPALPPPSLQLPSLNIGDTFQARGVMNGDAGAQTRPSTNTLMPPWMLRHL

SEQ ID NO: 2971 - protein, 706 aa, Candida glabrata CBS 138
MSEHNNENLNLHEGLNLDDDDLENMLKNPNLFTTSPGIDVESIPSATNQNSVNGQDDKSGIKSQNSDTNEVIEDIVNPSIDPYVSTPHNDEMASPEDDIDSINNKDSNKLMTSLVRQNYGPHLGRDNADINSSNFRSHYQNLFDDNYLKTDMGSPVNKNKRKREDDDDDQLYSSQILRGPLSPGGNAHKVDNRLMSYGSNNLNSRQQTPGMENTPSVLNRRFQNKTRPAFVNKVWSMINDPVNSHLIQWSEDGLSLIVVNREKFVHEILPKYFKHSNFASFVRQLNMYGWHKVQDVKSGSIQSSSDDRWQFENEFFVRGREDLLNRIVRQKGTSANATPGTQSNMKYGNGNQIRGLPNVNGQTLRLMNEANMGNTMDITAVLGELEQIKFNQMAISKDLMRINKDNELLWKENMIARERHRTQQQALEKIFRFLRNVVPHADQKLLMDVAEPVSSRIEEAQDISDAPSVSSKSFDFDDGKEDRSRYIPLQDEDGKRPLYLLKNRTMSENSNKSSGGRLASTHNDSSGRISEIPFEEDDLSPPRHEVTDVGHISGQKNVAIDKLKADLHEQEARIKYLEDMVENKTLDSHLNDSMTMPMMPSPSTMLMHDMVEPSTIALGKEATDTSEGKHHGHDQQGQVQGQDQVQGQDQMHSQDQQNDMSAIGGLSELSPGLSPGLSSGLSPGFDIGDYLNSSQNHMTPMYEDKK

SEQ ID NO: 2972 - protein, 269 aa, Oryza sativa Japonica Group
MKVQCDVCAAEAASVFCCADEAALCDACDHRVHRANKLAGKHRRFSLLNPSASGRSPTSTTAPLCDICQEKRGFLFCKEDRAILCRECDVPVHTASELTMRHSRYLLTGVRLSSEPAASPAPPSEEENSSSFCCSADDAVPAPAAPATSHGGSSGSSSISEYLTTLPGWHVEDFLVDDATAEAAAAAAATSSGISANGPCQGVTRIGGLQESAGYPAWMAQQQLCCDGLVAGDASPASRERWVPQMYADQLAAGSKRSRTSTASSYSYW

SEQ ID NO: 2973 - protein, 276 aa, Zea mays
LLRHQAGLHSISVARARTHCRPHFLVALAVALAAMPDSDVPSPASSPLGSVQKIARGRKSRRGGGRSPAYRGVRMRAWGKWVSEIREPRKKSRIWLGTFPTAEMAARAHDAAALVVKGRGAVLNFPEMAASLPRPASAAPRDVQAAAARAAAMDVPVGAAEPLPSSSPQQVLGQPLVVGDPDVELLEEIVELPLIDEDVMASDDVFCWTASFHDCAADDPLSYEPNAWMQAGGSIAAQVAEMMVPGTGLATDQLWTAQPDGIMPSELGAFLWNPCS

SEQ ID NO: 2974 - protein, 350 aa, Oryza sativa
MRGPLLLRAVVVVAMEHFNDWDLQAVVRSCSFPQSEPPRVGVGVPAAPGAGGAPVVVAPPARAPDGPDQMARASASALYDLEYLDLDHKPFLLPGSSSSSSSSRAVARARGEDDGKGRHEVMISFPAAAAASTSGAQPRSPSGRKPGIRTPRPKRRSSKKSQLKKVVYEVPVADGGVSSDLWAWRKYGQKPIKGSPYPRGYYKCSSMKGCMARKMVERSPAKPGMLVVTYMAEHCHPVPTQLNALAGTTRHKSAPTGDDDKPTSPGPAAGRAAAGEGVVKCEDVDGNELSAMAADGGAEDTAAAADDDGELWPEGMGLELDEFLGPMDDDVFEFDHVLEDDGVLGRRLSL

SEQ ID NO: 2975 - protein, 403 aa, Arabidopsis thaliana
MTESIDLNRSESESDNNTDDVTPIFAIDDSSKGRVSGPTRRSTKGGWTAEEDQILTNVVKKYQGRNWKRIAECLPGSEENRRNDVQCQHRWLKVLDPSLQKGAWKKEEDELLSELVKDYMENDRPPWSKISKELPGRIGKQCRERWHNHLNPTIIKSPWTREEELILVQAQRGNGNKWAEIAKLLPGRTENNIKNHWNCSVKKRLEQFPSNLFSGVVYGSKPSSGFEYNFFNQRNTMVESCITSQIKEAAKSPQRDFLDLTLGLNWRSISSSTSSLRGEESVSSSVDSVCARLNVSACLETPQNSNNDTVCVKEVREMKERLRMAARTFDTPSIISKTSSPASGLKRLRQKYDTPFPTDARSHMSSEEDHSVSASPSSKYRFVKRNTCSGSKPLERRLDFDFL

SEQ ID NO: 2976 - protein, 235 aa, Medicago sativa subsp. x varia
MAMEALNSPTTATPFTPFEEPNLSYLETPWTKGKRSKRSRMDQSSCTEEEYLALCLIMLARSGNNNDKKSDSVATPLTTVKLSHKCSVCNKAFSSYQALGGHKASHRKAVMSATTAEDQITTTSSAVTTSSASNGKNKTHECSICHKSFPTGQALGGHKRCHYEGSVGAGAGAGSNAVTASEGVGLSHSHHRDFDLNLPAFPDFSKKFFVDDEVFSPLPAAKKPCLFKLEIPSHY

SEQ ID NO: 2977 - protein, 274 aa, Solanum chilense
MNSTSMSSLGVRKGSWTDEEDFLLRKCIDKYGEGKWHLVPIRAGLNRCRKSCRLRWLNYLRPHIKRGDFEQDEVDLILRLHKLLGNRWSLIAGRLPGRTANDVKNYWNTNLLRKLNTTKIVPREKTNNKCGEISTKIEIIKPQPRKYFSSTMKNITNNIVILDEEEHCKEIKSEKQTPDASMDNVDQWWINLLENCNDDIEEDEEVVINYEKTLTSLLHEEKSPPLNIGEGNSMQQGQISHENWGEFSLNLQPMQQGVQNDDFSAEIDLWNLLD

SEQ ID NO: 2978 - protein, 218 aa, Oryza sativa Japonica Group
MVKEPAAVSRFRFPPLLLSFSFLTLPRPGFDSGWIPLDFRGVRGFKVSRKGDGNGGPGKFGPKKRFNELSAILEPGKPPRADKVSILSDAARLLSQLRAEAQKLKSSNESLQDSIKSLKAEKSELRDEKTRLKAERERLEQMLKGVGAATPAAPAPFVPHHAAAVAAAPAYHPAAFAQAGGKYVPYATSYAPPAAFWQWIPPTSLDTSKDPVMWPPVA

SEQ ID NO: 2979 - protein, 454 aa, Populus deltoides
MFSSSNSFNPFDQYANHTMIAGTENPSSIESCSQTFLQHFPDPFLDVDDLLVGELLSQQQQQHQEEDEVLGSNTALAVEAHDPQTIPTASNEETKINNKKKRSNVDTSKQPIRQRRTGKDRHSKIHTAQGPRDRRMRLSLQISKKFFDLQDMLGFDKASKTIEWLFTKSKAGIKELTDSVPGGRRRCSICADGKSVCSTPESEVVSGIKLTPETNGDKRGTKAKNDSLVSNPKEKRSKKVHKPVFNLVDRDSREKARARARERTRERMKNQGIDTSSDRSSQANPNKLEKFESSSPLEYGENLAPVNQEMSSPLKVGDVKESSNHDLLPHQMDYVSITGNFFWITNSPRSSSIFDFSESVALPGGTNCKDEFPGFPLNSDMTNDRIQYKYNALTNMKLPTLNAHEERPNSIFMNMPNPNDQNSISILMTTTTNGNANQSSSNSFFAEDNFDCLY

SEQ ID NO: 2980 - protein, 177 aa, Populus trichocarpa x Populus deltoides
MTRLQIPDTTRGSGTRHPAYRGVRKRRWGKWVSEIREPRKKSRIWLGSFPVPEMAAKAYDVAAYCLKGRKAQLNFPEEADDLPIPSTCTARDIQAAAAKAAHSVLIPMKKSSETNNDGGGDGEVAGDDFWGEIELPELLLSNSGYSWDSCGWNTTLASDNSTWQPDGEGLQPSMACL

SEQ ID NO: 2981 - protein, 258 aa, Vitis vinifera
MAEFAANLQSLKPSSLEMNSNMELMNNRSAPENSHMNGHGFMAFSNVGFSIHHQQEFPVNFRDNTQSPVHAGGLSAVQVLQFSSQPGDFGQETKTGKVNFVSSPPASGSEFLGDNKNLGGRKRKRSNERENNKPREVIHVRAKRGQATDSHSLAERVRREKINEKLRCLQDLVPGCYKTMGMAVMLDVIINYVQSLQNQIEFLSMKLSAASTFYDFNSSEAEALETMQGTNAYEVHEVERSVKEGYGGPSHLHSTWPF

SEQ ID NO: 2982 - protein, 288 aa, Vitis vinifera
MATVAKRINNSSEEIELRRGPWTLEEDTLLIHYIACHGEGRWNLLAKCAGLKRTGKSCRLRWLNYLKPDIKRGNLTPQEQLLILELHSKWGNRWSRIAQHLPGRTDNEIKNYWRTRVQKQARQLKIESDSKRFIDAVRRFWMPRLLQKMEQASTSSTAADTVTTNTTNTTTVNSQSSTIPALLPNQITVSSSPPQSSVTSPSISTSDSMKIPLLPEISEHPTSPSQAIGNTVHNNPVINDCSYVDSSVYDMEPLAPSSAIGTYDFSLFSDYQMAENDWIDLWNVDKLW

SEQ ID NO: 2983 - protein, 295 aa, Cucumis sativus
METLYPSSHLSSSAWFVLDNPSTKWTKEENKMFESALAIYDKETPDRWFKVAALIPGKTVSDVIKQYKELEEDVCEIEAGRFPVPGYDLASSFSFEFVDDRNFDVYRRKSSVGRGSEHERKKGVPWTEEEHKQFLRGLLKYGKGDWRNISRNFVNSKTPTQVASHAQKYFMRQLSGGKDKRRPSIHDITTVNLTEPTASENEKLSSMDQFSKLPSLQKSPCYQKLLFDWNRSSNGGLLGLGSNYGDRLMSFPSGIAANGIKNEQDQELNSAYYGTYSKPHKSIFQFEPSRYQIYG

SEQ ID NO: 2984 - protein, 93 aa, Brassica napus
MAREKIQIRKIDNATARQVTFSKRRRGLFKKAEELSVLCDADVALIIFSSTGELFELCSSSMREVLERHNLHSKNLEKLDQPSLELQLVENSD

SEQ ID NO: 2985 - protein, 209 aa, Solanum lycopersicum
RHEMSMLCDAEVGLIVFSTKGKLFEYANDSCMERILERYERYSFAEKQLVPTDHTSPVSWTLEHAKLKARLEVLQRNQKHYVGEDLESLSMKELQNLEHQLDSALKHIRSRKNQLMHESISVLQKKDRALQEQNNQLSKKVKEREKEVAQQNQWEINSSSFVLPQQLDSPHLGEAYQSTNVIDNGEVEGGSSSQQQGAANNTVMPPWML

SEQ ID NO: 2986 - protein, 313 aa, Medicago truncatula
MFPRLIHPHDGIVVGQDDLQGGVSNHKGDPCLVLTADPKPRLRWTQDLHERFVDAVTQLGGPSKATPKAIMRTMNVKGLTLFHLKSHLQKYRLGKQSGKDIGEGCKDGMTGSYLLESPGTENPSPKLPTSDTNEGYEIKEALRAQMEVQSKLHLQVEAEKHLQIRQDAERRYMAMLERACKMLADQFIGATVIDTDSQKFQGIENKAPRGPLVDHLGFYSLPSTEAAGVNVPEEEVPQTIPPQRADCSTESCLTSHESSGGLTLEGSQVGGKRRMLGMDSMAAPLIWSEAKMKTQAINLGQGNHPLGISRYGM

SEQ ID NO: 2987 - protein, 305 aa, Triticum aestivum
MMKQESWMEVLPVPPAPYFAGQAGGWFLQQDQRGTGGGGGAWSPQENKLFEEALARVDGDAPDRWERVAALLPGKTVADVMRQYDDLENDVCFIEAGLVPFPHYNANAGAPASGFTLDWDGGGDLAFKRSCYMAAGGNGKRGRGADQERKKGVPWTEEEHKLFLMGLKKYGRGDWRNISRNYVTSRTPTQVASHAQKYFIRLNSGGKDKRRSSIHDITTVNIPDDDHASNTNPSPSPPSALTATSSAPEQFGALVDSKPPPPLGGNHRFMPAHLYGSVKLEASNNGYHGDSVLMQMQCGQLQPLG

SEQ ID NO: 2988 - protein, 1050 aa, Physcomitrella patens subsp. patens
MNCTRQSRKEGRGGIYQACKIAKARALAKQETETVVQLDRRRRRRRRGYGGRKEGRRRRGGERERVAVVQPWGWHLSLQLLRFIPSLFFSHPPLGLAGRGGLENEAQGAVRRGWLAYGAGTGMDEGGGGDESSYGGRGRGPVLWLVSLGADEEVGVVAAFFRGSSGGGCRWWSRKSRVEARTTMQFASAVAVRAHRKVVNGNHRVSCVEHDARKVDTYGSSGSIFSAVTSSGLGASPVALPSGTLDASRTPTGLLPAIVKTKQVEEEMTLSNLTSASAGEASVSSGNHADGTNPGMPPTPSTPATPTTTTVTVSSGQPLGVPVKRKRNLPGTPDPEAEVIALSPKTLMATNRFVCEICNKGFQRDQNLQLHRRGHNLPWKLRQRTSKEVRKRVYICPEPSCVHHDPSRALGDLTGIKKHFCRKHGEKKWKCDKCSKRYAVQSDWKAHSKTCGTREYRCDCGTLFSRSVPSLWSFAVQGYILHKIVRRDSFITHRAFCDALAEESARVSAGKQGGGQPDGLTGPGSSSMSVVGAPSSPPHGNNVGPVSGDPLASVVPLASRSGGLPPSMAGLGGLSELPRWCGAPGGSGSVPRAGTGLSLWLGPDPGPPGNQQQMHQLLSGSDGNSSFLLQAQKGMQGGADLPGILNPLDYDVPQAPRPSSGQLPLTPSGSLLAHLFASGNGLQGFQGSSPSQSGATAGMGISGFSDFTGGASRMERGLTAAGMSPTSSAGLTSNSSSGNTNSGGNLSSVSPLFKAQQQQQQHTASAQMSATALLQKAAQMGATASNSSLLRGFGLGGADSNSLGIWQGHRQEQQQQQSQQSHPQPQQQQSQSQPQPQQQQGRTGDLLLNNMVNHALIRRPGDLQNVSQGLGGSSLGQSNSFGGGQGRLSDSSTNVQDLMNSLSGGAGLFGGPLSSMPSMFGPSSTSMGGMLPPSTQRISPSEGLANSTFTGGPGVLQGMGPSSLLPGLGGSSRGENDGSDRFTRDFLGVGGASGMTAVGGGMGRTLSQRDLASITSLGPGVDLGAFFNQGENLRSVNASGRSPGKSWDAT

SEQ ID NO: 2989 - protein, 279 aa, Triticum aestivum
  misc_feature (198)..(198): Xaa can be any naturally occurring amino acid
MTRRCSHCSHNGHNSRTCPNRGVKIFGVRLTDGSIRKSASMGNLSLLGGSTSGGGGASPADVGHDAAAEGYASDDFVQGSSSANRERKKGVPWTEEEHRRFLLGLQKLGKGDWRGISRNFVVSRTPTQVASHAQKYFIRQANMSRRKRRSSLFDLVPDESDLPPLPGIQEPEAQILDHPPFPPPMEEEEVESMGVGFXSVIAKRSPASGLRPENLAAHLSGPIPEYFLTSLEIPSPFWENQMVENFLGQGKLKLLSPAPVPPRAPSSLETGGHSNLCLG

SEQ ID NO: 2990 - protein, 876 aa, Physcomitrella patens subsp. patens
MAIGNNNNTCGGEKGMRGWPFSPVSTRAQNHFGGRGQLGQEGVTQNNNNNDDDDAHLEEVQCTWRHRLPVQSGFPVTTRTRACWEDEVQVLQNHRVLIFGKRSEMSRHTKKGVLLRSMAFIAAVGHKQLGPDWAIGSPSSLGHNRYGEVVPEESAAQQQREFYVVQKRHAMTQQQAERSQPHHFARREDTKPSTHDFLSLYDKGAHQLEIGSSSGLPSSLTTHDFLQPLERSGTRSTYRDAPASREKQARVDTVQSRNSTPASAERNLPTVAPTYSNNQVPYAVNPNSMNRMVNEADALRQGRGYSMVTLSSPDDHNGGPESSRGVEVAMDPEVANARDNLAHWPGVSFKFDMPADLTFPTGSQAVKGAVDNGHQSIPAIAKQWTYGIVDVPKRSIRPPSEDYEDEDEDSSERPKGNRKESISCKGDTAQRMDVKNGDMRGSTPRSKHSATEQRRRSKINDRFQMLRDLVPHSDQKRDKASFLLEVIEYIQVLQEKVRKYETTEQGRHQERLKSMVWDICKRGAAGSADEASQLNALIFAKDFNSGVGPVDVKPVTEANGDVRALRASEQAALTSEVHSTAGINGQQRSSRPACSIHSCVSSLDGEKEHATAPTAQPLAVGVPLQQAIPLPYALSIVPSRLQSDQDGGRGTPGSNSPAKEKLCDPDPVSSRENGSARANSPDQLFELRPRISPARQAEQISGQQSKAELQTPAATAVDRIDGAQTGQPSNGSASRQSYGATYYQENVSKPSRHSPARQNGQIAPGDGSAASPCPTQPPPRIQGGVINVSSVYSQSLLDTLTRALQSSGVDLSRANISVQIDLGTNVATAAADTSAKVATTPESSAQSHQSQGRTRPAPVAAEPAPALKRPKLENHE

SEQ ID NO: 2991 - protein, 260 aa, Picea abies
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQQHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 2992 - protein, 357 aa, Oryza sativa Japonica Group
MGRSPCCEKIGLKKGPWTPEEDQKLLAYIEEHGHGSWRALPSKAGLQRCGKSCRLRWTNYLRPDIKRGKFSLQEEQTIIQLHALLGNRWSAIATHLPKRTDNEIKNYWNTHLKKRLAKMGIDPVTHKAINGTLNNTAGDKSAKVTASLSHMAQWESARLEAEARLARESKMRIAASTPSKLHAQSTNPPASTPSPCFDVLNAWQSAKIDLESPTSTLTFAGSNASMLPFSTTTALELSESNSNVWQQRSDELEGEESEWKFVSKQQLQGMHGKETEEHFIGCEESWFPGTANIGAGFTGMLLDGSNMHDTSECWDESSNGQDEQRSQVSEDAENKNYWNGIFSMVNSEQPPLQPPLL

SEQ ID NO: 2993 - protein, 132 aa, Potamogeton distinctus
VYRGIRRRVWGRWASEIRDPNKGGRVWLGTYDTPEEAARAYDVAALKIRGKKAKLNFPNYVHGHVRYKSTVRETNTTIQIAPPTSPLTCWSEELSSSTDPFLALQNDSDESDVAIGWSSQEISGDDFFPSAF

SEQ ID NO: 2994 - protein, 260 aa, Picea abies
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 2995 - protein, 344 aa, Arabidopsis thaliana
MYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSGGMSPHGDKTISPLLTNDNGEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 2996 - protein, 78 aa, Glycine max
ADHRTYVDLKDKWKTLVHTATISPQQRRGEPVPQELLDRVLAAHAFWSQHQAKQHGKHQAGPGTLKITEASAERPCVC

SEQ ID NO: 2997 - protein, 260 aa, Picea abies
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 2998 - protein, 320 aa, Zea mays
  misc_feature (82)..(82): Xaa can be any naturally occurring amino acid
MGGGGGGGRNGAATRRYNRSKVPRLRWTSELHRNFVRAVDCLGGQDKATPKLILQLMDVGGLTIAHVKSHLQMYRSSGQDIXGERCKPRRLGHLVEHYSFAIDEEGGPKEFVCCPHMKRAEAGPEEAAATATATHESVQGNSDMGAPGTRRCGDDYTRAIPIPMGSSSSRRITEGLAWQWQSSGAASAARAATAASTLRELGFWVRGTEPFKTGRPLANRLSPVARQPSSKEIKCGDDGRFLFGTATRDEAARRHSPSRRPDSIDPKAVAAVPWSSEGGGCALPPPLSSTGLSARSGPSGSCVFARQRVNLDLSLSICGS

SEQ ID NO: 2999 - protein, 268 aa, Medicago truncatula
MMLHKSQGGGGGGGEQFANGGGLNGSAVKNVQPAGGGGKQRLRWTSDLHDRFVDAITQLGGPDRATPKGVLRVMGVPGLTIYHVKSHLQKYRLAKYLPESPGDGKDSKDEKRNSGDSISGADSSPGLQINDALRMQMEVQKRLHEQLEVQKQLQMRIEAQGKYLQKIIEEQQKLGSTLAASETLPLSHDKQNQPLSEPSGSSDALADTFSPHKKQRIDEGSKDGTAPQVTIKTAQKNDCNVGPLDPNLYEDDAGYGFDLETENDDGNE

SEQ ID NO: 3000 - protein, 320 aa, Arabidopsis thaliana
MEEDAAFDLLKAELLNAEDDAIISRYLKRMVVNGDSWPDHFIEDADVFNKNPNVEFDAESPSFVIVKPRTEACGKTDGCETGCWRIMGRDKPIKSTETVKIQGFKKILKFCLKRKPRGYKRSWVMEEYRLTNNLNWKQDHVICKIRFMFEAEISFLLAKHFYTTSESLPRNELLPAYGFLSSDKQLEDVSYPVTIMTSEGNDWPSYVTNNVYCLHPLELVDLQDRMFNDYGTCIFANKTCGKTDRCINGGYWKILHRDRLIKSKSGIVIGFKKVFKFHETEKERYFCGGEDVKVTWTLEEYRLSVKQNKFLCVIKFTYDN

SEQ ID NO: 3001 - protein, 257 aa, Oryza sativa Japonica Group
MGRAPCCEKMGLKKGPWTPEEDKVLVAHIQRHGHGNWRALPKQAGLLRCGKSCRLRWINYLRPDIKRGNFSKEEEDTIIHLHELLGNRWSAIAARLPGRTDNEIKNVWHTHLKKRLDAPAQGGHVAASGGKKHKKPKSAKKPAAAAAAPPALPERSASSSVTESSMASSVAEEHGNAGISSASASVCAKEESSFTSASEEFQIDDSFWSETLSMPLDGYDVSMEPGDAFVAPPSADDMDYWLGVFMESGEAQDLPQI

SEQ ID NO: 3002 - protein, 328 aa, Arabidopsis thaliana
MLIMSGLMSFGELEDQFGQISDTTMEEKIPFLQMLQCIEHPFTTTEPNQFLQSLLQIQTLESKSCLTLETNIKRDPGQTDDPEKDPRTENGAVTVKEKRKRKRTRAPKNKDEVENQRMTHIAVERNRRRQMNEHLNSLRSLMPPSFLQRGDQASIVGGAIDFIKELEQLLQSLEAEKRKDGTDETPKTASCSSSSSLACTNSSISSVSTTSENGFTARFGGGDTTEVEATVIQNHVSLKVRCKRGKRQILKAIVSIEELKLAILHLTISSSFDFVIYSFNLKMEDGCKLGSADEIATAVHQIFEQINGEISSKLAVFYDDIIIGHMKV

SEQ ID NO: 3003 - protein, 332 aa, Brassica napus
MSPEEELQSNGSVASSTRNIVGVLKEHNYLGLSDCSSVGSSNLSGLADDDKATISLKATELTLGLPGSQSPARDTELNLLGPAKLDEKPFFPLLPSKDEMCSSSSHKNIASGNKRGFSDTMDKVPLYTEKNWMFPEAVVATQSVIKKEVAQNLPKGKLSTTNNSSSPPAAKAQIVGWPPVRSYRKNTLATTCKNSDEVDGKPGSGPLFVKVSMDGAPYLRKVDLRSYTNYGELSAALEKMFTTFTLGQCGTSGATGKDVRNETKLKDLLNGKDYVLTYEDKDGDWMLVGDFSWEIFIGVCKKLKIMKGCDAIGLAAAPAPAPRAMEKSKMRA

SEQ ID NO: 3004 - protein, 177 aa, Oryza sativa Japonica Group
MPELEVCSPASSGGASPPESPVEGRRGGGGGEKRGRSGDGGRHPSYRGVRMRAWGKWVSEIREPRKKSRIWLGTFPTPEMAARAHDAAALVVKGPAAVLNFPDMAASLPRPASASPRDVQAAAARAAAMEPPQPPPSSLTVQADSAAAAFLTPKNGGVSGAGPADDELEAIVELPRV

SEQ ID NO: 3005 - protein, 949 aa, Oryza sativa Indica Group
MAIGVMMTSDNGKAPEKGGEASGPSSAPQEGEISNEPQRRRPLSGRTTGPTRRSTKGNWTPEEEDDIIVQMVNKLGPKKWSTIAQALPGRIGKQCRERWHNHLNPGINKEAWTQEEEITLIHAHRMYGNKWAELTKFLPGRTDNAIKNHWNSSVKKKVDSYMSSGLLTQVSCLPLNEYSAHCNSSPALTQQNSEDSGSYAVREVENSSVCSQSSLAKVSCSQVHNANVALGCDLQVNANVDNNEAHDSQSSVGHEACYTSVGAVATAIPEVHYHVSSSNFDPDQHLQEEFAQGLNLHMSMDEVPSNSSFADNPTICSIENHERSLEPYDVAMEMPLSMLPSDSGAEQKLHFMSEADFNSPNCLKSELWQDISLQSLLSGPDAVETDSFSRSNHQSDVYSSQADNEFLAPPYLLQTSNSSSVMEATYGQSPQMSVPPSLICSNVMTDVPSDNRSEPKEMTVSQAEMVTQSSSSSGDAEMSANPVSSNGSDIPSMMERIPECADQHVTNAEEPEASIEKEPSVTPSATADEKQDEGALFYEPPRFPSMDVPFVSCDLVTSGDLQEYSPLGIRQLMRSTMNVCTPMRLWGSPTHDESPDILLKSAAKSFICTPSILKKRHRDLVSPIPDKRIEKKSGTEKDCGVSDTSSIGIQTCFINATKDDAVITKSVLRIERSASSKPLEKKLEFSDENKENLDNTIEQAKDGQSAGNYKHIDEQARGERRTATNITTTYDDLPGNLQPAGILIEHNGDDLVSPDYGKNTMKQKQNTNMESLSVCKEGVSAKKPAELIVEKSSACINVDYEYVNILADTPGIKRGLESPSAWKSPWFVDMQFQGSYFVSPANGSYDALGLVKQINVQTAAALAEAREVLASGGQSENINSDKENLENPDAKKEPGATTKLQAKIKTEGKILDFNECATPIRSSDKKAGSSLGRSLSSPIPSSHLLKSFR

SEQ ID NO: 3006 - protein, 225 aa, Ashbya gossypii ATCC 10895
MVDQNNKDLALAIKELTEHNDTLSLAIQRTRLSVKRLRLEYAVLLERLEARIEKDPSLHYEEPLPTLASFKNNLLESLPSSRSRKRRSKEKRDPNLPKRPTNAYLLFCEMNKDKIRHEHAANNVDMTKVLPEIWKNMDEEAKKPYYDLYNADRLRYQREMTAYSQNKTTEEANVDVKNESGNEEEEGDEPEHEPDADEIDVNDSDVTQLDDGIGDVASSVMSSEM

SEQ ID NO: 3007 - protein, 464 aa, Cryptococcus neoformans var. neoformans JEC21
MAPATSLSVDDKTKVKKAIPTSSSTNKIITATVARIYQAKPGANSWSYSGVEGALVFCVDKAKGGLWFRVVTLSSGRGVIWEHELPIEIEYNQEKPFFHTWQGDEMQFAFVFASEHEAHDFYKKVANRSKYAMKAKEKKEKKEEKSAPTKKRKGKIDKSMISGPSVDSFRHVAHMGFDSEKGFSSTGVDPSWQKLLEQLTQKGFSEKDIKKNEKFIKDFVDQSGGIEKATAPPPAEAPKKPSRPPAPPTSRRKPAPPPPASRSARPSSVAQPSAPSVPPPPPPPPPPGRPAAPPSAPPSAPSAPPPPPPPPPPVRSDGTGVAPPPPPPPPPARPPGGAPPPPPPPPTSAPSAPPLPTASGGRSALLASIQGRGVHSLKKVDPSEQKVSALAGGDTAGTGTGTGTGAAAVGAGAGAVAGGGAAAAVAATTEDTPDLASSLAAALSKRKADIGSDEEDEDSDDEWD

SEQ ID NO: 3008 - protein, 168 aa, Triticum aestivum
MDSARSCLVDDVSSGASTGKKASPAPAVPATKPLQRVGSGASAVMDAPEPGAEADSGRVGRLPSSKYKGVVPQPNGRWGAQIYERHQRVWLGTFTGEAEAARAYDAAAQRFRGRDAVTNFRPLAESDPGDAAELRFLAARSKAEVVDMLRKHIYPAELAQHKRAFLAS

SEQ ID NO: 3009 - protein, 208 aa, Michelia figo
  misc_feature (5)..(5): Xaa can be any naturally occurring amino acid
GLVKXAHEISVLCDAEVAVIVFSTKGKLYEYSTDSRMSRILERYERYSYAERELVLSGPESEGSWCLEYGKLKAKVESLQRNLRHFTGEDLDTLSLKELQQLEHQLDAALKHIRSRKNQIMFDSIAELQRKEKSLREQNNMLEKEIQEKEKAMAQQVQWEQQNQSQSSPSFLLPTLNIGTYHRGNEVEEEGARPPARTNSLMPSWMLC

SEQ ID NO: 3010 - protein, 239 aa, Phytolacca americana
  misc_feature (235)..(236): Xaa can be any naturally occurring amino acid
VQLRRMENKINRQVTFSKRRSGLVKKAHEISVLCDAELALIIFSPRGKLFEYSTDSSMEKILERYERYFYAERQLASNDPNTEVNWTFDFAKLKAKLELLQRNHRHYLGQDLDSLNIKDLQSLEQQLDNALKHIRTRKNQLMHESISELHKKEKAMQEQNNMLVKKIKEREKAMAEAQGMQWQRQQNEPPEASNFLLPPPLTSWNTAGDAYHGQIAGEVKRNDLDLTLEPVYSCXXGCF

SEQ ID NO: 3011 - protein, 697 aa, Zea mays
MAPKRPAAAAAAASGSASEASDAEADVGHQPSSPSPSKTPPTNPNPKSAAAGPASAAEDSTAAGSDSEAAYDSDADHRPAHRKAAVAASPSRKPRSPRPRSRSRSRSPDAASYSDGAASDADADPAARDGADSADDGNASPLALPRLSRAEAAAIKPLSSRPMDPPRRSMVHSFSELRSKRPRSAAVPSSVEQLKRPTRLWSLRDEIVILRGLVTYRAKRGVLPGAMYDISMFQGHIQSELSVNVTPTQLSDKVRRLKQKYNQLASRGKNGRDPDLPTQHEQSVYEIGKKVWGTSTGGDGYEIGGDSQEEHEIGESDEDVESGWDERARKNRRLMPITMANGHGSGFGAGRGKFDVEKGKDAYPYLWETVEDLSKEHPNGVAFKKAFELIEGARARGMEEKLRKFRLTEIRHQLRRMELMKETVKMVLDALEATSTLDCPDPRLILVLSDANRPRLFARTTRLCNARPAAAGELVRDEHRQRVAQAVPATTDPVGSISPALVFTTLPVVVVKFEASFMLLAQPTATLQPVSVSEVEALFELFKSISGLVIDDGLINKLSLLIVRLETETGSYKSATEIKLLVAISIAVPNPTAPSHVRVRLPLRGVPAAPHRVVASMAVSAPRSGAATSFLERRESERALHFVKYQGFGNDFIMVDNRDSSVPKVMPEEAAKLCDRNFSISADGSSSCRGSMVPTTP

SEQ ID NO: 3012 - protein, 205 aa, Phytolacca americana
SVLCDAEVALIVFSTKTKLFEYATHSSMERILERYESYSYAEKQLVATDSESRQQGSWAMEYPRLVSKLEVLQKNMRHYVGEGIESLTLRELQHLEPQLDTALKRIRTRKNQLMHESISQLQKKQKTMQEHNNLLVKLVKEKDKTQATQKENPRELLMLSSNPLPFPSLSIGGAYQEREMGIKQVIHQSEPNTSSAMPHWMLHHL

SEQ ID NO: 3013 - protein, 212 aa, Phytolacca americana
SVLCDAEVALIVFSTKGKLFEYSTESSMEAILERYERYSYAEKQLVATDSESQQQGSWAMEYPRLISKLEVLQRNMRHYVGQDIDSLALRELQHLEQQIDTALKRIRNRKNQVMHESISQFQKKEKAMQEQNNLLVKLVKEKGKTQVIEEENPSQALMLSSSNPLSFPSLSIGGSYQERTEMGVEQVHYQGQGQVVPPNSNTTMPPWMLRHL

SEQ ID NO: 3014 - protein, 210 aa, Ammopiptanthus mongolicus
MRNPSSMAVKQNQNLKKNNNNIGAEVQVHYRGVRKRPWGRYAAEIRDPARKTRVWLGTFDTAAEAARAYDAAARQFRGLKAKTNFPSENNQCSTVESSTPDSPEREVTRRCDDVCGIDRFPFLPLQTRHVAFGGEGLDVAPVRPVFFSEPAVGTEFVSQSCPIRFDPEPVEFNGGFGIGAQSESDSSFVVDCKPKTVLNLDLKLALPIDA

SEQ ID NO: 3015 - protein, 80 aa, Brassica napus
MYHSSMNEKKSLEPVTEDKQEIMPDILTTSPIKANSPNSKRVSPAHIGPSEPGSILGKRSNGRKLILRSIPAFPSLNPNQ

SEQ ID NO: 3016 - protein, 200 aa, Triticum aestivum
MAPSSSTSTTAAAAADERDRKRKRGAGGEAGTEAEAERAPKWRSRREHEIYSTRLLDALRLVRAGAGVAPSPSPARQVREAADRALAVAARGRSRWSRAILASRRAHRVHRVRLHAPAPAPAPALTRPASPGASSSGSTSAQAQTLARKAKTLGRLVPGCRKLPFPALLSEASDYIAALEMQVRAMAALAQALSAVAPPP

SEQ ID NO: 3017 - protein, 122 aa, Brassica napus
  misc_feature (10)..(10): Xaa can be any naturally occurring amino acid
  misc_feature (28)..(28): Xaa can be any naturally occurring amino acid
  misc_feature (43)..(43): Xaa can be any naturally occurring amino acid
RKIKYTGELXRKVQTLQNEATTLSAQVXMLQRGTSDLTTENKXLKMRLQALEQQAELRDALNEALRGELNRLKIAAGEIPQGNGNSFNNNRSQFSSQLGNNKNQQMSTNGQPSSFMDFNKRG

SEQ ID NO: 3018 - protein, 320 aa, Arabidopsis thaliana
MSSIRNTHWCHRCQRAVWLRARDAVCSYCGGGFVEEIDIGPSRAHRDVERDPTFDLMEAFSAFMRSRLAERSYDREISGRLGSAGSESFSNLAPLLIFGGQAPFRLAGGDNSSVEAFVNGAAPGIGIARGTNAGDYFFGPGLEELIEQLSSGTHHRGPPPAPKSSIDALPTIKITQKHLKSSDSHCPVCKDEFELKSEAKQMPCHHIYHSDCIVPWLVQHNSCPVCRKELPSRGSSSSTQSSQNRSTNGRENSRRRNIFSNLWPFRSSSSSSTQNRRDTNNTATAEEGHYHHHQQQQQQHQHQHQQQQSHMGYSGWPFDY

SEQ ID NO: 3019 - protein, 260 aa, Picea abies
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQHHHHQEASRMVTSLEVDIDSACSSNPNDSIDTLKTKIASHPHYPQLLAAYMDCQKIGAPPEVVTVLDEISQENQLGRHLATMDIGVDPELDQFMEAYCQMLIKYH

SEQ ID NO: 3020 - protein, 196 aa, Vitis vinifera
MDQLYGLYSPSSSNYHHSPPFMSENLISPSHYPNFNSPTPFPIFGSDQLLLASSVAKVGAPPKVAYLLEEIRRGSELCRRNTVSTCLGADPELDESMETYCDVLVKYKSDLARPFNEATAFLNNIETQLNTLCNGASRSYVSDEAAGSLEEAEGGKLKTWRSTRSMANEVLENQCKDNVSTNDVTIYDEASLTSDV

SEQ ID NO: 3021 - protein, 767 aa, Arabidopsis thaliana
MVLSDGKIRSIDGVVRVFNDFALWSGLRISMEKSTLFLAGTSATAHQTITSTYPFSVGTLPVRYLGLPLVNKRLSAADYLPLLEKIRQRIGSWTARFLSFAGRLNLISSVLWSICNFWMAAFRLPRGCIREVDKICSAFLWSGQEMKTTKAKVSWQEISNMENSVSWKLSLGEVDRRKSSQTEVLLVCQTHIGSWMWKKLLKYRAVASPLCRAEVKNGQTTSFWYDNWSDLGRLSDLVGERGAIDLGIDWQKSVADAWTMRRRRRHRDGLLMQIEEALNKKMQNRKDEADHILWRGINDTYRPRFSTKDTWHHLRTISPTITWHKGVWFTHATPRQSFCVWLAVLNRLSTGDRMRMWNVGATDTCFLCHTELLNRLAHEPNARLLPPKPAGRRIFTKRNGRMHGDDPNPPARLVGWLDKQIRNRLSAIRLMGDGRYASGLQKCFIMEDDDAAYDLIKHELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKKVFEFYETVRQIYLCDGEEVTVTWTIQEYRLSKNVKQNKVLCVIKLTYDR

SEQ ID NO: 3022 - protein, 372 aa, Oryza sativa Japonica Group
MDDPMLNAVKEEESHGDGGGLEVVAGEDGAAAVAAGLAPGPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLFKNIKRRKPPSHTASNQQSFGPYLEVGHFGYDAEIDRLKRDKQLLMAEVVKLRQEQQNTKANLKAMEDRLQGTEQRQKQMIAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGASQQQQIGPQGELNDNFWEELLNEGLVGEENDNPVVEDDMNVLSEKMGYLNSNGPTAGE

SEQ ID NO: 3023 - protein, 230 aa, Vitis vinifera
MAEPLNSETESSSNSGSSSSSSPSSPGSTQSRPNSSKPEPESKKMKRIRDSSKHPVYRGVRMRNWGKWVSEIREPRKKSRIWLGTFPTPEMAARAHDVAALSIKGNSAILNFPQLAASLPRPVSLAPRDVQAAAAKAAAMDKFDSPSSSSSSSSLSSLVSSIDLSTASDELSEIVELPNLDPSFDSPESKTDFVFDDSADGWLYPPPWLQSVEDCGKDPQSKSPFSNKIG

SEQ ID NO: 3024 - protein, 222 aa, Oryza sativa Japonica Group
MEVGNGKCGGGGAGCELCGGVAAVHCAADSAFLCLVCDDKVHGANFLASRHRRRRLGVEVVDEEDDARSTASSSCVSTADSASSTAAAAAAVESEDVRRRGRRGRRAPRAEAVLEGWAKRMGLSSGAARRRAAAAGAALRAVGRGVAASRVPIRVAMAAALWSEVASSSSRRRRRPGAGQAALLRRLEASAHVPARLLLTVASWMARASTPPAAEEGWAECS

SEQ ID NO: 3025 - protein, 260 aa, Glycine max
TLWFSKLIECHASRYTCVLIFFLLLNSVINCSGLLRCGKSCRLRWINYLRPDIKRGNFTIEEEETIIKLHEMLGNRWSAIAAKLPGRTDNEIKNVWHTNLKKRLLKSDQSKPSSKRATKPKIKRSDSNSSIITQSEPAHLRFREMDTTSTACNTSSSDFSSVTVGDSKNIIKSEDIESMETMPVIDESFWSEAAIDDETPTMSSQSLITISNDMPLQYPFANYEETFQQSHAYDSNFDDGMDFWYDIFTRTNDSIELSEF

SEQ ID NO: 3026 - protein, 226 aa, Phytolacca americana
GLVKKAHEISILCDADVALIVFSTKGKLFQYATGSCMEKILERYERYSYAERQLITPDPESHLSWTLEHAKLKARVEILQKNQRNYMGEELDTLSLKELQTLEHQLDSALKQIRSKKNQLMYESISQLQKKDKALQEQNKSLSKEVKEKEKEKEKTMTQQAQWDNQNQDINSSSCLMSDQALPSLNIGMNYQTESGSSSVENEAIQQQNRNNTTIALMPHWMLSHL

SEQ ID NO: 3027 - protein, 242 aa, Oryza sativa Japonica Group
MVTVREEMRKGPWTEQEDLQLVCTVRLFGERRWDFIAKVSGLNRTGKSCRLRWVNYLHPGLKRGRMSPHEERLILELHARWGNRWSRIARRLPGRTDNEIKNYWRTHMRKKAQERKSNMSPSSSSSSLTYQSCHPETPSMIIGIEEQELHGGSGCITSIMKSTPVDMDGYPMDQIWMEIEAPNVLPGPCFDEAKDSASNSLSGPLLPYPMWDYYCPETCLRMDDEIKVAPQFGYGKGVGPCY

SEQ ID NO: 3028 - protein, 215 aa, Pachysandra terminalis
GLVKKAHEISVLCDAEVALIVFSTKGKLFEYSTDSCMDQILERYERYCCAERELGAADTESQGSWTQEYTKLKSKIEVLQKNLRHLKGEDLESLRLKELQNLEQQLDNSLKHVRSRKNQLMHDSISELQKKEKELQEQNNMLNKKLKEKERAKTQQAQWEQQNQGPNSPSLQLSQPLPFLNIGGTYQTRSTRNQEEGGRPHHSNRTDALMPHWMV

SEQ ID NO: 3029 - protein, 122 aa, Coprinopsis cinerea okayama7#130
MPKDSAKPKRKAAEKAEKAPRAAASKSKKDPLKPKRALSAYMFFSQDWRERIKAENPDAGFGEVGKLLGAKWKELDEEEKKPYIELANKDKERAENEKSAYDKGIKKSRANSGSGEEDEDDE

SEQ ID NO: 3030 - protein, 234 aa, Pachysandra terminalis
  misc_feature (204)..(204): Xaa can be any naturally occurring amino acid
  misc_feature (207)..(207): Xaa can be any naturally occurring amino acid
  misc_feature (211)..(211): Xaa can be any naturally occurring amino acid
VQLRRMENKINRQVTFSKRRTGLLKKAHEISVLCDAEVALIVFSTKGKLSQYSSNSSMETILDRYERYSYAERKLMAGDHLDSQGSWPLEYTKLKSKIEVLQRNQRHFMGEELDSLSLKELQYMEHQLDTSLKHIRSRKNQLMNDSIYDLQKKEKALQEQNSTLIKKLKEKEKAPAHQACWEQQGQNLPSFLLSQPLPSLNIGXNYXLARXSRDEEEGAQSHARTNPIMPPWML

SEQ ID NO: 3031 - protein, 301 aa, Vitis vinifera
MAATRKDVDRIKGPWSPEEDDALQKLVQKHGPRNWSLISKSIPGRSGKSCRLRWCNQLSPQVEHRAFTSEEDDTIMRAHARFGNKWATIARLLSGRTDNAIKNHWNSTLKRKCSAITEDGSFGGDYPPHPLKRSVSAGAAAPVSGLYLSPSSPCGSDVSDSSLPVVSSSHVYRPVARTGGIIPPETTSSSNDPPTSLSLSLPGVDSCEVSNRAPEPNHAPPGKPYSDDTYDGSFAADSDAPTQPASDGAGYSPLPGGETIYPLQLQSLRNYMAGLEQNGVCLQADGIRNAAVKRIGISKIE

SEQ ID NO: 3032 - protein, 151 aa, Daucus carota
MKRLSSSDSLGALMSICPTTEEGSPGNNHVYSREFQSMLEGLDEEGCVEEMGQISEKKRRLSINQVKALEKNFEVENKLEPERKVKLAQELGLQPRQVAVWFQNRRARWKTKQLERDYGVLKANYDSLKLKNDTLQQENQSLLKEIRELNS

SEQ ID NO: 3033 - protein, 238 aa, Peperomia caperata
  misc_feature (207)..(207): Xaa can be any naturally occurring amino acid
  misc_feature (238)..(238): Xaa can be any naturally occurring amino acid
VQLKRMENKINRQVTFSKRRTGLLKKAHEISVLCDAEVALIVFSTKGKLYEYATNSSSMPGILDRYERHSFTDKEFFIKEGEPPEGAWTLEYAKLKARYELLQKNYRHYLGEDLGSLSGKELQQLEGQLDASLKNVRSRRTQALFHTISDLQKKEKSLLEQNSVMIKKLQDLEKAEKAQQSQLEMQNHERTQNQPPLILLPPPALSXGSFRQENGPSVEGEAAPRVAQKNSLLPPWMX

SEQ ID NO: 3034 - protein, 201 aa, Zea mays
MFRCLAGWMRRVRRSVERSNRADMQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 3035 - protein, 301 aa, Triticum aestivum
VTSRTSLYKKAGSYRSGIPGISSTHASAGGGGFAPGLGAGGWEREKAAIEALPLYERLLEAHVACLRGAAPVDQLPRIDAQIAARAPPPMPPAAAPAGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQDTGLQLKPNNNWVPNQRKRNWHSNPTSSSWDKSKRKRDNA

SEQ ID NO: 3036 - protein, 260 aa, Picea abies
MEDMNMNIGGAATFFGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 3037 - protein, 217 aa, Triticum aestivum
MTDGHLFNNISLGGRVGNNPGQFRLYSGGLAWKKQGGGKTIEVDKADIISVTWMKIPRSYQLSVGTKEGIRYVFKGFREQDVSNLTNFIQKNTGTTPEEKQLSVSGHNWGAVDINGNMLSFNVGSKEAFEVSLSDVSQTQLQGKTDVVLEFHVDDTTGANEKDSLMDLSFHVPTSNTQFLGDEERPSAHIFWQKILAIAPVVSSTWNSRTTSVFPCN

SEQ ID NO: 3038 - protein, 317 aa, Oryza sativa Japonica Group
MVPSSRKVRVFCSDPDATDSSDEDDQNKKERRFSREILIPMENSKASKPVKTLVQCGTKTVKDSEKEPTSKYRGVRRRAWGKWAAEIRDPVRKSRKWIGTFNSEEEAAAAYLAQSNQFHEELMALKIQSSVSEQEDLSSSVTISCVSSSQSCDQKIQAKPQEHKRVSVVVNRETVEQKFKAQPQAQKIKAQPEVQKRVSVKISHETEDEHLLNLPSTPKGKEISMGAVLGRIDEIPVSNCVGHIDEFPPDDFTRLADAFPVSDFIGMADVPLGDDYIGLADISHLPLPITDLKFDLNAELNWDGFDFASLEQELNCL

SEQ ID NO: 3039 - protein, 260 aa, Triticum aestivum
  misc_feature (211)..(211): Xaa can be any naturally occurring amino acid
QVCTKKQAGTGPEFPGYRRPTRPRAQDGILKYMLKMMEVCRAQGFVYGIIPEKGKPVSGASDNLRAWWKEKVRFDRNGPAAIAKYQADNAMPGSESELASGTTSPHSLQELQDTTLGSLLSALMQHCDPPQRRFPLEKGISPPWWPSGDEEWWPELGIPKDQGPPPYKKPHDLKKAWKVSVLTAVIKHMSPDIEKIRRLVRQSKCLQDKMXRQEISTWLARGQQEEELFMRLHPGARPPASAGGIASAISFNASSSEYDV

SEQ ID NO: 3040 - protein, 135 aa, Picea glauca
GGFSEEEFSCGEIEVHEVDPRAEDRELKDQLLRKYSGYFSSLKQEFLKKKKKGKLPKEARQKLLEWWNVHYKWPYPSETDKVSLAESTGLDQKQINNWFINQRKRHWKPSEDMQFVVMDSLNPHGASFYMDGADC

SEQ ID NO: 3041 - protein, 362 aa, Oryza sativa
  misc_feature (196)..(196): Xaa can be any naturally occurring amino acid
  misc_feature (261)..(261): Xaa can be any naturally occurring amino acid
MEEELCGNNWDLDAVVRLGCCRRRISPAAVAQQVDPFASFLQQGVAMEVAAEKEVGVEAAWSFPELTVRDGGGGGLGRDADELLKAFCAAFPSSSSSKSSPLPTPPPPPPTQPQPEQQKPVTVQENLPAPTTAPARASQPAAARQVPAGGVPRSKRRKNQQKKVVRHVPADGVSADVWAWRKYGQKPIKGSPYPRXGYYRCSSSKGCPARKQVERSRSDPNTFILTYTGEHNHSAPTHRNSLAGTTRNKLPSSSAASAASXKPQPPPPSVVVVGAGGGGAEAAGLSPTTPLRTPSMEEDEEEEEEEELLVEDMEMAGEDELLFLNGGDDNAALDGTPMSSLFDIADEPFLPSPWTEPTAAGS

SEQ ID NO: 3042 - protein, 394 aa, Oryza sativa Indica Group
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPPSSAAAREHLFDKTVTPSDVGKLNRLVIPKQHAEKHFPLQLPPPTTTSSVAAAADAAAGGGECKGVLLNFEDAAGKVWKFRYSYWNSSQSYVLTKGWSRFVKDKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 3043 - protein, 388 aa, Picea mariana
MGRAPCCAKVGLNKGAWSAEEDSLLGKYIQTHGEGNWRSLPKKAGLRRCGKSCRLRWLNYLRPCIKRGNITADEEELIIRMHALLGNRWSIIAGRVPGRTDNEIKNYWNTNLSKKLAVRGIDPKTHKKVTTDSINRASDRFNQRKGGKLYDCSQRSQRLERNVARAGQSTGLVIPNVHNLKADLKGQYIAGPRAIQSSNSIRSSSPINTLIQPKSNELTDDPDFMQPQPVVSSEAGKQTDDSTVYCSSDSAASCALIDHLSSADDDQYLSLEGNSNECYSHTVAEESGTLKSSNPQTHSEAICDSRERDNGGPVQKHDQFPEYDVLSFFDVRNAENEICCNDDQWVHEQEMPQLHSWDNQIDDQGKEHFGSHVNNDVTAMSWEASFWF

SEQ ID NO: 3044 - protein, 301 aa, Zea mays
  misc_feature (213)..(213): Xaa can be any naturally occurring amino acid
EITTLLLVPGPREGSVERASGGLGVPSVKHMFPFCDSSSPMDLPLYQQLQLSPSSPKTDQSSSFYCYPCSPPFAAADASFPLSYQIGSAAAADATPPQAVINSPATELGACASGAEGSGASLDRAAAAARKDWHSKICTAGGMRDRRMRLSLDVARKFFALQDMLGFDKASKTVQWLINTSKAAIQEIMADDASSECVEDGSSSLSVDGKYKXNPAELGGGNEKSNGNARSEWKKPAMGRKAATTAKPPRKSGNNAHPVPDKETRAKARERARERTKEKHRMRWVKLASAIDVEVRGCLCL

SEQ ID NO: 3045 - protein, 262 aa, Zea mays
  misc_feature (44)..(44): Xaa can be any naturally occurring amino acid
MGRSPCCEKMGLKRGPWTAEEDRILVAHVERHGHSNWRALPKLXQAGLLRCGKSCRLRWINYLRPDIKRGNFSREEEDAIIQLHQMLGNRWSTIAARLPGRTDNEIKNVWHTHLKKRLEPKPASQQAPKRKPTKKQQPQPEPEPVTTLEGPAGAVPPVSPERSLSTTTSTTTSTADYSAASSLENAGDSFTSEEDYYQIDDSFWSETLAMTTTVDSFESGVQQAEGSFGKSAAAPSSTNDDMDFWLKLFMQASDMQNLPQII

SEQ ID NO: 3046 - protein, 267 aa, Vitis vinifera
MEIPRSEPCLSETSSIISVSEAAPSLNTSMDSPKEGKQQEGQDRNQEELTNPDLVLDLSLSSRDLEQGSRPELNLINSFEMGSSQNHSEIPQGNEGEPRVFSCNYCQRKFYSSQALGGHQNAHKRERTLAKRGQRIGAASVAFGHPLPNPYRFSSMASLPLHGSFNRSLGIQAHSLIHKPSSLSSTLYGHQGWSRLPIDQQPAIGRLAPENYHVGSSSSSGGAARFETVRKSCNVKTPQNHMRVLEGSHRSTFLSLSVGSFPTTYIS

SEQ ID NO: 3047 - protein, 296 aa, Solanum tuberosum
MTAAELQLPPGFRFHPTDEELVTHYLCRKCTSQPIAVPIVTEIDLYKFDPWDLPDLALYGEKEWYFFSPRDRKYPNGSRPNRAAGSGYWKATGADKPIGIPKAVGIKKALVFYSGKAPKGEKTNWIMHEYRLADVDRSARKNNNSLRLDDWVLCRIYNKKGSIEKNRKMNTTCYMDTVGSPEDRKPEILPPLPPPPQPQQLHNDFFYLPSDSVPKIHSDSSCSEHVLSPEFTCEREVQSEPKLTDWEKATLDLPFNYMDATTGATTVDNSLLGSQFQSCYQMSPLQDMFMHLHRPF

SEQ ID NO: 3048 - protein, 264 aa, Glycine max
MVRAPCCEKMGLKKGPWTPEEDQILMSYIQKHGHGNWRALPKLAGLLRCGKSCRLRWINYLRPDIKRGNFSSEEEEIIIKMHELLGNRWSAIAAKLPGRTDNEIKNVWHTHLKKRLLNSDIQKRVSKPRIKRSDSNSSTLTQLEPTSSACTTSLSDFSSFSEGTKNMDNMIKSEDIESVETIMPPIDESFWSEATVDYESSTMMTSNSWTISNELAPPQYQFNSVESFQQQSVDYNGSNDDHDGMDFWYDIFIKSGESIELPGF

SEQ ID NO: 3049 - protein, 206 aa, Peperomia caperata
SVLCDAEVAVIVFSTKGKLYEYATDAGMARILDRYEKHTFSNRELELTNLESEGAWSLEYGKLKARFELLQKSHRHYLGEDLGALNMKELQHIEHQLDSALRHVRSRKNQILSDTISDLQTKEKLIHEQNKILQKRIQEKEREITGQPQWEIVPSRQENQNPQPTLFPIPLHTLSIGYCKEDGKAIELGLENEPRPLSQKMPPWML

SEQ ID NO: 3050 - protein, 936 aa, Physcomitrella patens subsp. patens
MNTQAVRLKKNERGRGEGKKAKNKKKQKEGEEGEEGEGEGWGEVVTHGRRRRCDVTARSVRNKRRLTERTVHPSIRPSVQKSTHSSKGDPQSTPDQGFAEPGTICAHARTGEHYHSATRQALSSSCSQPCRGQHDARKEHAYSSSGSVLLFPVSSTLGASSLASRTGKPDALCFASAGEASVSSGNRTDGTNTGMLPTSSTPATPTVTTVTVSSGQPLAVAVKRKRNLPGTPDPEAEVIALSPKTLMATNRFVCEICNKGFQRDQNLQLHRRGHNLPWKLRQRTSKEVRKRVYICPEPSCVHHDPSRALGDLTGIKKHFCRKHGEKKWKCDKCSKRYAVQSDWKAHSKTCGTREYRCDCGTLFSRRDSFITHRAFCDALAEDSARVSAGKQGGGQPDSLLGSGSSSMSVIGAPSSPHVNNVGRMNGEPLASMVPLASRPGGMPQSMVGLSDLGESCHPLLPRWGATSGSGPASKTGTGLSLWLGPGPGPGNQQQMHQLLPGSDGNSSFLMQAHKGMQGGAGLPGMMNTLDYEMPQAPRHSSGHLPLTPSGSLFAHLLASGNGQGLQASSSSQSGATTGMDISGFSDFSAAGANRIDSGSATAGLSSTSSAGMASNASSRSTNGGGNLSSVSPLFNPQHQQQQHTASAQMSATALLQKAAQMGATASNTSLFRGFGQGGTDSDSMGIWQGQRQEQQPQQQHLAQQQSQSQSQPQQHQHQQQGRTGDLPLNNMSNMGNQPLMRRPGDLQSVSQGLGGSSLGQTNNFGGVQGRLSESSTNVQDFMNSLSGGAGMFGGPFGSMPSMFGPSSTNMGGMLPPSTHRMSPSDVLAGSTFPGGGQGVFQGMSSSSSLLPGLGGSSRVENDSSDRFTRDFLGVGGASGITAAGGGMGRTLSPRDLARITSLGPGVDLGVFFNQRENLRSVNASGHSPGKSWDPST

SEQ ID NO: 3051 - protein, 447 aa, Magnaporthe grisea
MSTLAMAAPSPHAPFKKEYFSNWDDRRQADYAPSRPRSDPERIALPSIRQAFPDLLRLRVIPQDGQTSTPSSTTSPISGPPGTLTPPEYVHSPTSQNKRRRLSFGDDQEERVSQVPRLYTSQSQAYQRRDNRPLSPVTLSGGPRSSTSDSWAGSSRTSPFLPGTSTSTLRSPAAIEQNDPMDRQRPTLPSLPHLNFDRSPMESQSHMHHHHQQHPHQQQQQQHSHHVRAMSGDEYMMEQHRGMVQQHPHSAVEPGYRQPAPSGYPYPYHHPSRSQSLSIGAMPPMDRMPFSPSGYSAYHGDYMRMGDMGGMGFNGDNKQRKRRGNLPKETTDKLRAWFLAHLSHPYPTEDEKQELMRQTGLQMNQISNWFINARRRQLPAMINNARAESDALAQGRGLSDGSKILLSTERSDYDSDKRGSPISDDGASHLYHDDMHRRAVGMKRGSV

SEQ ID NO: 3052 - protein, 268 aa, Physcomitrella patens subsp. patens
MVSQVVKTDPHWPPLEESMGQERYSLNSDVVPSSSVPGFHNLSAPQPMDGLQSTAPPPFLTKTYDMVDDPATDPVVSWSTGHNSFIVWNPPDFAQELLPKYFKHNNFSSFVRQLNTYGFRKVDPDRWEFANEGFLRGRRDLLRTIHRRKPATHSQQSAQQQQQHQQTDQGSVGPCVEVGKFGLEGEIERLKRDKNVLMMELVRLRQQQQNTERDLQAMGQRLLTTENRQQHMMSFLAKAMQNPSFLAQLMQQSENKRLAATVRKKRRL

SEQ ID NO: 3053 - protein, 517 aa, Ostreococcus tauri
MTRARDNRTSCFAERWLCTTGRIGRRLVRTRTAFEKARQMTSGSRAKTDEMISFVVSIVAVHFSDTRTDVQCLHRWQKVLNPDLVKGPWTTEEDSKIIQLVTELGPKRWSKIASELPGRIGKQCRERWYNHLDPEIKREEWSSEEDRQLILAHAEYGNRWAEIAKSFKGRTDNAIKNHWNSTLKRKVDQALNQGLSALAAAEPSAGGSKGKSLTVKKHAATRKALALNPAHANRSHQPNAGSSLQYRGGVDMSRRASSYAASPTKCGIRRSMFDVSDGEASNPPGIINANIFASPYGSQSVGGSPYSDIRANAVEGSPFRIGEILDEFASASDSPQQLTTSPVFETASTPQGAYHGIGITPPNKLALPSGAAMAAVEGLDVAKIPDARTLEASNINLSNVQMPKMPGINSIEDLQAFVSPDRKKRGRNMRLSHLFRRSGKQAKTSDDSTGVAENVDAVNLMRTVKSANTSMYDRAEELLRGVDVTEVPILAGMTTPTRPRRNDTVAPVPFSPSQFLA

SEQ ID NO: 3054 - protein, 348 aa, Lotus japonicus
MGRTPCCDEIGLKKGPWTPEEDAILVDYIQKHGHGSWRALPKLAGLNRCGKSCRLRWTNYLRPDIKRGKFTEEEEQLIINLHAVLGNKWSAIAGHLPGRTDNEIKNFWNTHLKKKLLQMGLDPVTHRPRLDHLNLLSNLQQFLAATNMVTSFTNTLDSNAALRLQSDATQLAKLQLLQNILQVLGTNPASNLELLNQLGPSSSISDTFLHEALGLNQSKLQELYKSSIGFPSHQNLSNLQTLEVPHHLQQHYMNGGSTINSCMQSRKVVDEQLDATNSSSTIPLNSLPNLVSASPQCSTVKEMENKVNPNECSNPSSTSTTFEMWGDFMCEEVNDDYWKDLIDQESNR

SEQ ID NO: 3055 - protein, 268 aa, Oryza sativa Indica Group
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKITTKAVLEVKPFCLHSSEQLMETEKEKNNAIINTNREEQNGATPSTSSPTPVTAPDPIPTTNNSQSQPRGSGESEAQPSPAQAGNSKLPPWMLRTSHT

SEQ ID NO: 3056 - protein, 374 aa, Vitis vinifera
MYHHHHHQGKNIHPSSRTPITPERNLFLQGGNGPGDSGLVLSTDAKPRLKWTPDLHERFIEAVNQLGGADKATPKTVMKLMGIPGLTLYHLKSHLQKYRLSKNLHGQANSATSKTVVGERMPEANGALMSSPNIGNQTNKSLHLSETLQMIEAQRRLHEQLEVQRHLQLRIEAQGKYLQAVLEKAQETLGRQNLGAVGLEAAKVQLSELLKELQTNPNPAHRLCLTSCEGSQREQEIHNCGMGLRPYTNGSTPLEAKDTAEPPGLQHTVLKWCEDTKENRQFISSMQRDAERRTMTAERSNSDLSMRIGLQGEKGNGSNSYSEGRFKGRAEADNFMSHGYRLPCFGAKLDLNAHDENDVTLSCKQFDLNGFSWN

SEQ ID NO: 3057 - protein, 164 aa, Zea mays
MEDLYSIHPGISRHGAAATSEASGVAGGPGSPPPPPPPAADLTELVKAQIAGHPRYPSLLSAYIDCRKVGAPSEVATLLEEIGRERCAAASAGGEVVGMDPELDEFMETYCRLLERYKEELSRPLDEAASFLSNVRTQLSSLCGGAASLSGDEAIRDQFSGLLQ

SEQ ID NO: 3058 - protein, 332 aa, Glycine max
MESCVPPGFRFHPTEDELVGYYLKRKINSLKIDLDVIVEIDLYKMEPWDIQDRCKLGYEQQNEWYFFSHKDKKYPTGTRTNRATAAGFWKATGRDKAVMSKNRIIGMRKTLVFYKGRAPNGRKTDWIMHEYRHQTSEHGPPQEEGWVVCRAFRKPSPSHRPGFDHPWCSTSSQQQHFFRDQIQSYSSRPLSIADILDETNNVPHPNAEGTSFSHPFSSDHQQHLNNLLSNQTVAIMDKQLIELPQLDSPTASLAIKECNQQQHNGLTNEEYCSDERSNNSNAQGIDWKSLDNLFGSQLSDNAAYFSHPNLPLMMPHNHDQASHILGCFPDSS

SEQ ID NO: 3059 - protein, 283 aa, Zea mays
VGRPARPRHLLGRAHRGGRLGLGGGALAGTTPSSDAASTDHGSRKAAPEPAAGRRKRRRTKVVKNKEEIESQRITHIAVERNRRRQMNEYLAVLRSLMPPSHAHRGDQASIVGGAINYVRELEQLLQSLEVQKSLKQSRERRPAAGGASCSPPFAGFFSFPQYSTASSTTSSSGGEKCRGHDVAAADIEVTMVEGHASLKVLARRRPKQLLKLVAGLHQLRVPPLHLNVTAAVDAMVLYTFSLKVEDDSKMGSVEDIATAVHEILGSIQRQQQEEEEEETAAM

SEQ ID NO: 3060 - protein, 166 aa, Physcomitrella patens subsp. patens
DPKPRLRWTPELHERFVDAVTQLGGADKATPKSVMRIMGVKGLTLYHLKSHLQKYRLGKQLNRDQHLQNKDGTVSAGLQRSNSFSDGVQPLKSQNPQDGLQMTDQIQLQLEVQQRLQDQLEVQRHLQMRIEAQGKYLQSILEKAKETLASHTNESPSLEAAHAELT

SEQ ID NO: 3061 - protein, 486 aa, Arabidopsis thaliana
MDLSAKDEFSAEKRNPDNYDSVNNPSGDWRVDSYPSENLISAGPASCSPSQMMDSFGQTLWYDPTSVQAVGYAGFNGGNASSSSFRGSIDRSLEMGWNLPNLLPPKGNGLFLPNASSFLPPSMAQFPADSGFIERAARFSLFSGGNFSDMVNQPLGNSEAIGLFLQGGGTMQGQCQSNELNVGEPHNDVSVAVKESTVRSSEQAKPNVPGSGNVSEDTQSSGGNGQKGRETSSNTKKRKRNGQKNSEAAQSHRSQQSEEEPDNNGDEKRNDEQSPNSPGKKSNSGKQQGKQSSDPPKDGYIHVRARRGQATNSHSLAERVRREKISERMKFLQDLVPGCNKVTGKAVMLDEIINYVQSLQRQVEFLSMKLATVNPQMDFNLEGLLAKDALQLRAGSSSTTPFPPNMSMAYPPLPHGFMQQTLSSIGRTITSPLSPMNGGFKRQETNGWEGDLQNVIHINYGAGDVTPDPQAAATASLPAANMKVEP

SEQ ID NO: 3062 - protein, 356 aa, Arabidopsis thaliana
MFPSLDTNGYDLFDPFIPHQTTMFPSFITHIQSPNSHHHYSSPSFPFSSDFLESFDESFLINQFLLQQQDVAANVVESPWKFCKKLELKKKNEKCVDGSTSQEVQWRRTVKKRDRHSKICTAQGPRDRRMRLSLQIARKFFDLQDMLGFDKASKTIEWLFSKSKTSIKQLKERVAASEGGGKDEHLQVDEKEKDETLKLRVSKRRTKTMESSFKTKESRERARKRARERTMAKMKMRLFETSETISDPHQETREIKITNGVQLLEKENKEQEWSNTNDVHMVEYQMDSVSIIEKFLGLTSDSSSSSIFGDSEECYTSLSSVRGMSTPREHNTTSIATVDEEKSPISSFSLYDYLCY

SEQ ID NO: 3063 - protein, 171 aa, Zea mays
MGRSPCCDKTGIKRGPWTAEEDMTLVAHIEQHGHSNWRALPKQAGLLRCGKSCRLRWINYLRPDIKRGNFTGEEEDAIIQLHAMLGNRWSTIAARLPGRTDNEIKNVWHTHLKKRLDSSSSKTSGQAAPKRKAKKPVAAASTADGPVSMPVSSPEQPISSSATDYSMASSL

SEQ ID NO: 3064 - protein, 365 aa, Vitis vinifera
MGGASLPPGFRFHPTDEELVGYYLKRKVEGQKFELEVIPVIDLYKFDPWELPDKSFLPKRDMEWFFFCPRDRKYPNGSRTNRATRAGYWKATGKDRKVVACQSTVIGYRKTLVFYRGRAPLGDRTDWVMHEYRLCDDPSQGSGFQGAFALCRVVKKNDPTQKSSDFHGEAKGKQVGSSSSNGDFTSAAISNEILSISDNIPSQASHAYNESNYSSPMASPYEAARPVDFELSSRGTNPTDFWVSPDLILDSSKDYQQGQETVSEFVPQYDFANSMSSWNPYSEISPCSSYSNFPGEVEFADDFSRIGCMSPYSGDPNYMGFYGNEDVPYEGFENQVPICRQESGDESFGECSGLWLQEDNLVIVM

SEQ ID NO: 3065 - protein, 374 aa, Oryza sativa
MRLARQQQQVVVAATMEHDVHHHRQMMQQQQQQEMDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKQDQEWVLCRVFKKSLELAPAAAAAVGRRGAGAGTDVGPSSMPMADDVVGLAPCALPPLMDVSGGGGGAGTTSLSATAGAAAAPPPAHVTCFSNALEGQFLDTPYLLPAADPADHLAMSSASPFLEALQMQYVQDAAAAGGAGMVHELLMGGGWYCNKGERERLSGASQDTGLTSSEVNPGEISSSSRQQRMDHHDASLWAY

SEQ ID NO: 3066 - protein, 272 aa, Glycine max
MVRAPCCEKMGLKKGPWATEEDQILTSYIQKHGHGNWRALPKQAGLLRCGKSCRLRWINYLRPDIKRGNFTIEEEETIIKLHEMLGNRWSAIAAKLPGRTDNEIKNVWHTNLKKRLLKSDQSKPSSKRATKPKIKRSDSNSSIITQSEPAHLRFREMDTTSTACNTSSSDFSSVTVGDSKNIIKSEDIESMETMPVIDESFWSEAAIDDETPTMSSQSLITISNDMPLQYPFANYEETFQQSHAYDSNFDDGMDFWYDIFTRTNDSIELSEF

SEQ ID NO: 3067 - protein, 200 aa, Brassica napus
MENGLDIQQTPTMVEHPPQIQELLFSLLPYHQMIMEAIEASNDAKGCSKTAILKHVETTQTHLPPSHLTLLDYHLNQMKHSGKIVIVKNNYMKPDPKPKPQGDSRHVAVTSPSVSSSLRLRGRPSRSNDSFSGADLTEEKTEVPPSVSGRPRGRPPKKEKMVQGYDGACASRAWKATEGETITIHLAYRISLDYKLFVLF

SEQ ID NO: 3068 - protein, 269 aa, Physcomitrella patens subsp. patens
MGSLEPTHSGPSLSGSSDSDYGDDRVREQSNSKLPSSQFRGVVPQSNGRWGAQIYEKHQRIWLGTFNTEEEAARAYDRAAIKFRGRDAMTNFRPVTDSDYESEFLRSHSKEQIVEMLRRHTYDEELDQCKKVFNMDVAANAVRARRRALEINTLKECAPTREHLFDKAVTPSDVGKLNRLVIPKQHAERCFPLDLSANSPGQTLSFEDVSGKHWRFRYSYWNSSQSYVLTKGWSRFVKEKKLDAGDIVSFERGPSQELYIDFRRKQVIP

SEQ ID NO: 3069 - protein, 330 aa, Zea mays
MDFSGEIDDFSLQLIREQLLGGEASLPIVTNAAAYSASVVHHPTQAEFHQPAAFLPQPSHVAYVDLTNEYAADATVASAGGEAAFRAEPVMIRFGGEPSPVSDPSRRPLLTISLPPASHAWGPAAVPLEAPGAAALDANDFRKYRGVRQRPWGKFAAEIRDPKKRGSRVWLGTYDTAIEAARAYDRAAFRMRGAKAILNFPNEVGTRGADFLAPPPPPPQAAATSQNKRKLMHDAEATATAGAGAGAEPAKSVKAEASGSPASSLSPATTTTPASTVTTCSPSSDAAAAHEVFPMTPSSWTWEQLEGVFGSLPPLSTTHPQLGFPEVTVN

SEQ ID NO: 3070 - protein, 156 aa, Zea mays
  misc_feature (48)..(48): Xaa can be any naturally occurring amino acid
MESMAQERDALDSPALSIDKRLRSDAVESPLVDDATQPKEGADGYLKXVRKPYTITKQREKWTEEEHGKFLEALKLYGRSWRQIQEHIGTKTAVQIRSHAQKFFSKVVREPGASNSIEIPPPRPKRKPLHPYPRKCADSTVANAPMGEPKNAPVSS

SEQ ID NO: 3071 - protein, 388 aa, Oryza sativa Japonica Group
MEPATETTATSPAAAAAAQPEAEAEAEAESAATPVAVAAAAAATYQPPAPVVPVAVAGAAAGRGNGKRKRGRPRKYGPDGSLLRPLKATPISASVPDDSGGGQYTPAAAVGAVMKRGRGRPVGFVSRASPVSVAVTAATSTAAVVVSSPATHTQTPLGPLGELVACASGANFTPHIINVAAGEDVNMKVISFSQQGPRAICILSANGVISNVTLRQQDTLGGTVTYEGRFELLSLSGSFTPTDSGGTRSRSGGMSVSLAATDGRVIGGGVAGLLVAASPVQVVVGSFLPSYQLDQNATKKPVIEITTVPPPPPAIGFTISSGDPMEDSYSGSHGQHRSGAAAATTTTAKANSTSAFRVENWTPPAPPAAEAARTKTPSSEAKVPVPGA

SEQ ID NO: 3072 - protein, 494 aa, Triticum aestivum
MANSGDEGRVVTDLRSAAESAGGDEALHEIESLCMRCGENGTTRWLLTTIPNFREVVLMAFECPHCNEGNNEVQFAGQLQPKGCCYRLKVPQGQNEILNRQVVKSDSATIKIPELDFEIPPEAQRGTLSTVEGIIMRAVEELQALQDERKKVDPQKAEAIDQFLVKLRSLGSGEAAFTFVLDDPAGNSFIENPHAPSSDPLLSASFYERTSDQQAALGFLVDPPTGESGEPSQNASTVEANCGGLPKVPHGSVGAVAGRRAIAQGNPDEIAATLCRYTAPEEVDTLPSTCGACGAACVTRFFATKIPYFREVIVMAASCDLCGYRNSELKPGGEIPAKGKKITLHVQTVKDLSRDVIKSDSAAVKVPELELELSMGTLGGIVTTVEGLIVKICEALERVHGFQLGDSTNEWKKKKWDDFQQRLSKLLSLQEPWTLIIDDALAASFVAPSTDLIEDDSQLLIEDYERSWEQNEELGLNDMDTSSADIAYNTTSTE

SEQ ID NO: 3073 - protein, 116 aa, Brassica napus
SSQTSMVMENQSVSLLQPTVQNHQEHLQFQGNVVEGSFFEDLNIPNRANNSNQTFFQGNNFEAALNNSSSNGFQVVYDAPPFDMASFDYRGDMSMVGVVGTMDGMQQKQQDVSTWF

SEQ ID NO: 3074 - protein, 219 aa, Papaver nudicaule
EMSVLCDAEVALIVFSTKGKLFEYSTDSGMDRILERYERYSYAERELVTTEIDQGNWSLEYSKLKSKIEILQKNQRHFMGEDLQSLSLKELQNLEQQLDVALKQIRSRKNQLMYESISELQKKEKALQEQNNKLGKQLKEKEKEVAAQQQQASQWDQQVTQGQSSPSFLLSQSLPNLNIGNGSYQVRGGNNGNEEEIRTQTTRTNTATPMPHWMVNHLR

SEQ ID NO: 3075 - protein, 158 aa, Arabidopsis thaliana
GRLGLEITELRLGLPGDIVVSGESISGKKRASPEVEIDLKCEPAKKSQVVGWPPVCSYRRKNSLERTKSSYVKVSVDGAAFLRKIDLEMYKCYQDLASALQILFGCYINFDDTLKESECVPIYEDKDGDWMLAGDVPWEMFLGSCKRLRIMKRSCNRG

SEQ ID NO: 3076 - protein, 245 aa, Solanum lycopersicum
MGRGRVHLKRIENKINRQVTFSKRRSGLLKKAHEISVLCDAEVGLIVFSTKGKLFEYANDSCMERILERYERYSFAEKQLVPTDHTSPVSWTLEHAKLKARLEVLQRNQKHYVGEDLESLSMKELQNLEHQLDSALKHIRSRKNQLMHESISVLQKKDRALQEQNNQLSKKVKEREKEVAQQNQWEINSSSFVLPQQLDSPHLGEAYQSTNVIDNGEVEGGSSSQQQGAANNTVMPQWMLRHLNN

SEQ ID NO: 3077 - protein, 201 aa, Papaver nudicaule
DAEVALIVFSTKGKLFEYSTDSGMDKILERYERYSYAERELVTNDTDSQGNWSLEYTKLKAKVEILQKNQRHFRGEEIGNLGLKELQNLEQQLDTALKLIRARKNQLLFESISEYQKKEKALNEQNNQLEKQLKEKEKELAKRPQWEQPPNQGQTSQSFTLQSHPSLNIGGNYQGRSSGREDEVPQTQARPTILMPSWMLC

SEQ ID NO: 3078 - protein, 417 aa, Oryza sativa Japonica Group
MEMASGGGAAAAAGGGVGGSGGGGGGGDEHRQLHGLKFGKKIYFEDAAAAAGGGGTGSGSGSASAAPPSSSSKAAGGGRGGGGKNKGKGVAAAAPPPPPPPPRCQVEGCGADLSGIKNYYCRHKVCFMHSKAPRVVVAGLEQRFCQQCSRFHLLPEFDQGKRSCRRRLAGHNERRRRPQTPLASRYGRLAASVGEHRRFRSFTLDFSYPRVPSSVRNAWPAIQPGDRISGGIQWHRNVAPHGHSSAVAGYGANTYSGQGSSSSGPPVFAGPNLPPGGCLAGVGAATDSSCALSLLSTQPWDTTTHSAAASHNQAAAMSTTTSFDGNPVAPSAMAGSYMAPSPWTGSRGHEGGGRSVAHQLPHEVSLDEVHPGPSHHAHFSGELELALQGNGPAPAPRIDPGSGSTFDQTSNTMDWSL

SEQ ID NO: 3079 - protein, 189 aa, Arabidopsis thaliana
MAKEGLALEITELRLGLPGDNYSEISVCGSSKKNKRVLSDMMTSSALDTENENSVVSSVEDESLPVVKSQAVGWPPVCSYRRKKNNEEASKAIGYVKVSMDGVPYMRKIDLGSSNSYINLVTVLENLFGCLGIGVAKEGKKCEYIIIYEDKDRDWMLVGDVPWQMFKESCKRLRIVKRSDATGFGLQQD

SEQ ID NO: 3080 - protein, 210 aa, Papaver somniferum
SVLCDAEVALIVFSTKGKLFEYSTDACMDAILERYERQCCVEEELVGTDQESQGNWSLEHAKLKAKVEVLQRTQRHMMGEDLESFNVKELQNLEHQLDTSLKHIRSKKNQLLYASISELQRKEKALQEQNTILGKKIKEKEQEMGRLDQQQQSNQAQNSCSQAQNSAQNSPTFLLSQELPSLTICTGTYEPAARPIAIQTVMPPWMLRHL

SEQ ID NO: 3081 - protein, 201 aa, Arabidopsis thaliana
GDCVLMRPSDAGKPPYVARVEKIEADARNNVKVHCRWYYRPEESLGGRRQFHGAKELFLSDHFDVQSAHTIEGKCIVHTFKNYTRLENVGAEDYYCRFEYKAATGAFTPDRVAVYCKCEMPYNPDDLMVQCEGCKDWYHPACVGMTIEEAKKLDHFVCAECSSDDDVKKSQNGFTSSPADDVKVRLSLFSHLLYRCSITYL

SEQ ID NO: 3082 - protein, 119 aa, Brassica napus
IHFDYLNFNIRFKFVKGRTVSELQCETVKEENAITEDLSEWQDDASELVMGTVSNLDQRIRRLAEIVHRADDLRLRTITGVVELLSPLQQAEFLIAAAELRRGVSGWGSSHDRRRSANV

SEQ ID NO: 3083 - protein, 607 aa, Candida albicans SC5314
MFNRPEHYPPQHINQPHQDPNLNHQPFNYSHQYNGLPPIGMMMQSNTHYQPQAQPQVPQPTAIPHSQLPVHLQQQQQQQPPLVQQHHYIHQQPVFHQSNHMVTHDHKPSTSSSHKRGPWSREEDEKLLELIKIHGASNWVKISSSLETRTAKQCRERYHQNLKPSLNRSPITPEEGAKIERLVAIHGKKWAEISRHLEGRSDNAIKNWWNGGANRRRRASLATTTSSINGNNSIAEELQRKSPTPETATINSEAEMTNKQDSTYSKSILPQPQPQPQPSQSITNYPPASAPVQPQPFQHAQPQRLPSFHQLPQIAFKTSMFGKDNEKSTLPSLSKSLHPSSLSSSTPPPPENHQAAAGSSPLKSISHRSASFDINSNILPPISQSNKRRLIDDQFGRRHSSVSSTIFHNQKNVSHPNLLLVHSARTSVSGPSGSNYGTGSPSYNGSPLSMSTAASRNNSITHFELINNSTIPSRRSSTFNSDLFPNPLAKENNNGNDNHKRRESQNSSFNSPMLTPSTRFSVSSMTSVHNSTIHNYNSSSVTSPTTSFKNAYSASSTSINLPVEEEEPETGADKQKINEPSKDEVTAEQNGDEKVGKKRMAVSSLLD

SEQ ID NO: 3084 - protein, 382 aa, Medicago sativa subsp. falcata
MCGGAIISGFIPAAAAVGGSRRVTADILWPNLRRKPSSRKPFLLDDDFEAGFREFKDDSDFDEDEDEDDDEGLLVGVKGFTFGSNKNNKSSKSFVRGSSAAKPVALNSNKLAEKDSKRKRKNQYRGIRQRPWGKWAAEIRDPRKGVRVWLGTFNTAEEAARAYDAEARRIRGKKAKVNFPEEAPVASSKRLKKSPETQLLNENLNSLKPNGNQMFNFGENMENYFSPMDQVEQKPLVNNQYADIGAFSGNGVQLTSADVNAYFSSEHSSNSFDYSDLCWGEQGPKTPEISSVFSAAAPMEGESQTNMLSDNTQDMLPMQNDSAKTLSEELADIESQLKFFENDNWSDASLAALLGGDTTQDGGNTMNLWNFDDLPSIAGDVF

SEQ ID NO: 3085 - protein, 140 aa, Oryza sativa
  misc_feature (93)..(93): Xaa can be any naturally occurring amino acid
RCRYGPESRVDHASADAWASIALGRSVDLTKFNGYEELIAELDDMFDFNGELKGPKKEWMVVYTDNEGDMMLVGDDPWIEFCDMVHKIFIYTXREEVQRMNPGTLNSRSEDSHANSMERGSVGREMRGCLSTSSLNSENC

SEQ ID NO: 3086 - protein, 383 aa, Zea mays
MATGGGGGSDDFHGLTFGQKIYFEQDAGAAGGSATGGRKGKGAAASASAAQPPRCRVDGCGVDLSAVKQYYCRHKVCYMHSKEPRVFVAGIEQRFCQQCSRFHQLPEFDQGKRSCRRRLIGHNERRRKPPPGPLTSRYGPLAASLVQEPGRFRSFLLDFSYPRVPSSVRDDAWQWQGMQHGGDRMLLGTASAIQWHGNQEPHPPHRSAAAGYGNHAYNNCHGGGGLVAAAAGASMLSSAFEPPPGGGGCVAGATAADSSCALSLLSTQPWDTPTQSGSSHHNRSPAMSAAAGAFEVAPSSVVASSYTASSSWSGSRDPADGARKNAQRHDDGLHLVHPPGPVHHGHFSGELELALQGSGPPHVDHGGGTCFSHSDTNAMNWSL

SEQ ID NO: 3087 - protein, 159 aa, Solanum tuberosum
  misc_feature (158)..(158): Xaa can be any naturally occurring amino acid
RLLERYERYSYAERQLNATDIETPGSWTLEHAKLKARLEVLQRNQKHYAGEELDTLSMKELQNLEHQLDSALKHIRSRKNQLMHESISALQKKDKALQEQNNNLSKQVKEREKEMAQQTPWEQQSHDHLNSSSFVLPHPFNNLHMGEAYPTAGDNGEXE

SEQ ID NO: 3088 - protein, 260 aa, Picea abies
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQHHHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 3089 - protein, 351 aa, Zinnia elegans
MPPPLLGVEGDGLGNVSLMTSASTMESIFQKNAELTERNYLGLSDCSSFDSTAVSGISEVKRNNLNLKATELRLGLPGSQSPERDVDVDLVNSESLDEKPLFPLLPSKDGICSNSQKVFVSGNKRGFSDAIDEGKWMFGSSGTDSETSNMNGKISSGAQPVMIKDATSKVVTQEQTHATFGTNLNIVNTSNPPAAKAQVVGWPPVRSFRKNILATNSKTNDEVDGKPGPGALFVKVSMDGAPYLRKVDLRSYSTYQQLSSAIEKMFSCFTIGQCGSQGAPGRESLSESKLRDLLHGSEYVLTYEDKDGDWMLVGDVPWDMFIGSCKRLKIMKGSDAIGLAPRAMEKSKNRN

SEQ ID NO: 3090 - protein, 297 aa, Triticum aestivum
MGAPKQRWTSEEEAALKAGVAKHGPGKWRTILRDTDFSAVLRLRSNVDLKDKWRNLSVTAGGYGSREKARMALKQGKRVPKVNTEPMDVDADNLDNVHDTVIDAKPLAVVVEPSQRECSSEKSVARLDDLILEAIKKLKESSGSNKTAIASYIEEQYWPPADFQRLLSTKLKALVATGKLMKSNQKYRIAPSSVSLGGRSTKVHSTEDDKQNICIRQLTKPQVDAELDMMTHMNKEEAAAFAAKAVAEAEVANAEAEEAARAAEAAEAEAEAAKAFLDAVMLTVQNKNAASAILRAC

SEQ ID NO: 3091 - protein, 473 aa, Oryza sativa Japonica Group
MVKKHGPKKWSVIARSLNGRIGKQCRERWHNHLDPQIRKEAWTVEEERVLARAHCMYGNKWAEIAKLLPGRTDNSIKNHWNSSLRKKIDDYNTRDILPVHPPVVGDGLKQLPKRPPADNHFDLNKEPIICSRDRLGVVHSDPTSHQRASNLKDFKGCADYLSLGQPVTSCEASAADDSAFDLATQGMRMDSVHDKGTGNNFVCGKVQGINFLGDKGLKINQISDKMGCSRQAKREGEAAINGGGSSLQSEAHSVGSLCYQIPKMEDIAPAQSPVFTANYVPEHSRNVMHSPNGYTTPPTHGKGSDQLSVESILRSAAEKFHGTPSILRRRKRDKPTPAEDNDLKIGRLSSDDFHTPIGKCTTDSPQSFKTAALLSLGPMDEQGSLDVSPPYRLRSKRLAVLKTVQNHLDFSSDEMSICDTTMKSACGNSDCANASSGVSSIQGKKLDEHMIGLETLTMNFAHTTKLDATQPNL

SEQ ID NO: 3092 - protein, 301 aa, Arabidopsis thaliana
MPTLYKKAGSMNNDLWLPEEDFKGLPDNFLDNLVDPTNDVSVEDIETGDDEGDWDAKFQKLVPPPLDELMSLSYEFTCNGQRVQVQKHVPILKQSSSSEVFSTVDNSPPNVKVSKLLQSLSPVSVLKNTNGSGSPQNPNGDQKLAFLVKGIRSKRKRPTLLRVTFLKSFLLEMSQQFAPDESESSEISALKKRKKNKSRRLKCTHCETTTTPQWREGPNGRKTLCNACGIRFRSGRLVLEYRPAASPTFIPTVHSNLHKKIIYMRMKDNDQFDTRKIRAETSGPETRSRLRNFGRPMSYGQ

SEQ ID NO: 3093 - protein, 197 aa, Vassobia breviflora
LTARQVTFSKRRRGLFKKAQELSTLCDADIGLIVFSATGKLFEYSSSSMMQLIEKHTLQSERDIMDSPEQLHSSNLQSEKKTYAKVSREFVEKNRELRQLHGEELQGLGLDELMKLEKLVEGGISRVLKIKGDRYMREISSLKKKEAQLQDENSQLKQQSQARLNEEGQNVIEQGHSADSITNNLSLVNCHQDYNDS

SEQ ID NO: 3094 - protein, 197 aa, Tubocapsicum anomalum
LTARQVTFSKRRRGLFKKAQELSTLCDADIGLIVFSATGKLFEYSSSSMMQLIEKHKMLSERDNMDSPEQLLSSNLQSEKKTYAMLSREFVEKNRELRQLHGEELQGLALDELMKLEKLVEGGISRVVKIKGDKYMREISSLKKKEAQLQEENLQLKQQSQARLNEEVQNAIEQGHSTDSITNNRSLVNSHQDYNDS

SEQ ID NO: 3095 - protein, 175 aa, Cicer arietinum
LSVLRSLMPDSYIQRGDQASIIGGAINFVKELEQKLHFLGSKKEEVKSDDVGEGSNKSFSEFFSFPQYSTSGGNSASVIGEKVGEIADIEVTMVESHANLKIRSKKRPKQLLKMVSGLHNMHLTILHLNVTTTCEIVLYSLSVKVEDDCKLGSVDDIAAAVYQMLNRIQQETMLN

SEQ ID NO: 3096 - protein, 197 aa, Tubocapsicum anomalum
LTARQVTFSKRRRGLFKKAQELSTLCDADIGLIVFSATGKLFEYASSSMMQLIEKHKMQLERVNMDSPEQLQSSNLQSEKKTYAMLSRDFVEKNRELRQLHGEELQGLDLEELMKLEKLVEGGISRVLKIKGDKYMREISSLKKKEAQLQEENSQLKQQSQARLNEEVQNVIEQGHSADSITNNRSLVNSHQDYNDS

SEQ ID NO: 3097 - protein, 216 aa, Vitis vinifera
  misc_feature (157)..(157): Xaa can be any naturally occurring amino acid
MEGANGYRKGLWTVEEDRILMDYIRVHGKGKWNRIAKVTGLKRCGKSCRLRWMNYLSPSVKRGDFSQEEDDLIIRLHNLLGNRWSLIAGRVPGRTDNQVKNHWNTHLSKKLGIKKHKSKSEGSSQAQSIEAKEAHSMPSNPDSKPPSEDKNGETGPXVREDLPRSMTMLANTQDMEMGTEDYESSLWFSTGDLDLNAPSLMQFLDGHVLDFVWDGL

SEQ ID NO: 3098 - protein, 436 aa, Zea mays
  misc_feature (269)..(269): Xaa can be any naturally occurring amino acid
MATGGGSSRSDDVRGLKFGKKIYFEQDGGSGSGAGAVGGRKGKGVATGGARPASAASAAQPPRCQVDGCGVDLSAVKQYYCRHKVCNMHSKEPRVFVAGIEQRFCQQCSRFHQLHEFDQGKRSCRRRLIGHNERRRKPPPGPLTSRYGRLAASLQEPGRFRSFLLDFSYPRVPSSVRDAWPGIQHGGDRMLGTVQWHGHQEPPHPHRSAAAGYGNHAAYNCHGGLVAGGAPMLSSAAFELPPGGCVAGVAADSSCALSLLSTQPWDTTXPRPPVPSNARGRRLRRHPGGAVRHGEQLRGVERLDGLAGPRCRRRQERAASRRCSAPGPPRLRGGPLLRRARARPAGKRRAATPAARRPWRLRRRHLQPFHHQRDELVPVAALPAFIRSPRHEMWREHFCIGHHPGFVRLTLPFSFFQGGETGIPNHSRSTVNSLPV

SEQ ID NO: 3099 - protein, 336 aa, Triticum aestivum
MEFAGEADDFALDLIREHLLGGDGGVLATANHEQGPFCDDVTFPVLPPSAAEPQAYQQPMFFPQQGQRQEQTQGYMGLTHQYVNSYPAATAVFRAPEPVMIQFGGQPSPVRALSSTLTISVPPQGTFGWAGTAAAAAPAPAPVEDLRKYRGVRQRPWGKYAAEIRDPKRRGYREWLGTYDTSVEAARAYDRAAFRMRGAKAILNFPNEVGTRGAELWARPPAGPASQAAGATNKRKRSQGEDADVEVTGVVINKAVRAEAPSPSSARVSWDTPSSLSRGTASSTVTSVATTPEGEFPPTPSSSGWEQCWEALMGGMPLLSPLSPHPALGFPQLSVS

SEQ ID NO: 3100 - protein, 157 aa, Physcomitrella patens subsp. patens
EIRGSTPRSKHSATEQRRRSKINDRFQMLRNLVPHSDQKRDKASFLLEVIEYVQVLQEKVQKYETAEQGRHQERLKSMCKDKAVKPSRHSPEHRSDQTTPEDGSAASPGPVQPPRIQGGVINVSSVYSQGLLDTLTRALQSSGIDLSQANISVQIDL

SEQ ID NO: 3101 - protein, 240 aa, Papaver somniferum
VQLRRMENKINRQVTFSKRRSGLLRPCAEMSVLCDAEVALIVFSTKGKLFEYSTDSGMDRILERYERYSYAERELVTTEIDQGNWSLEYSKLKSKIEILQKNQRHFMGEDLQSMSLKELQNLEQQLDVALKQIRSRKNQLMYESISELQKKEKALQEQNNKLGKQLKEKEKEVAAQQQQASQFSQGQSSPSFLLSQSLPSLNIGSGSYQARGGDNGNEEGNRTQTTRTNTATLMPPWMLN

SEQ ID NO: 3102 - protein, 209 aa, Ranunculus bulbosus
  misc_feature (24)..(24): Xaa can be any naturally occurring amino acid
  misc_feature (65)..(65): Xaa can be any naturally occurring amino acid
  misc_feature (67)..(67): Xaa can be any naturally occurring amino acid
  misc_feature (89)..(89): Xaa can be any naturally occurring amino acid
  misc_feature (136)..(136): Xaa can be any naturally occurring amino acid
  misc_feature (185)..(185): Xaa can be any naturally occurring amino acid
  misc_feature (191)..(191): Xaa can be any naturally occurring amino acid
AHEISVLCDADVALVIFSIKGKLXEYSTNDRMEGILERYERYSYTSTELVAADPESQECLSMEYXKXKSKVEALQRSQRYFMGEDIGSXGVKELQALEQQLDTSLRQIRSRKNQLMAGSITELQKNEKALLEENIXLKKQAKEKELALSLCEQLNPVERSPYVPLPDAVPALNTSEPTNQSSGSXGEEEVXAQPSQTKTLMPPWMLHHL

SEQ ID NO: 3103 - protein, 214 aa, Ranunculus bulbosus
  misc_feature (16)..(16): Xaa can be any naturally occurring amino acid
  misc_feature (25)..(25): Xaa can be any naturally occurring amino acid
  misc_feature (32)..(32): Xaa can be any naturally occurring amino acid
  misc_feature (41)..(41): Xaa can be any naturally occurring amino acid
  misc_feature (45)..(45): Xaa can be any naturally occurring amino acid
  misc_feature (169)..(169): Xaa can be any naturally occurring amino acid
  misc_feature (188)..(188): Xaa can be any naturally occurring amino acid
  misc_feature (212)..(212): Xaa can be any naturally occurring amino acid
KAHEISVLCDADVALXIFSIKGKLXEYSTNDXMEGILERYXRYSXTSTELVAADPESQECLSMEYNKLKSKAEALQRSQRHFMGEDIGGLCVKELQALEQQLDTSSRQIRSRKNQLMAGSIIELQKNEKALLEENINLKKQAKEKELALSLCEQLNPVERSPYVPLPDXVPALNTNGPTNQSSGSGGXGGGGEEVVAQPPQTKTPMPPWMLXHL

SEQ ID NO: 3104 - protein, 474 aa, Arabidopsis thaliana
  misc_feature (223)..(223): Xaa can be any naturally occurring amino acid
  misc_feature (274)..(274): Xaa can be any naturally occurring amino acid
MPTLYKKAGFMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDVSLQGRCNVKYSEYPVLNGLSTENAGGNWPIRPRALNXYEEVVNAQAQAQAREQVSKQPFTIQEETAKSREGNCRLFGIPLTNNMNGTXSTMSQRNNLDDAAGLTQIASPKVQVLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSRLGTLTQLSCTKLAL

SEQ ID NO: 3105 - protein, 194 aa, Ranunculus acris
HEMSVLCDADVALIVFSIKGKLTEYSTNDSMESILERYERYSSSCKELPATDPESQECLFRDYNKLKSKVEALQKSQRHLKGEEIGGLGVKELQALEQQLDTSLRQIRSRKNQLMNGSITELHRSSKALHEENVNLKKQAKEMELALSVYKKHNQAPLNVSGTSTQSSETQGEGDVVQPLRAKTLMPPWMLNHL

SEQ ID NO: 3106 - protein, 387 aa, Picea sitchensis
MGRPNAEAQLNLPPGFRFFPTDDELVVHYLCRKAASQAIAVPIIAEVDLYKFDPWQLPEKALFGEKEWYFFTPRDRKYPNGSRPNRAAGSGYWKATGADKPITAKGSNKRVGIKKALVFYVGKAPKGNKTNWIMHEYRLADVNRSAKKKGSLRLDDWVLCRIYNKKSSAEKLAKEQKEWSSEEAMEQFHEEIDEKVPGILPTGNTIMNSSIEHSERTSQDSTISAPSPNCRTASNHDSRASAITSLSYNSNPIFEQNLNLSNARSAPMEIPELVPFFSSMNNHRTNYDSADLIPPILLTDSSCSMQSSHDLKSEKEEVQSSFRLEELMQQQQQENAGLNQQMFSFGFESLQNPFPSLDQIQPPTNNDPFQDYLASLTVPSYLQRSSY

SEQ ID NO: 3107 - protein, 513 aa, Schizosaccharomyces pombe 972h-
MESQPVIWYCHSCSNEFQRPGNCPRCNSDFVEMVEPNTAPEDDPRAANFVNATEFNDPNAMLQNILQSLGQGVVPNVNPTDANRTANPNTNSNPNPNATNAQPNPTMFSTGQFSTEQGLPNVFFGAAAAQPGSGTPFVMPGIVNAAQIRNFFQNIMGGNAPQPEANSEQARNANTETSNPPFASAQTQGQEHRPSSPNPAEHMTGAYVNTPLNQPPSYAASTQPEFQQTTSPIFSSSSTPPPPPPRPSQPTSGESQNTNPRFPFSAQSFVFSVGPNGALHQVNTSTENPQNAQAGAIPITDLGSILERIFGSLNQPGAQQGEGEPFNPANMFSNIFNLSGNPGDYAWGARGLDDIISQLMEQAQGHNAPAPAPEDVIAKMKVQKPPKELIDEEGECTICMEMFKINDDVIQLPCKHYFHENCIKPWLRVNGTCAICRAPVDPNSQQRNNTSTDSANGHNPSNHANPSTSTTNDQGATLRNESFNAASQSNLSSEHGHSSRTPMDDFVDEEPLE

SEQ ID NO: 3108 - protein, 216 aa, Ranunculus bulbosus
  misc_feature (214)..(214): Xaa can be any naturally occurring amino acid
GLVKKAHEISVLCDAEVALIVFSTKGKLFEYSTDSGMDKILERYERYSYAERELVTNDTDSQGNWSLEYTKLKAKVEILQKNQRHFRGEEIGNLGLKELQNLEQQLDTALKLIRARKNQLLFESISEYQKKEKALNEQNNQLEKQLKEKEKELAKRPQWEQPPNQGQTSQSFTLQSHPCLNIGGNYQGGSSGREDEVPQTQARPTILMPPWMVXHL

SEQ ID NO: 3109 - protein, 533 aa, Solanum peruvianum
MASSGGNMNTFMNSFNSFSSSQFMTSSFSDLLSDNNNNNNSNNDNKNWGFSEDRSKSFPMMNSSTSPASPSSYLAFPHSLSPSMLLDSPVLFNNSNTLQSPTTGSFGNLNSKEGNSRNSEFSFQSRPATSSSIFQSSAPRNSLEDLMTRQQQTTEFSTAKTGVKSEVAPIQSFSHENMSNNPAPVHYCQPSQYVREQKAEDGYNWRKYGQKQVKGSENPRSYYKCTFPNCPTKKKVERNLDGHITEIVYKGSHNHPKPQSTRRSSSQSIQNLAYSNLDVTNQPNAFLENGQRDSFAVTDNSSASFGDDDVDQGSPISKSGENDENEPEAKRWKGDNENEVISSASRTVREPRIVVQTTSDIDILDDGYRWRKYGQKVVKGNPNPRSYYKCTFTGCPVRKHVERASHDLRAVITTYEGKHNHDVPAARGSGSYAMNKPPSGSNNNNNNMPVVPRPIVLANHSNQGMNFNDTFFNTTQIQPPITLQMLQSSGTSSYSGFGNSSGSYMNQMQHTNNSKPISKEEPKDDLFFSSFLN

SEQ ID NO: 3110 - protein, 221 aa, Methanococcoides burtonii DSM 6242
MSAEDSSGAESPRSFETRTSCPLCQEDLIIKWQGDEIPYFGEVMYISTSCCNCGFRFTDTMILAQKEPMRFELKVEGLEDLNARVIRSTSGTIRIPELGIDVEPGSVSDSYVTNIEGILQRVQSVVVTATGWVKDDDDAYARGLELQDQIEKAIAGDFPLTVIIEDPLGNSAIISEKVVSRKLSAEEAGDLHSGMVVFDVDTSQMEVDSSDKIQPIGNSYK

SEQ ID NO: 3111 - protein, 156 aa, Zea mays
MEDLYSIHPGISRAGGAATAASEVSGVAGGPGSPPPPPSQPPPPPPADLTELVKAQIAGHPRYPSLLSAYIECRKVGAPPEVATLLEEIGRERCAAASAGGEVGLDPELDEFMEAYCRVLERYKEELSRPFDEAASFLSSVRTQLSSLCGAAASLS

SEQ ID NO: 3112 - protein, 650 aa, Triticum aestivum
MMGGGLLMDQGMAFSGVHNFVDLLQQNGADKNLGFGSLMPQTSSGDQCVMGEGDLVDPPTNNFPDAGEDDSDDDVDDIEELERRMWRDRMKLKRLKELQQSRGKEQAAGGGGAGDGLKPRQSQEQARRKKMSRAQDGILKYMLKMMEVCRAQGFVYGIIPEKGKPVSGASDNLRAWWKEKVRFDRNGPAAIAKYQADNAVPGSESELASGTASPHSLQELQDTTLGSLLSALMQHCDPPQRRFPLEKGISPPWWPSGDEEWWPELGIPKDQGPPPYKKPHDLKKAWKVSVLTAVIKHMSPDIEKIRRLVRQSKCLQDKMTAKEISTWLAVVKQEEELFMRLHPGARPPASAGGIASAISFNASSSEYDVDVADDCKGDEAGTHKMAMADPTAFNLGAAILNDKFLMQAPMKEETADMEYVQKRSAVAAEPELMLNNRVYTCNNVQCPHSDYGYGFLDRNARTSHQYTCKYNDPLPPSAENKAAPPAPPQVFPAAYNQQNHGLNNLDFGLPMDGQRSIAELMNMYDTAFPATNKNMGNDDVTIIERPNAITPVTQMDEGFFGQGNGIGGNGDSMFSDVSNMMQQQQQQPQQPQQQQQQAPAQQQFFIRDDAQFGNQMGSISGASDFRFGSGFNMSGTVDYPQKNDGPNWYY

SEQ ID NO: 3113 - protein, 267 aa, Oryza sativa Indica Group
EPHDYIGLSAAAASPTPSSSSCSSSPNPGGEARGPRLTLRLGLPGSESPEREVAAAGLTLGPLPPTTTKAASKRAFPDSSPRHGASSGSVAAAAAACQDKAAPAAAPPAAKAQVVGWPPVRNYRKNTLAASASKGKGEDKGTAEGGPLYVKVSMDGAPYLRKVDLKMYSSYEDLSMALEKMFSCFITGQSGLRKSSNRDRLTNGSKADALQDQEYVLTYEDKDADWMLVGDLPWDLFTTICRKLKIMRGSDAAGIAPRSIEQSGQSR

SEQ ID NO: 3114 - protein, 192 aa, Triticum aestivum
GTAAPCATRRRLWGWGVAPRYRGVRKRPWGRFAAEIRDPAKRARVWLGTYDSAEAAARAYDVAARTLRGPLATTNFPQDPVSFPTLPTLPHPSRPASPGPACSASSTVESYSGPRAANAPRAVPRVSAPAPLLAERSGGDAGCQSDCASSASVVDDGGDEAASAAVRPRAPFVFDLNLPPPSDELCTELRLF

SEQ ID NO: 3115 - protein, 1196 aa, Chlamydomonas reinhardtii
MNTGMAYNNGGELKQRLSRALLDVSGTLATVKSGALVQVWMPECTHDGTIVLSCQGLPFAVAGVGDLLALFRCVSVRYRFSTDVMKPSLMGAIGRVYSTLEPEMSHNVQKYDKQVYLRVSEAQRCRVHSTLIIPIFGSDARDTPLAVFELVQGDRDVTFPAVLSQLSASLQNVNLFTIDLETAATAAGLRKWPMHIDMLPASEFSSGAAGTAAGAAGGTAAAGSGPARLSPNGEGQGLHRRLGSARLADVAEDKEPAASSNVIATEEREHQSPSTSRQDEVGSWGAKRTSLTRVSTGNLHGAGGGAAGSGPVHMPTAAGGGATAGAGGIKLSSSPQTMQGPLAAAGTSPPGAGAGTGVPSVALSMPVPVPVQGMSQLTASGSGHAAGPGGAAAGLAGAGGSGLLPGSAPALLKLETAGSAGTSDGLGARQAMTPPAPVPGPPLDPNNAAQLMAWLSQQGNAGNAALDQIKALLEQQQQQQQQQQQQQQQQQQMQLQQQLQQLQALQQQQMQQQAQSQALQVRQARMSESMSVPGALAAQQLQLQQQQQQQQAPHQHQQGPMMMDVTVGSSGPLQHLAGAAVSTPSPPTTGSGLAQACSGDTNANAAGPNTLVAAVAAAAAAEQQQQQQQQAAAQMQQAAIQQAVAQASTAAAAAASMNNKLSRSGSAPRVQAAAAGAAAGDAGDDGDEEDISSGGDDDDSDDERGGGGNPRNNNRVGGGAGKRLRFEDLQAQFGLGLKEAANNLGICATTLKRACRRHGIKRWPRRQIAKLSKALNQMGYQGAPPPGLVQNAVINGVGPGGTATTATKPKPKPKPDPVALQHATQMLLAQQQAALVAAAAANGGNMAAFPSIAAAAAAGMMQVHQGHMAAAAMAPHGVYALTAGQQGAGGGGQPGSATAGGGQSMFPTHGTTTIMTPMGPMQVATQPGGGPGAGGQGMMVGGGGMQGGLTPMQMQAMGMQGTGAGGMGAVGLHPLLAAGGGYNIQQALQQHMQQQQQGMQQQQQQQQQPGAPLLGSMQNLQALQQQQQQQEALQQQQQLLQQQQQQHHHQFQHHQQQHQQQQQQSQQQVAGSSPGVSWLTHAMGGGGGGGGGGMHMGVMPPGTGCGSAATAMDIGPRVSAGDAPSPFSGLGLSPGITDSGIPDIPEDFIANLNGAGAGPGAGGGMAPMTASMFKTNAANSELLGLFDDELAGISAR

SEQ ID NO: 3116 - protein, 448 aa, Oryza sativa Japonica Group
MSSTAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAFGQLLSRRLVVVPEAAAGSGGDSPEERKDEGEIVEEQEQLLYRVPIFDPALSEFCSPPPLEDAAAAVSCCNEDGAVENPTKPSMTTTTATTPPLQFFPDGQANFGPTDAELREFAADMEALLGRGLDDGNDEDSFCMETLGLIEPVDDDAGRVKVEADGDAGMTLAWCHELDTETSSGEMLDIDFDCGSPQAATTPDEKVGSSGPAAADDDAQLQQSNLALSLNYEAIIESWGTSPWTDGERPHVKLDDSWPRDYSGVWMAAAGVFGHGGEEQALTPRLGMDGGREARVSRYREKRRTRLFSKKIRYEVRKLNAEKRPRMKGRFVKRAAAAATAAVATACVA

SEQ ID NO: 3117 - protein, 283 aa, Glycine max
MYSTHQQHQGKNIHSSSSSSRMPIPSERHMFLQTGNGSGDSGLVLSTDAKPRLKWTPDLHARFIEAVQQLGGADKATPKTVMKLMGIPGLTLYHLKSHLQKYRLSKSLHGQSNNATHKITINSGSATDERLRENNETHVMNNLNLAPQSINKDLHISEALQMQIEVQRRLNEQLQVQRLLQLRIEAQGKYLQAVLEKAQETLGRQNLGVVGLEAAKLQLSELVSKVSSQCLNSAFSELKEIQGFSPHHQKQTQTNNNQPINANDCSMDSCLTSCEGSSQKDQQ

SEQ ID NO: 3118 - protein, 328 aa, Oryza sativa Japonica Group
MGEQQQQVERQPDLPPGFRFHPTDEEIITFYLAPKVVDSRGFCVAAIGEVDLNKCEPWDLPGKAKMNGEKEWYFYCQKDRKYPTGMRTNRATEAGYWKATGKDKEIFRNHHMLIGMKKTLVFYKGRAPKGDKTNWVMHEYRLADASPPQPPPPPSSAEPPRQDDWAVCRIFHKSSGIKKPVQVPMQMPMQMQMPVAHQVPAANYQQQMAMASASIIQVPMQMQMPSMSDQLQMLDDFSTGSLMAPPPPPPSYSTLPGFPLQINGGAQQFVGNPSMYYQQQQQQQQQQMDMAAGGFVVSEPSSLVVSPQATWTLPSGSTDTYIHTYIHT

SEQ ID NO: 3119 - protein, 253 aa, Picea sitchensis
MGRSPCCEKVNTNKGAWTKEEDDRLIAHIRAHGEGGWRSLPKAAGLLRCGKSCRLRWINYLRPDLKRGNFSQEEDELIIKLHSLLGNKWSLIAGRLPGRTDNEIKNYWNTHIKRKMLSKGVDPQTHRPLGDPYNGCNNASISRPAPDYEIPAFENPRTPEIADFFQYNRSESSPIEPAGSKDEEHPDLNLDLCISLPSHSTPAASRVSSVVRTVDSNPNSLACNIGLRVNYGGYCESRYFEQNVGDFSHSGLV

SEQ ID NO: 3120 - protein, 340 aa, Medicago truncatula
MEQATVGLSGSIHDDSVQFDEEIQGIMIPAPAPENASSFTALLELPPTLAVELLHLPEQKPYLPNSSNGNLTFPTNAALIERAAKFSVFAGENSSPGDSRLFPVESVKNEPQETDSNPCSTQECVSDPAENKNQRNVKRKEREKKGKASSSKKSKSIADETSGAGEKLPYVHVRVRRGQATDSHSLAERARREKINARMKLLQELVPGCEKISGTALVLDEIINHVQTLQRQVEILSMKLAAVNPRIDFNLDRLLAADGSSLMDSNLPSTMVTPLVWPEMPLNSNRQHYQQQWQFDAFHQPLWGREEDNHNFTTPENSLLSYNSSANSASLHSNQLKMEL

SEQ ID NO: 3121 - protein, 282 aa, Solanum tuberosum
MVGKTSSDLPPGFRFHPTDEELIMYYLRYQATSRPCPVSIIPEIDIYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEVEELEAQNVSINNAIEVVGGPQTMKLPRICSLSHLLELDYYGSIPQLLSDNLLYDDQSYTMNNMSNTSNVDQVSSQQQNTNNITSNNCNIFFNYQQPLFVNPTFQSQ

SEQ ID NO: 3122 - protein, 840 aa, Mangifera indica
MMATASSELSIKSSNETSKSPMEEDKDLNLETALYKELWHACAGPLVTVPRQGERVYYFPQGHIEQVEASTNQFADQQMPIYDLRSKILCRVINVQLKAKPDTDEVFAQITLLPEPNQDENAVEKEPPPPLLPRFHVHSFCKTLTASDTSTHGGFSVLRRHAEECLPELDMSQQPPTQDLVAKDLHGNEWRFRHIFRGQPRRHLLQSGWSVFVSSKRLVAGDAFIFLRCEKELRVGVRRAMRQQGNVPSSVISSHSMHLGVLATAWHAVSTGTMFTVYYKPRISPAEFIVPFDQYMESVKSNYSIGMGFEMRFEGEEAPEQRYTGTIVGIEDADPQRWPDSKWRCLKVRWDETSTVPRPERVSPWKIEPALAPLALNPLPLSRPKRPRSNMVPSSPDSSVLTREGSFKVNVDPSSATGFSRVLQGQEFSTLRGNFAERDSNEFDTAEKSVVRPSSLDDKKIDVVFASRRYGFENCVPAGRSEPMCTDLLSGLGTNSDSVHGYSPSIDQSLASAVPVRKSLLSQEGKFNMLGSPWSLMPSSLSLKMPETNAKVQVQGGDINYLVQGNARYGGLSDYPTLQSHRVGPSNGNWFMPPLVSSHFENLVPSRELMEKPISVQHHEAGKTKDCKLFGIPLVSSSCVTPEPILLHQNSMNEPVGHMNHQLGVLESDPKSEQSKSPTLANDSNCVSEQGKPSQTCQPHVKDVHSKPQSGSSRSCTKVHKQGIALGRSVDLSKFNNYEELIAELDRLFEFGGELMTPKKNWLIIYTDDEGDIMLVGDDPWKEFCGMVRKIFIYTREEVQKMKPGSSLSKGDENLSIGEGTEAKEVKHQSVPSACNDENC

SEQ ID NO: 3123 - protein, 207 aa, Ranunculus bulbosus
RHEMSGVCDAEVALIVFSTKGKLFEYSTDSGMDKILERYERYSYAERKLGASDTDSQGNWSLEYTKLKAKVEILQKNQRHFRGEDIANMSLKELQNLEQQLDSALKLIRARKNQLTYESISDLQKKEKVLQEQNNQLEKQLKEKEKELAKREQWEQPNQGQTSRSFTPQSPSSLNIGGSYQGNNGGEGFQTQNRPTILMPPWMLSHL

SEQ ID NO: 3124 - protein, 223 aa, Solanum tuberosum
MAPKEKIGAVTAAAVMAVGKLNGISKEVHYRGVRKRPWGRYAAEIRDPGKKSRVWLGTFDTAEEAAKAYDNAAREFRGAKAKTNFPQLLKEEDLKFPVKNEINRSPSQTSTVESSSPVMVDSSSPLDLRLCGSIGGFNHNTVRFPISGGGFTGAVPAVNHMYYLDALERAGVINLETNRKKTVDFLGGGDSDTSTVIDFMRVDVKPTIAGLNLDLNFPPPENM

SEQ ID NO: 3125 - protein, 227 aa, Glycine max
FCVWETVSELGPEDSGRNIVEIIFKSSWLKKDNPICKIERILKVHNTQRTIQRFEECRDTVKNRALGSTKKNPRCAADGNELLRFHCTTLTCALGARGSSSLCASVHGSCGVCTIIRHGFQGGSCGGGSGDHGKAKGVRTTASSGRAHDSVVCGDATRRAMLVCRVIAGRVKRVVEDAPSEEEHVSVASYDSVAGYAGIYSNLEELVVFNPKAILPCFVVIYKVPSC

SEQ ID NO: 3126 - protein, 269 aa, Glycine max
  misc_feature (184)..(184): Xaa can be any naturally occurring amino acid
MSNSISDPTRIIHSQDPNTTADPQVPLRNLSQVRNRMDSLQHFLSQSINTNTPLTVDQIAMVSSQILSSIHQVIVNGAALVSYSQNSIAAGAPDPPPYPKKPKPEPSVADKAKQTLDSKLEPLEGDDSEIVELDAVEILAEHMHFCEICGKGFRRDANLRMHMRAHGEQFKTAEALAKPSEKAXCNRNKLHRRFRPLKSVICVKNHFKRSHCPKMYTCERCRKKHFSVLSDLRSHLKHCGGEARATRLRSRVTKRVKGNKWWRTTKIQC

SEQ ID NO: 3127 - protein, 618 aa, Glycine max
MMMMFDEMGLCNNLDMISAPLGEEDITTRQTDPEVIVEDDFTDEEIGVDELEQRMWKDKMRLKRLKEQSKSKEGIDAVKQRQSQEQARRKKMSRAQDGILKYMLKMMEVCKAQGFVYGIIPEKGKPVTGASDNLREWWKDKVRFDRNGPAAIAKYQADNTIPGRNDGCNSIGPTPHTLQELQDTTLGSLLSALMQHCDPPQRRFPLEKGVPPPWWPTGNEEWWPQIGLSKDQNSPPYKKPHDLKKAWKVGVLTAVIKHMSPDIAKIRKLVRQSKCLQDKMTAKESATWLAIINQEEALARELYPDYIPPLASAGGSGSLVINDSNEYDVEGGEDEPNFDVEDCKHENLHTSNLGMERVRVTLPVQQPSFSIKGETVTNLDFIRKRKVSNDFNMMDLKIYTCEHPQCPYSQVRLGFPDRISRDNHQLICAYRGTSDFGGPSFPVNEIKPVVHPPSFVQPKSTAQPGSMVPPVIDLTGLEVSDNGQKMITDLMTNYDTNVRGNKKTSSCNHLAAENFDLPQHAMQQQQDNFIRGQGITAEGNIFDEANMPNNHHMFAREEGQFDRFKALNAPFETNHNNNNFHSMFGSLCDLASFDFKEDMQGVGMDTLQKQPDISIWYQ

SEQ ID NO: 3128 - protein, 210 aa, Syringa vulgaris
SMLCDAEVALICFSYKGKLFEYATDSCMDRILEKYERYSFAERQLVTNEPQSPANWTLEYSKLKARIELLQRNHSHYMGENLDSMSLKELQNLEQQIDTALKNIRSRKNQQLHESISEMQKKEKALREQNNMLEKKIKEKEKEMAVQPQWGLPNHGANGPQFLLAPQLPGLNIGGAYEGESAEATRNELDLTLEPVYNCKGEFQHTGGRY

SEQ ID NO: 3129 - protein, 232 aa, Syringa vulgaris
  misc_feature (231)..(231): Xaa can be any naturally occurring amino acid
RMENKINRQVTFAKRRNGLLKKAYELSVLCDAEVALIIFSNRGKLYEFCSSSSMLRTLERYEKCNYGAPEPHVSSREALELSSQQEYLKLKARYEALQRSQRNLLGEDLGPLNSKELESLERQLDMSLKQIRSTRTQAMLDTLTDLQRKEHALNEANQSLKQRLMEGNHISLQWNQDPEEVGYGREPTQHQPHGFFHPLECEPTLQIGYQNDPMAAAGPSLNNFMSGWLPXI

SEQ ID NO: 3130 - protein, 277 aa, Brassica oleracea
MNTFPASTEMVGSENESPVTTVVGGDYYPMLAASCPKKPAGRKKFQETRHPIYRGVRLRKSGKWVCEVREPNKKSRIWLGTFKTAEMAARAHDVAALALRGRGACLNYADSAWRLRIPETTCHKDIQKAAAEAALAFEAEKSDVTMEETMAVASQAEVNDTTTDHGMNMEEATAVASQAEVNDTTTDHGVDMEETMVEAVFTEEQSEGFNMAEESTVEAAVVTDELSKGFYMDEEWTYEMPTLLADMAAGMLLPPPSVQWGHNDDLEGDADMNLWSY

SEQ ID NO: 3131 - protein, 228 aa, Oryza sativa Japonica Group
MAASEQSSESSSTASTSSCGKKQQVAGKRKREDVGGGGEQAAAVAYRGVRMRAWGKWVSEIREPRKKSRIWLGTFPCPEMAARAHDVAALSIKGARAVLNFPDLAPALPRPASLAPRDVQAAAALAAVMHHHKHPSSSTSTSSPPAAPPPDEHHPRHEPQQPESSREDDQQQQPAAAAAAQMAVAELVFDELAPLWVEDVVEFGTSDHCWTAYDALDPIGFQPLLWEY

SEQ ID NO: 3132 - protein, 715 aa, Arabidopsis thaliana
AECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSNGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDNGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCDLVPSNSDLRQEYSPFGIRQLMISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNVSPSLSLHIIWYQL

SEQ ID NO: 3133 - protein, 207 aa, Syringa vulgaris
ALVQLRRMENKINRQVTFAKRRNGLLKKAYELSVLCDAEVALIIFSNRGKLYEFCSTSNMLKTLERYQKCSYGSLEVNNSTRDLEESSNREYLKLKSKYESLQRHQRHLLGDELGPLNINDLEHLEHQLETSLKHIRSTRTQVMVDQLSDLQAKEKMMVETNTALERKLEEIYAANQLQQSWAGGEQSCAYSQQHLNLRTFFNLWMQ

SEQ ID NO: 3134 - protein, 370 aa, Zea mays
MDAAHWQQGLGLVKPMEEMLMAANAGAANPSQSSNPNPPAPAPSLAPGGLLGGGAPAPLAGAGSTERRARPQKEKALNCPRCNSTNTKFCYYNNYSLQQPRYFCKTCRRYWTEGGSLRNVPVGGGSRKNKRSSSSASASASTSGSVTSSSMASTAGAGSKNPKLAHEGAHDLNLAFPHHGGLHAPEFAAFPSLESSNVCNPGGGMTSNGRGGGAGPAVGALSAMELLRSSGCYMPLQMPMPMAMPGDYTAAGFALGEYRTPPPPPSQSVLGFSLDAHGPGSGATAAGYGSSAGLQGVPENAGRLLFPFEDLKPPVGSEGGGGATGGASDGNSSHTQFDHNNKEQGGGGTGAGHDTPGFWSGMIGGSGASW

SEQ ID NO: 3135 - protein, 283 aa, Arabidopsis thaliana
MYPSLDDDFVSDLFCFDQSNGAELDDYTQFGVNLQTDQEDTFPDFVSYGVNLQQEPDEVFSIGASQLDLSSYNGVLSLEPEQVGQQDCEVVQEEEVEINSGSSGGAVKEEQEHLDDDCSRKRARTGSCSRGGGTKACRERLRREKLNERFMDLSSVLEPGRTPKTDKPAILDDAIRILNQLRDEALKLEETNQKLLEEIKSLKAEKNELREEKLVLKADKEKTEQQLKSMTAPSSGFIPHIPAAFNHNKMAVYPSYGYMPMWHYMPQSVRDTSRDQELRPPAA

SEQ ID NO: 3136 - protein, 423 aa, Oryza sativa Indica Group
MDAQYNPRTVEEVFRDFKGRRAGLVRALTADVEDFFRQCDPAALVGSCLDSWEHMSQAYNGRRRSTLLALLQAMLLVPTRFSYVTTVFRKTTVGSKEKENLCLYGFPNEHWEVNLPAEEVPPELPEPALGINFARDGMQEKDWLSMVAVHSDAWLLSVAFYFGARFGFDKNDRKRLFGMINDLPTIFEVVSGKSKAKPPSANNHSNSKSKSSNKTKSSEPRAKQPKPQPQPPVKNEGREEEGGPDDEEGGGGGGGGREEEHGETLCGACGESYGADEFWICCDICEKWFHGKCVKITPAKAEHIKQYKCPSCSGGNGGGGGGSGNGKQLKICSTKREAIISQYLVRDERSKNTSTHARSPLISDNPYEVISDIRIMLAEQYTTNAREDDFDAKPNDKYNQGEGNVAWGGINKELYSLQVTIQN

SEQ ID NO: 3137 - protein, 250 aa, Brassica oleracea
MNSVSTFSELLGSENESPVGGDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQAEVNDTTDHGLDMEETMVEAVFTEEQRDGFYMAEETTVEGVVPEEQMSKGFYMDEEWMFGMPTLLADMAAGMLLPPPSVQWGHNDDFEGDADMNLWNY

SEQ ID NO: 3138 - protein, 114 aa, Zea mays
KGSPERGQRRIGRPFFFVEVEALVFPVEKLGTGRGGDFKFRAFANGKPRPFFVFKDKWKTWGPPASFSPQQGGGEPVPQELFARVLAAQAYWSHHQPKLHLKTPPLRGGARLLP

SEQ ID NO: 3139 - protein, 479 aa, Oryza sativa
MVEPGRARETKVTASASSSAGSDAAVMKKKKKKKKLVVASRKVDEKDKKQVDYKCSRSSGRDECCKVESRHQQCTEPESPSYRLALRSLFSCRNSSSSSHAGHHHHRAADGKKLGCNSSSICKVKQDNPMQQHMRRAEDELKVKDKPPVAEPYCKRRASVSACNISSERSVKKSVKQQQQEASSSLQSSASISASSCSSTAGGGGSFRGMQQLSLRRLSGCYECHMVVDPISGVFRDNSSMRATICSCPDCGEIFVRPDSLHLHQSIRHAVSELGAEDTSRNIISIIFQSSWLKKQSPVCAIDRILKVHNAARTLARFDDYRAAVKAKAMAHRHPRCTADGNELLRFHCATLSCDLGLHGATHLCDHLSCAACAIIRHGFRPPAPGAGIRTMATSGRAHDAVVSSGSEGDRRAMLVCRVIAGRVRREEAAAAAAEEEEEEEEEYDSVAGTTPGLYSNLDELDVFNPTAILPCFVVVYRA

SEQ ID NO: 3140 - protein, 125 aa, Arabidopsis thaliana
MELYRSVLYLVSYLSVVVSKPISINLRFQLLLILECDEDEKNDKDQYDVRTHSLPYEKYGPYTCSKCKGVFNTSQSFAAHMLSHYNHETTKEREHRLTARNKKRYRNYMENLKRSQQKVGSILVT

SEQ ID NO: 3141 - protein, 418 aa, Arabidopsis thaliana
MNSFSQVPPGFRFHPTDEELVDYYLRKKVASKRIEIDIIKDVDLYKIEPCDLQGLAGKSYHLSLVVISLFWYKLRLTILCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRVFKKKLAATVRKMGDYHSSPSQHWYDDQLSFMASEIISSSPRQFLPNHHYNRHHHQQTLPCGLNAFNNNNPNLQCKQELELHYNQMVQHQQQNHHLRESMFLQLPQLESPTSNCNSDNNNNTRNISNLQKSSNISHEEQLQQGNQSFSSLYYDQGVEQMTTDWRVLDKFVASQLSNDEEAAAVVSSSSHQNNVKIDTRNTGYHVIDEGINLPENDSERVVEMGEEYSNAHAASTSSSCQIDL

SEQ ID NO: 3142 - protein, 212 aa, Zea mays
MSISVNGQSVVPPGFRFHPTEEELLTYYLKKKVASERIDLDVIRDVDLNKLEPWDIQEKCRIGSGPQNDWYFFSHKDKKYPTGTRTNRATAAGFWKATGRDKAIYASPGARRIGMRKTLVFYKGRAPHGQKSDWIMHEYRLEAPVDAGAGAAHHLLLPAAEHPPYYTSPPQAPSSTTTATIRGAAGDQAAQEQEGWVICRVFKKKNLVHHGQ

SEQ ID NO: 3143 - protein, 502 aa, Populus trichocarpa x Populus deltoides
MDKQGRELVFFHSGDFLRQNPGVSDHTNDSSSDHTKPIIKEVDFFSSDRTSELPGTDQEKKIGTIGSSSLVDSSINTGLNLLTSSSGISIIANVKNTDNNELSGLQGELERLHDENKKLRSLLDQITKSYRDLQAQLIMATQKQTQGNRIEQKGELNDTPGSIMSAQHLMDPRPRPSVTLDVNDPSVSDDKTQEVLVSSTNTVGTKSQMLGKRASIEDGLDQTSQSWGSPKSPKLEHEKPDEQTPEVPFRKARVSVRARSDAPLISDGCQWRKYGQKMAKGNPCPRAYYRCTMAVGCPVRKQVQRCAEDKTILITTYEGNHNHPLPPAATAMASTTSAAAAMLLSGSTTSKEGLSSSSSFYPSFPYASTMATLSASAPFPTITLDLTQGPNTTMPFHRTSPSPATFPLPLHGFPQLLGHPMYASPKLPAIPSVQLGQRHASMVETVTAAIASDPNFTAALAAAISTFMGTPRSSDGTNNHNAPSGIPGSPQLPQSCTTFSTN

SEQ ID NO: 3144 - protein, 734 aa, Arabidopsis thaliana
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINALLYLGKEIRPKNKLEQWFCGKVSHSRNSPLHSPHCQGTIQAYKLAVVCLLSSRSFLIQATYSASGKPHTTRLVNGMFVQFKYKNLGDFCEHCGMISHRKCEKVAKQRCLTRAGLKRYDSQRVGKGLSVKSHYSQSYVDMGLLFEETLTYAQFMVEVRVDVVYASEHEWGGKKLIRSLLVNLTSGEVDDRGQGQHRPWTSRSLNEAEEDLVKAEMGSSVVHVEKKGMVLINLMRVRTQRCLGKIIIDSDMNNCTRYILLYRDESVDYLVRVIRGVMNEFGFTHFPDSYINRLVTWVKNSNYFSPNFPKDCILITNVWQCLALTWICLAHVVYVKKISFLGWKQPLLLLVLMFSILSALKTGCNNLKIVHFVVSCFQYQVGEIES

SEQ ID NO: 3145 - protein, 443 aa, Oryza sativa Japonica Group
MDFSCLQPHSGGCDDMPFDSYVQQNGHQELHLVDHPFNNVTDGHEYYSPSAGGSFLPFATYYDLGHEYYPQGGEKDAVVVDRASPTIRKASPHLPLFTPKSEVSHLIGGGVVGSYKAFEMNSRLIRRKRASGKSLKKANVVKGQWTLEEDRKLVKLVEQFGLRKWSHIAQILPGRVGKQCRERWHNHLRPNIKKDTWSEEEDIVLIQTHKEVGNKWAEIAKHLPGRTENSIKNHWNATKRRQFARRRSRASSKNPKSGTLLQNYIKSLGIGPIKSSVRQAPPESTAVSSSSPASTQKLAEVNGKIRPDSNPSNQMVTQGILTMDENSYIQTNSCEELLVSTYDDLCLDMCDHLFETKDEMPYQVYNIDDDVDMNYIFNHIDYANKIGHEIDMEMAWDDDVLQDDESAGSSPLETPAGLAQINTVHVKEEMDLIEMVTRTQSCG

SEQ ID NO: 3146 - protein, 342 aa, Arabidopsis thaliana
MDTAQWPQEIVVKPLEEIVTNTCPKPQPQPLQPQQPPSVGGERKARPEKDQAVNCPRCNSTNTKFCYYNNYSLTQPRYFCKGCRRYWTEGGSLRNIPVGGGSRKNKRSHSSSSDISNNHSDSTQPATKKHLSDHHHHLMSMSQQGLTGQNPKFLETTQQDLNLGFSPHGMIRTNFTDLIHNIGNNTNKSNNNNNPLIVSSCSAMATSSLDLIRNNSNNGNSSNSSFMGFPVHNQDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 3147 - protein, 405 aa, Oryza sativa Indica Group
MAAKLRCPEEQELLGGSEVDAVGEPSCMDAAHWHQGLGLVKPMEEMLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 3148 - protein, 354 aa, Cicer arietinum
MSPDIAKIRKLVRQSKCLQDKMTAKESATWLAIINQEEALARELYPDYCPSLSSGGGSGSMVINDCSEYDVDGADDETNFDVVEDRKPENLHPSNLGMERMRGMVPVQQPSLPMKGEVVTNLDFIRKRKISNDFNMIIDQKLYTCEHPQCPYSEVRLAFQDRSSRDNHQLNCPYRNSPADYGGSNFHATEVKPIIFPQSFVQPNSTAQPAGLVPPSFDLTGLGVPEDGQKMITELMSIYDTNVIGNKNASSTNCVAVENQNLSQPCIQQQQDNFFSSQGMVMEAANFFTRDESQFDRFKPINSPFETNHNNNNIHLMFGSPCDLASFDFKEDIQLQGVGIDTFHKQPDMSIWYN

SEQ ID NO: 3149 - protein, 113 aa, Zea mays subsp. parviglumis
MGRRACCAKEGVKRGAWTSKEDDALAAYVKAHGEGKWREVPQKAGLRRCGKSCRLRWLNYLRPNIRRGNISYDEEDLIIRLHRLLGNRWSLIAGRLPGRTDNEIKNYWNSTLV

SEQ ID NO: 3150 - protein, 350 aa, Picea sitchensis
MAMSSGKQEVEYTEMSVLDQIRSHLLGDFEPSFFVTGNWGSDPTRNSSPEEENFIQTALTADSVDDSRRETETETLIAAVKSSRPLLSVSVTRHESFDWEKISVDWALKNSVTPSVSPCFSAAWTKLPLDENDSEDMVLYGILKEAATKGWLPRTPKEEPVTEIKKEAALPVKPDADIRQETGATPPPPPPPTVKNNAGRHYRGVRQRPWGKFAAEIRDSSRQGARVWLGTFTTAEEAALAYDRAAYKMRGSRALLNFPLEVGAEDSNTCNNNTSTIEKVESNLSKKRQREEVEVQWNRQCRVRFEDSNTMDHEMVEELLGGKLATPPLTPSGIDMSFTGFLSRGQLTVN

SEQ ID NO: 3151 - protein, 328 aa, Hordeum vulgare
MCGGAILAQLIPPSAGRPSKQAAAGGRAPPTSSKKGGVSKSRHSSTPDADDDVFEAAFEDFDDHFDLRAEEDGGDDHVVFASKPAFSPRPAYDGGRAAHAASRKKRTGHLHGIRQRPWGKWAAEIRDPHKGTRVWLGTFDTADDAARAYDVAARRLRGSKAKVNFPDAARTGARPRRASRRTAQKPQCPPARTTAYSATAAARAQPEQDAMMVKPELMEFFNVDAIVHLTTAVAALPPVTASTFADTMPRVDEDSSVGSGGGAMLGFADELGFDPFMMFQLPCSDMYESADSIFAGDAVIPDALSVDSGMDAVSLWSFDEFPMDSAIF

SEQ ID NO: 3152 - protein, 992 aa, Arabidopsis thaliana
MAVEDDVSLIRTTTLVAPTRPTITVPHRPPAIETAAYFFGGGDGLSLSPGPLSFVSSLFVDNFPDVLTPDNQRTTSFTQLLNGTMSVSPGGGGRSTAGMFAGGGPMFTIPSGFSPSSLLTSPMFFPPQSSAHTGFIQPRQQSQPQPQRPDTFPHHMPPSTSVAVHGRQSLDVSQVDQRARNHYNNPGNNNNNRSYNVVNVDKPADDGYNWRKYGQKPIKGCEYPRSYYKCTHVNCPVKKKVERSSDGQITQIIYKGQHDHERPQNRRGGGGRDSTEVGGAGQMMESSDDSGYRKDHDDDDDDDEDDEDLPASKIRRIDGVSTTHRTVTEPKIIVQTKSEVDLLDDGYRWRKYGQKVVKGNPHPRSYYKCTTPNCTVRKHVERASTDAKAVITTYEGKHNHDVPAARNGTAAATAAAVGPSDHHRMRSMSGNNMQQHMSFGNNNNTGQSPHSSPAGPPRPVRRRLDTNVHRSHTQDPHNRHVLPGPPSHRRVVNSSPKKHRNNDDDAPKSRTTGVSLRSGLPHSNVEAEQVAAGWPSWLSSAAPEAVHGWVPLRAEDFEKREKIGQGTYSNVFRACEIKCYMKQLLWGVEHCHLRGIMHRDIKAANILVNNKGVLKLADFGLANIVTPRNKNQLTSRVVTLWYRAPELLMGSTSYSVSVDLWSVGCVFAEILTGRPLLKGRTEIEQLHKIYKLSGSPDEEFWEKNKLHPQTKMFRPQHQYEGCLRERFDEFPKTAINLLENLLSIDPEKRGTASSALMSEYFNTQPYACDPSTLPKYPPNKEMDAKYREELQRRRRVSIKKRDNLATKKLGKSRRATVKEPTNLNRLPTHQETKKEAETEIVVQTPSETSQATTRSEFPYNSLSQTTAPASGFAWAGTKKRKENDVASTLTYIQPGSASHVSGMSMAFAKNTFGLTINEDKPFLRPHVSLDPSDVLLFSGVNHKKTEEDMDLTNLGANPKIFQTNGMNEILRRTESDVRVGVRRPPRIERGED

SEQ ID NO: 3153 - protein, 329 aa, Arabidopsis thaliana
METFGVFHKEDDEQMDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 3154 - protein, 220 aa, Vitis vinifera
MKGEDNYKKGLWTKEEDRILLDYIQVHGRGRWNRISKITGLKRYGKSCRLRWMNYLSPSVKHGEFTEQEEDLIIRLHNLLGNRWSLIAGRVPGRTDNQVKNHWNSHLCKRLGIKKKNRKTAVTSLKPHSTNVDNTPKRQALVDSISKPFHDNNMDVGGVTRRQCPLSGAQVSEEQPAEVGWHCVDSLWASTAEHLRVCTPTSIEFLEGYYSPGDAFWQGL

SEQ ID NO: 3155 - protein, 239 aa, Zea mays
MEGDDDGPEWMMEVGGAGATGKGKGGALDKNKKRFSEEQIKSLESMFATQTKLEPRQKLQLARELGLQPRQVAIWFQNKRARWKSKQLERDYSALRDDYDALLCSYESLKKEKHTLLKQLEKLAEMLHEPRGKYSGNADAAGAGDDVRSGVGGMKDEFADAGAAPYSSEGGGGGKFAHFTDDDVGALFRPSSPQPSAAGFTSSGPPEHQPFQFHSGCWPSSTEQTCSSSQWWEFESLSE

SEQ ID NO: 3156 - protein, 633 aa, Oryza sativa
MVLQKRLDYGSHGHRAPIKPRVATLAPVKRSTRIRKKQMYALDLLATAAEKLLADQDNLSSGPNINETPEGYVTSMKPVKAEQFDEAFPLRSVAVKKDDCKGCTVGCAGICGFLRQANMCLAENSSTQNLADSVLESLTAKPDVLAKDSFVSSKKSCRLGFGLGTIPEYGSVGVCQPWSTRSAEVKQVHRARPTAIRSQEDSDAAALCALVETMDLDTKPLAEASSGSNSGVHICGPDRGHNSHPSCLAKVQHAADRDDDENSSGCVHPSTSGNNRGYIPHYIGDRRIRRLFASRLRKAARNRICGEMSCKGNKLSLCEKKMPTTRRRVQQTTLKRKRLAQLYSEKSSDEVKLTIKSFNIPELLIEIPENATVGSLKKTVSDAVTTIIERGLRVGILLQGKNIQNDNKTLRQAGIYRGKKLNDIGFTLECEAGQDSHPGVIVPEEMDFVGASVVDKSATVKCEEPAENQQLMQDFPGCSLSDPGSVDYPVEWSTQETSASSQAIVPFADPNSLALANVPLSRSKRPDFGQRRIRRPFTVAEVELLVEAVEHLGTGRWRDVKFRAFENVHHRTYVDLKDKWKTLVHTASIAPQQRRGAPVPQELLDRVLAAQAYWSEQQAKLHGDPPVPEICPT

SEQ ID NO: 3157 - protein, 710 aa, Oryza sativa Japonica Group
MDTPDRPPRAAATAAVEMLRPFAAPDWGLIVLEVSIQDSPVFNFINSLSPIPPPKPSDSAHNVQLFKSSDLAPVSSIFASPHVNPAKESKLPIREDSVQLSRESHSPNSVRTRTGATSSIIRMIRCKNIVSENCSITCYLNDSTSSKASQPIQLCGGSAESDTNQNTDGKKDPTTEQDRTDIEFVLLDQCGPEKMDSSQSGNNACENQLSEQHKDELGSFDGGYMFAHQPHSDMLRLAPPFESETQLVNETLQTDNVYCETLLTDGPSGSYTQNSAPDPHLYWAGAVEGCATDYTPQMLPGACQSQLVPNDQINNKLNEPSDYMPMDHNVSSQNLRGMRRRCLFNEKSGAANEGAKNSSARHSTNSTTPRRKISSSDNNLKTLRTPPCALPGIGLHLNALATVPKDKMTAVVAYVGESSQGSPKKKRHKFDNGDGTSCKRCSCKKSKCLKLYCECFHAGVFCSEPCSCQGCLNMPSNMETVLSTREQIESRNPLAFAPKVIRTEPGQELAGGVGCSVSCRCEGCKNAFGRREGVALLGIEEAKRGCEEKDGGVKEETTDNDKQLVIYQDSINLTPAESVLATPSVVDYRPLVALPPLSSKKPRSSTKLGGYSSRLEGHLKSDILLSPFESYAEMMLGDGTSNVLKGESSPQTSVKVVSPNKKRVSPPRIGTGLSPICKSGRKLILKSIPSFPSLGVDITNEDPNTSSLAP

SEQ ID NO: 3158 - protein, 410 aa, Zea mays
AIYRIVAIDVRSRREGRDLRKVGFYDPIKNQTCLNVPAILYFLEKGRRDANPNRGPAPTPPNHLSPPPSGEGDDGITASGAPVGGDAAASASAAAAANATIEERVRGPWSPEEDAVLSNLVEKFGARNWTLIARGIPGRSGKSCRLRWCNQLDPQVKRKPFTEEEDRIIMAAHAVHGNKWASIAKLLDGRTDNAIKNHWNSTLRRRYCNDGQCKHGGSVERSIPKVSREVSEEPWPLNDLNSFTAMDVKDDPVQTAPDTSPRARHITDHCSITQVVDPPYLSRPAAKIGAFRPYYLGHTEPTQQEMPGAVVMFDSTHKVSTPESEVFKFVDPICFAAEVPDKCGYGCCGAHEQHRKNSLLGPEFSEFEGHPPVLNISFASLVSEISSIAWMRSGMQSSDSSNLMQSIPPT

SEQ ID NO: 3159 - protein, 369 aa, Populus trichocarpa x Populus deltoides
MTRRCSHCSNNGHNSRTCPTRSSLASSSSSPLSGVKLFGVRLTDGSIIKKSASMGNLSAHYHSSSSAAASPNPDSPVSDRVHDDGYLSDDPAAHASCSTSRRGDRKKGVPWTEEEHRLFLIGLQKLGKGDWRGIARNFVVSRTPTQVASHAQKFFIRQSNATRRKRRSSLFDMVPEMATDPQPVPEEQELPSSQAGDDDNVDALPSLNLSLKPEFEPMDTESQELVKERDKTVMGFSEFKPSVPSSSEFVPIVSGSNEFTAVPGFFPAYMPVPYPYWAPNTTPFEEGKGAATSHHEVLKPVPSILKEPFNVDELVGMSHLSLGEIERRHREPSPLSLKLIGEAPRQSAFHASAPASGSDLSNGKVAPKG

SEQ ID NO: 3160 - protein, 148 aa, Arabidopsis thaliana
MTSIPNGLNSYVDDTVNICGFTPIEMSSNLRNHESKMVHSMFNTSDHTNHHDIEYDGRTHSLPYEKYGPYTCPKCNSVFDTSQKFAAHISSMHYKNESIEEKFKRYNARNKKRLRKRNQMIHEESNNIQPEEIVAEESGGDNNIASSK

SEQ ID NO: 3161 - protein, 110 aa, Brassica napus
MPLPWKKSKSGRISKFVSDLQQSPKRGGSLVVETGFPTSLIHLFFKNRDRLKKSSSKRNNNNKAQIPTGPSHSHSTRQRVASLPPPISSLPASVTEDPAASKIDESFVCD

SEQ ID NO: 3162 - protein, 320 aa, Arabidopsis thaliana
  misc_feature (9)..(9): Xaa can be any naturally occurring amino acid
  misc_feature (45)..(45): Xaa can be any naturally occurring amino acid
KILGIQETXDLLTQLSLPPGFRFYPTDEELMVQYLCRKAAGYDFXLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 3163 - protein, 235 aa, Populus trichocarpa
MKIQCDVCEKAPATVICCADEAALCEKCDIEVHAANKLASKHQRLLLQCLSNKLPPCDICQEKAAFIFCVEDRALFCRDCDEPIHSAGSLSANHQRFLATGIRVALSSSCSKDTQKSSLEPPNQSEQQTSKLPWQHASSFGSSWAVDDFLQFSDIEESTDKKEQLGLGEFDWLADMGLFSEQLPQEALAAAEVPQLPISPPTNVNAYRPPKFSMSHKKPRIEIDDDEYFTVPDLG

SEQ ID NO: 3164 - protein, 203 aa, Brassica napus
  misc_feature (177)..(177): Xaa can be any naturally occurring amino acid
MGVPKHKWSQKEESALRSAVSKHGPGRWRTILKDPDFSQVLFLRSNVDLKDKWRNISVMGYGSGSRPKPVKRTLGSLPSDEEILEMVDAKKFSTTGSSALQVSSPRTPNWLDSLITEAICTMKQPCGSSKTAIGNYIQERYEVPPNFKQLLSSKLKYLSGFGSGKLIKVKRKYRIPXNSAALSSHKKRHLGTSSDKDEVSVQR

SEQ ID NO: 3165 - protein, 362 aa, Oryza sativa
IGKRESTCIAQQGNSCCYPLFLFSASPCSLSLSLSLSLSLSSLPFFLSISCSAKSPRPNKGEDGGGEAEASHRRGKGDAMWDLNDSPAAEAAPPPLSPSADDSGASSSSAAAVVEIPDDADDDSAAVVVVTRQFFPPAVPGGGGDPAPGNARPGWLRLAGAAPPVAATGPAASAAVSKKSRRGPRSRSSQYRGVTFYRRTGRWESHIWDCGKQVYLGGFDTAHAAARAYDRAAIKFRGVEADINFSLEDYEDDLKQMSNLTKEEFVHVLRRQSTGFPRGSSKYRGVTLHKCGRWEARMGQFLGKKYVYLGLFDTEEEAARAYDRAAIKCNGKDAVTNFDPSIYAGEFEPPGGCVMCALTAHG

SEQ ID NO: 3166 - protein, 212 aa, Arabidopsis thaliana
MGPTYRALPVGMRFRPSDLELAVYFLIKKALGLPMKALTVPDECNDIFSTHPRDLPGYGSEEHWYFYCKKPKNQVTRTKSYNLWIPTGEKTDVLDPKKNGGELVGIKHSFTFIENEEEEESDNKNGDEEEPPQCNWFLDEISLPLTVVDTDWTLCHIFYEKVKPEFGNLHIVESESESEEEEEDESVDKPAESLDSVKEKDGTVLPPPPATP

SEQ ID NO: 3167 - protein, 594 aa, Oryza sativa Indica Group
MPAVKVEEEEEEERNPVASSPSVSEGSAHAAALASPTAADSIFGRRRKSGPVRRAKGGWTPEEDEKLRKAVDIYNGKNWKKIAESFSDRTEVQCLHRWQKVLDPELIKGPWTQEEDDVIINMVKKHGPKKWSVIARSLNGRIGKQCRERWHNHLDPQIRKEAWTVEEERVLARAHCMYGNKWAEIAKLLPGRTDNSIKNHWNSSLRKKIDDYNTRDILPVHPPVVGDGLKQLPKRPPADNHFDLNKEPIICSRDRLGVVHSDPTSHQRASNLKDFKGCADYLSLGQPVTSCEASAADDSAFDLATQGMRMDSVHDKGTGNNFVCGKVQGINFLGDKGLKINQISDKMGCSRQAKREGEAAINGGGSSLQSEAHSVGSLCYQIPKMEDIAPAQSPVFTANYVPEHSRNVMHSPNGYTTPPTHGKGSDQLSVESILRSAAEKFHGTPSILRRRKRDKPTPAEDNDLKIGRLSSDDFHTPIGKCTTDSPQSFKTAALLSLGPMDEQGSLDVSPPYRLRSKRLAVLKTVQNHLDFSSDEMSICDTTMKSACGNSDCANASSGVSSIQGKKLDEHMIGLETLTMNFAHTTKLDATQPNL

SEQ ID NO: 3168 - protein, 169 aa, Picrophilus torridus DSM 9790
MDEITEVICPVCGKNLYYTGSQVNIPYEGNIIIETYFCKSCGYHNSYTNTLEEPKGHKRLKLKIRNREDLKTIVYRSSKADIIIPEIDAEITHASNTTGYITTVEGIIYRIKDHLDLMGDGEEINYLHQRIDGILNGPEEEVTLILDDVSGLSRINSSKVEIEEVAGDQ

SEQ ID NO: 3169 - protein, 113 aa, Zea mays subsp. parviglumis
MGRTACCAKEGVKRGAWTSKEDDALAAYVKAHGEGKWREVPQKAGLRRCGKSCRLRWLNYLRPNIRRGNISYDEEDLIIRLHRLLGNRWSLIAGRLPGRTDNEIKNYWNSTLV

SEQ ID NO: 3170 - protein, 197 aa, Physalis crassifolia
LTARQVTFSKRRRGLFKKAQELSTLCDADIGLIVFSATGKLFEYSSSSMMQLIEKHKMQSERDNMDSLEQLQSSNLQSEKKTHAMLSREFVDKNRELRQLHGEELQGLGLEELMKLEKLVEGGISRVLKIKSDKYMKEISSLKKKEAQLQEENSQLIKKSQARLNEEGQNVIEQGHSADSVANNISLVNSHQDYNDS

SEQ ID NO: 3171 - protein, 361 aa, Zea mays
  misc_feature (153)..(153): Xaa can be any naturally occurring amino acid
MAPRKEIMAGDHGGGEGEEVVVLVGDYDYELEEEDEDMLPGFRFHPTDEELVTFYLRRKVAGKRLTIEIIKDFDIYKHDPWDLPKSSSTISGETKEWYFFCLRGRKYRNSIRPNRVTGSGFWKATGIDRPIHSAASGRAGDPIGLKKSLVFYXRGSAGKGTKTEWMMHEFRLPPRADTAHASPSEQEAEVWTICRIFRRNFTYKKQGVHCSSKMSSAAAVVAQPGESSSVTAGSMESDTGDEYTNGLLPQTPLLQDPVNMIDGYSYSYGYDHHHHQQQQLQHGQWNSHALHAAATAPLPSPTTMAAFHHGVLSSPPAAASGPLDDMYYKDGSSWDDIGRMVMELTDPSPSVFSFYDTRSYA

SEQ ID NO: 3172 - protein, 277 aa, Oryza sativa Japonica Group
MEGVQHMEATSKCQTRHTHTEQQQQQQQHQTARHNERSLAFQAIKRFDMVKTAASNGAAAARRVGGGGDGKRAAYKGVRMRSWGSWVSEIRAPSQKTRIWLGSYSTAEAAARAYDAALLCLKGSAAADLNFPVRLPFDLPAAAMSPKSIQRVAAAAAANANANASSSCSAAVFAGVDDSGGASASEASTPACSSSDGAASPSPVSSPETVISDVDVDYSLLADIEAFFQSPKCMEYAMMDPCSAFFAPPPPPAMAMEEECGWEEEGDIALWSFSSLD

SEQ ID NO: 3173 - protein, 1013 aa, Oryza sativa Japonica Group
MSTGGNGGGVGVRRRRWNLYWCYVCRRALRVVVPSATSDVYCPRCFGRFLHEIDLPVPRVSPPAEDQFFQPPFLPYDGPRRWVLYTGGGGGGDYGGADVTARRRRLPSPPPAPGTRRQDGAGDGDPPPPAPAIDPGEYFAGPDLNALIDALTQDDRPGPPPAPESAIESLPTVHISPDHLPADGGSECPVCKEEFELGEAARELPCKHAYHSDCIVPWLRLHNSCPVCRQEVPPPPEPDGESPGIDGGCDDGVGGGGEPAEPPRPAMAGWDPIALLAIALRPDLNGWENSHGRSESEADDDEVAGGGVSPHLLKRTTTLTFWVLHPPIITGVHALTKPALDERCRWNRFGFFLFDEKIGCCTAARSSSPTTATASSATRSTPRRCGFSTTAPAAAGEEWCRRSARRSSSTSSPSGAAAATGLAFVVAPSATLPGASPEIYLGVLGPRTNGNASDHVFAVEFDTVMDLEMNDTNGNHVGVDVNSLVSVVSEPVAYYAGDGSTKVPVQLESAQQIQAWIDYDGGSSILNVTVAPATVTERPRRPLISTKLDLLPIFKENMYVGFSSATGKLASSHYILAWSFRTNGVAQSIDLRRLPKVPRQSSPPPKLLIIKFAAVACAGTLTLIAAAMVAVLWLRRRAALADTLEEWELEHPQRIPYKELYKATKGFKESELLGAGGFGQVYRGVLRRRSGEAVAIKRISNGTRQGMREFVAEVASLGRMRHRNLVELRGWCKHDQDLLLVYEFMPGGSLDARLFGTAASAAAAEGVKAPPPPPLLTWAQRFAILKGVAHGLLYLHEEWEHVVVHRDVKANNVLLGAGDTGAARLGDFGLARLYEHGATPATTRVAGTLGYMAPELTFTSRATTATDVFSFGALLLEVACGRRPIEPAAAGEADGDVLLVRWVRDRALDGDGGGGDVLRAVDPRLEGCYDEEEARLVLWLGLMCSQARPEARPSMRQVCRYLDGEEMLQEDATPAAIFSGADSSDLFGGSFVVSMTSSSAGGTMSASSLQGGR

SEQ ID NO: 3174 - protein, 244 aa, Zea mays
  misc_feature (230)..(230): Xaa can be any naturally occurring amino acid
MEEERCFNNWDLDAVVRLGCRRLLSPSPQPDPFASFLPPPPQKEKPVAPAPAKEPEPHTAWRFPDLGAGGGQDGEELLRALLADQPPLHQPLPTPAATPTPTPTATPPPPSQQQHLQPTVTAVDVAPPQVRPAPARAQPSGRQVPGGVPRSKRRKNQVKKVVCHVPADGSSPDVWAWRKYGQKPIKGSPYPRGYYRCSSSKGCAARKQVERSRADPNTFILTFTGEHNHXAPTHRNSLAGTTRH

SEQ ID NO: 3175 - protein, 988 aa, Chlamydomonas reinhardtii
MDTATAGPMMREDVQGALGAAFSAGMVGAHGSSALPLHLGAAHAATIAQLAASPLAFATIAGPLAVADFAQANVELLRSRSSAEQRPEQPRPSALPTARLIEVARAALQTVRRGQGVPLGAAPAAASEPTASERQREVVGGSQGRPPLLKREAPESDSVDRDRLSEAKRTRIDAPDAQTRFSLSASVPAAAASSADAVAHVSADSADTSVPAPVAELAESVPISTAAPAKLVSPFAAPPLPQLPGQSSVSGCDADGATTRATGAGSQAAPSLGGFKSAFAAAAAAELWEPGCSFTTGRRSARSSALKSNGTASLPRALASEGQSLSRRGSGFVVAAAALAIGSDATAANAAAHSGLERPERGRSGTMGAWGSGGGSKPESAASADLRRLAQLAEAAALLEGFSAGHVRGNAADGADTGGKATTSPSRHRAGSLPTAGMVAASGAAASATGSGGSGSGGCGGSSGRQQAPQQHQQLAGNSSGAGAAHGGGGASLRSANSLPLRALESQPLPGSRSRSERAARDGSPDSADGCNGSAGLSRGRSGELDSWRGGARGSGAHDDGTDADEGMEGDDLLADEDEDDSAGGDSSGRSLTDRYRAVLKASAQQRGRGSGSAGRGGGGRAGSPDDEDVLGRSGSMRNGVCARIASITKERLQQVYHLNIEEAARELGIGMTKLKEHCRTLGIPRWPSRKLKSMDKLIESLNERAAIEPATKEVINDILAEIESFKRAIYENPCLEVEEDIKRLRQSNFKKEYQQRQVEQRLRVSEPRSERERGGASSLGRAASGSLATSSQQQERPATGSGAVASRGARYGGNLESSPSLPLTEAGACGMGVPVGVAALALAAQAAEMPAVNLARAASLAAVAGLIQPVMPPSNVLDISVQSAAALAPPPPPQLPGLLPPQLHQLLLVQQHAALHSQGITALLPAGVLPMPLQAADKPQERAGDTNHCDAPAAAEPLSAADNLAERVSVAVDRVGSEASPKVAVER

SEQ ID NO: 3176 - protein, 397 aa, Oryza sativa Japonica Group
MFDAFDVLDMFIPDKILPKRATRIKLDIYFVKTSPEGGFGMSHREALAQVTAQASHSPLRMFDHTEQPSFSAAPTSSEAMQHMNAAVNMTGISDMVMGPTNNENVAFQPAEASQRYQVNAPVDKPADDGYNWRKYGQKVVKGSDCPRSYYKCTHPNCPVKKKVEHAEDGQISEIIYKGKHNHQRPPNKRAKDGSSSAADQNEQSNDTVSGLSGIKRDQEAIYGMSEQLSGLSEGDDMDDGESRPHEADDKESDSKKRNIQISSQRTSAEAKIIVQTTSEVDLLDDGYRWRKYGQKVVKGNPHPRSYYKCTYAGCNVRKHIERASSDPKAVITTYEGKHNHEPPVGRGNNQNAGNAAPSSSAQQNMQNLSSNQASLTMADFNNINQRPIGVLQFKSEE

SEQ ID NO: 3177 - protein, 406 aa, Oryza sativa Japonica Group
MGSKKRSPQHPAAAAPPPAVGGGGGGEVSGDGGASTANGPVVPKPSEVAPFLTKVYDMVSDPATDNVISWAEGGGSFVIWDSHAFERDLHRHFKHSNFTSFIRQLNTYGFRKVHPDRWEWANEGFIMGQKHLLKTIKRRKKSSQESPSEIQKAPVKTAPGTENIEIGKYGGLEKEVETLKRDKALLMQQLVDLRHYQQTSNLEVQNLIERLQVMEQNQQQMMALLAIVVQNPSFLNQLVQQQQQQRRSNWWSPDGSKKRRFHALEQGPVTDQETSGRGAHIVEYLPPVPETSGQVNPVEGAICSANSQPVPSPAVATPMDMQTSNVADTLGSSEEPFADNSTLHEWDDNDMQLLFDDNLDPILPPFENDGQMGPPLSVQDYDFPQLEQDCLMEAQYNSNNPQYGND

SEQ ID NO: 3178 - protein, 317 aa, Populus tremula x Populus alba
MERKEAVKVENFVGSPTFSSTTDHVQTSYPFMQGFDFVDDKSSLGFMELLGVQDFSPSLLDMIQVQIPSVQTPSAQVATEVVDSPPEVLNQPATPNSSSISSASSEGLNDEPANKGVDNEVEEQGKTKKELKPKKTNQKRQREPRFAFMTKSEVDHLEDGYRWRKYGQKAVKNSPFPRSYYRCTTASCNVKKRVERSFSDPSVVVTTYEGQHTHPSPVMPRPNFSGSTSDSGFSSTAAFAMPMQRRLSLYQQHQSQQQPPFPLVSLSPLGFGYNGNSTNAASYLQYEKRFYTSPGSALLKDHGLLQDLVPSHMLKEE

SEQ ID NO: 3179 - protein, 164 aa, Physcomitrella patens subsp. patens
GKGKTSTSSFASDGKDSKSMEANEQTSLKRQRSGPVKAERSASENSGDSVGPSSLKASSKSVQNLPKQDYIHVRARRGQATDSHSLAERVRREKISERMKFLQDLVPGCSKVTGKAVMLDEIINYVQSLQRQIEFLSMKLAAVNPRLDYGFDVLGKDLLQLRSP

SEQ ID NO: 3180 - protein, 521 aa, Oryza sativa Japonica Group
MGVLRRELMVELVMGVIFLVLIPCLVSRRIPSKSHELTGLSQGEQAAGDLADIVLRAGGAAAAAVAGGGIPSTEWQLPPAEEEEEEPGLFPLPPSSSDGSGMSGADAFGDPFAGLPDPFGGDYPSSGGAAAAADFFDAVVAKAGFVDVGVLGGGGGGGCDGGGVDGGGGGSSLLGMSKPILPRAAMQLPSVSPRAIRAVPRDGRLHALQFPHLAPPNKAVRIKIKERNCEPVFDLFRQKQQKSRKNQARKVVCIPAPAAAGGRTSGEVVPSDLWAWRKYGQKPIKGSPYPRGYYRCSSSKGCSARKQVERSRTDPNMLVITYTSEHNHPWPTQRNALAGSTRSHHAKNSSSNSSSSGASSASKNNSSHSGYHHHHHQKPLVKAEPNDQSAAATTAATVPVKEEAAMDAAAAASATAAAVEHSDLMQQMFSQSYRPMIPEAAAGGHQDDFFADLAELESDPMSLIFSKEYMATNYKPAGDPAGKEMNAVDKGLDPAYMLDWSSTTVVTRAGGSSFMQGEGGL

SEQ ID NO: 3181 - protein, 248 aa, Anthurium andraeanum
MTAKAKRGAAVAAEARVAKKRVVKLNKGPWTAEEDQKLVEYVDAHGDRKWTSLPTKAGLNRCGKSCRLRWLNYLRPGIKRGNISEAEEDMIIRLHNLIGNRWSLIAGRLPGRTDNEIKNYWNTHLSKKPLTISDLNDKLNDDGGSRSDVDEPPSSGQSQGPLDSRRPAEPRISEASNEVAFNVDELVNLPAILDFDDLLDSGSCSDGIITSSQIFWTPNFSAHDQQDISDFDDLGMLMDIMDYVICPP

SEQ ID NO: 3182 - protein, 443 aa, Arabidopsis thaliana
MNRHRLLSAATDECNKKLGQACSSSLSPVHNFLNVQPEHRKTPFIRSQSPDSPGQLWPKNSSQSTFSRSSTFCTNLYLSSSSTSETQKHLGNSLPFLPDPSSYTHSASGVESARSPSIFTEDLGNQCDGGNSGSLLKDFLNLSGDACSDGDFHDFGCSNDSYCLSDQMELQFLSDELELAITDRAETPRLDEIYETPLASNPVTRLSPSQSCVPGAMSVDVVSSHPSPGSAANQKSRMRWTPELHESFVKAVIKLEGPEKATPKAVKKLMNVEGLTIYHVKSHLQKYRLAKYMPEKKEEKRTDNSEEKKLALSKSEADEKKKGAIQLTEALRMQMEVQKQLHEQQEVQRVLQLRIEEHAKYLEKMLEEQRKTGRWISSSSQTVLSPSDDSIPDSQNMSKTKASSPQPPLPAENKASETEDDKCESPQKRRRLENIAESEDPKR

SEQ ID NO: 3183 - protein, 147 aa, Populus trichocarpa x Populus deltoides
MIKDLRTKGPESEDMDNTHPSKCNEIKRRCTDCQTTRTPCWRGGPAGPRTLCNACGIRQRKKRRALLGFDKGGPERSREKMAKGSNSSKLGVSLNLGLMGFKRDGMFQEDWKIKLGEEEQAAILLMALSCGSVLPWYKKDEGKHFYP

SEQ ID NO: 3184 - protein, 416 aa, Triticum aestivum
MDPVPSLVKEEEEEEGAHGRGDSPGARAAPRPMEGLHDAGPPPFLTKTYDMVDDPNTDSIMSWSAGNNSFVVWDPHAFATVLLPRHFKHSNFSSFVRQLNTYGFRKVDPDRWEFANEGFLRGQRHLLKNIRRRKPPAHTASNQQSLGSYLEVGHFGYDAEIDRLKRDKQLLMAEVVKLRQEQQNMKVHLKAMEDRLRGTEQKQQQMTSFMARILRNPEFLKQLIAKNEMSKELHDAISKKRRRRIDGGPEAYAVGASSSNLEQESPVVFDSHGSVELLAEGSVPVPVELLADGIPPDLEGSVDLLGDEIPPGLEGSVALLADGLEGSVELLVDGIPSDLNGSGIDANGVTEPQDFGLGTCEAQQNRVPGLFHDNFWEELLNKGLSGENDEPVNADGMDVLSEKMGYFIPNSPTLST

SEQ ID NO: 3185 - protein, 113 aa, Zea luxurians
  misc_feature (42)..(42): Xaa can be any naturally occurring amino acid
MGRRACCAKEGVKRGAWTTKEDDALAAYVKAHGEGKWREVPXKAGLRRCGKSCRLRWLNYLRPNIRRGNISYDEEDLIIRLHKLLGNRWSLIAGRLPGRTDNEIKNYWNSTLV

SEQ ID NO: 3186 - protein, 308 aa, Arabidopsis thaliana
MPLEAVVYPQDPFGYLSNCKDFMFHDLYSQEEFVAQDTKNNIDKLGHEQSFVEQGKEDDHQWRDYHQYPLLIPSLGEELGLTAIDVESHPPPQHRRKRRRTRNCKNKEEIENQRMTHIAVERNRRKQMNEYLAVLRSLMPSSYAQRGDQASIVGGAINYVKELEHILQSMEPKRTRTHDPKGDKTSTISLVGPFTDFFSFPQYSTKSSSDVPESSSSPAEIEVTVAESHANIKIMTKKKPRQLLKLITSLQSLRLTLLHLNVTTLHNSILYSISVRVEEGSQLNTVDDIATALNQTIRRIQEETLFSK

SEQ ID NO: 3187 - protein, 113 aa, Zea luxurians
  misc_feature (109)..(109): Xaa can be any naturally occurring amino acid
MGRRACCAKEGVKRGAWTTKEDDALAAYVKAHGEGKWREVPQKAGLRRCGKSCRLRWLNYLRPNIRRGNISYDEEDLIIRLHKLLGNRWSLIAGRLPGRTDNEIKNYWXSTLV

SEQ ID NO: 3188 - protein, 197 aa, Physalis alkekengi
LTARQVTFSKRRRGLFKKAQELSTLCDADIGLIVFSATGKLFEYSSSSMVQLIEKHKMQSERDNMDSPEQLQSSNLQSEKKTYAMLSREFVEKNRELRQLHGEELQGLGLDELMKLEKLVEGGISRVLKIKGDKYMREISSLKKKEAQLHEENSQLKQQSQARLNEEGQNAIEQGHSADSITNNLSLVNSHQDYNDS

SEQ ID NO: 3189 - protein, 318 aa, Oryza sativa Japonica Group
MASCRRGGGGDVDRIKGPWSPEEDEALQRLVGRHGARNWSLISKSIPGRSGKSCRLRWCNQLSPQVEHRPFTPEEDDTILRAHARFGNKWATIARLLAGRTDNAIKNHWNSTLKRKHHSSLLADDLRPLKRTTSDGHPTLSSAAAPGSPSGSDLSDSSHHSLPSQMPSSPPHLLLPQHVYRPVARAGGVVVPPPPPPPPPATSLSLSLSLPGLDHPHPDPSTPSEPAVQLQPPPPSQMPPPTPSCVRQEPPQMPFQLQPPPPPRPSAPFSAEFLAMMQEMIRIEVRNYMSGSAAVDPRSSPDNGVRAASRIMGMAKIE

SEQ ID NO: 3190 - protein, 299 aa, Oryza sativa Indica Group
MMAEALREVLPLPYFPGQPCWYLQERRGAEAWSAEENKVFERALAQVDLDSPNRWEMVAAMLPRKTVIDVVNHYRDLENDVGSIEAGLVPFPHYSSSLSPASSGFTLQDWDGSDGGFRRGCYLKRGRAPDQERKKGVPWTEEEHKSFLMGLKKYGRGDWRNISRYFVTSRTPTQVASHAQKYFIRLNSGGKDKRRSSIHDITTVNLPEEDTSNPSPSPPSVLTTASDQLGSLVDTKPVPPPPSLGAQRHFMSPLPGALGVSHHPYGNVKLEPNASFLAGGGTGPGLDDAILLQMQCGHL

SEQ ID NO: 3191 - protein, 113 aa, Zea luxurians
MGRRACCAKEGVKRGAWTSKEDDALAAYVKAHGEGKWREVPQKAGLRRCGKSCRLRWLNYLRPNIRRGNISYDEEDLIIRLHRILGNRWSLIAGRLPGRTDNEIKNYWNSTLV

SEQ ID NO: 3192 - protein, 257 aa, Antirrhinum majus
FPFSSSSLNGLNFGKKIYFENVGSSGLQSSPSKKGRSGGVVQGGQPPRCQVEGCKIDLSDAKAYYSRHKVCGMHSKSPKVIVAGIEQRFCQQCSRFHQLPEFDQGKRSCRRRLAGHNERRRKPPPVSTISPRYGSLSPTIFDNYSKPGGFVLDFSSSHPNLTGKDSWANTSSERGLGNQLSWQSNSQNPLPDFLQGSSTSSRPSYSGHGVSSVECFGGVSSDSSGALSLLSNQPWGSRTRASSLGLNNFLGTTTNGE

SEQ ID NO: 3193 - protein, 248 aa, Zea mays
  misc_feature (62)..(62): Xaa can be any naturally occurring amino acid
  misc_feature (103)..(103): Xaa can be any naturally occurring amino acid
  misc_feature (118)..(118): Xaa can be any naturally occurring amino acid
MGRGKVQLKRIENKINRQVTFSKRRSGLLKKAHEISVLCDAEVALIIFSTKGKLYEYSTDSXSMDKILERYERYSYAEKVLISAEYETQGNWCHEYRKLKAKXVETIQKCQKHLMGEXDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 3194 - protein, 323 aa, Antirrhinum majus
SAAGGAEESLNGLKFGKKIYFEEAKAKKGKSTGGVVRCQVEGCEVDLSDAKAYYLRHKVCSMHSKSPKVIVAGIEQRFCQQCSRFHQLPEFDQGKRSCRRRLAGHNERRRKPSPGSMMSPYYGSLSPTLFDNQNRTGGFLMDFSTYPNLAGKDSWPNTIPERGLGGPASPWQSDMQNPVPEFLRGTTNRPSFSGLGVSSEECFSGVSNSSTALSLLSNQSWGSRNSNNFLGTNGNGPTIVQPSINPGATIGQFTCPSWGFGGNPADNTSHDMPPNLNLGQFSHSSNSHYTGEPGVVQLSHGQFQDLDHSRGYDSSVQDMHWSL

SEQ ID NO: 3195 - protein, 805 aa, Zea mays
MPPATAMAPPSQPPSNSGDPLYPELWRACAGPLVTVPRVGDLVFYFPQGHIEQVEASMNQVAGNQMRLYDLPPKLLCRVLNVELKAETDTDEVYAQIMLMPEPEQTDVPAEKPSSAPAASPRPAVRSFCKTLTASDTSTHGGFSVLRRHADECLPPLDMTQSPPTQELVAKDLHGMEWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSIGMRFRMRFEGEEAPEQRFTGTIVGCENLDPLWPDSSWRYLKVRWDEPSTIPRPDRVSPWKIEPASSPPVNPLVHSSRAKRPRQNVPPPSLESSVLTKEGATKVEIDSAQTQHQNSVLQGQEQMTLRNNLTESADSDSTVQKPMMWSPSLNGKAHTHFQQRPAMDNWMPLGRRENDFKDTRSAFKDARTASQSFGDTQGFFVQAYDDNHHRLSFKNQGSTHRFADPYFYMPQQSSVTVESSTRTQTANNDLCFWGDQNAMYGNPSDQQQGFNFGQNPSSWLNQPFPQVEQPRVVRPHATVAPFDLEKTREGSGFKIFGFQVDTTSPSPVQLSSPLPAIQEHVLQTRPSAPVNELQPVQIECLPEGSVSTAGTATENIQQAPQSSKDIQSKSQGASTRSCTKVHKQGVALGRSVDLSKFTDYGELQAELDKMFDFEGELVSGSQNWQIVYTDDEGDMMLVGDDPWEEFCSIVRKIYIYTKEEVQKMNSKSAAPRKEESPAAGGGGGCAAATNE

SEQ ID NO: 3196 - protein, 186 aa, Triticum aestivum
  misc_feature (172)..(172): Xaa can be any naturally occurring amino acid
MEAVLRHPSLSRLKAPNPAAHRTQYLSITVPRRPRVPKRRLAAAALFQDQTNPRTAATSKGGDEEDEEGYGEVDRIVSSRTVKNAVFAEDGSATTVTATEYLVEWKDGHEPTWIPSEAIAADVVAEYETPWWDAAKKADVDALGALLADEALRRDPDAEDAQGRTAMHFAAXLGSEECLRLLAEAG

SEQ ID NO: 3197 - protein, 82 aa, Brassica napus
  misc_feature (47)..(47): Xaa can be any naturally occurring amino acid
EDGEGEGEGEEDNKEGGEQKMSHVTVERNRRKQMNEHLTVLLSFMPXFYFKRGDQALIIGGVVEYICELQQVLQSLEAKKQL

SEQ ID NO: 3198 - protein, 772 aa, Zea mays
MDTPDRPRAGAGAGFEDSPVFNFINNLSPIPPPKPLDSAHNVQLFKSSDLAPVSSIFASPHVNPTKGTKVLIRDESVQLPHELHSPSSVRTRIGTSGSFRMIRCKDIVPENCNITCQLNEASIDSSDHTSSSTGQLTQSIKDAAGSMESDKDQCAGGKIDLTMSQECTGLEGMNLDESSPDRMDSSHSGIVVHENQLSEQNNDEPAAYNGVYMITHQSSSDMLTLAVPSGTEAQPMNDTQKADNPYPCESLLDVQSSGNCTQNSVHEPHLYWNGAVEGAAVAYTPQALPGALQSQLMPCNKLNEPKDYMPTEQNALSQHLRGMRRRSLFNEKAGLSNKGVDKASDHHPVNSTTPKCKTISGDNSKTLRTPPCALPGIGLHLNALAATATPKEKIVPQDIQSTINESSNLIGPAGSSPAPSEQNIINDDFTQTTDVATAEASSQGSPKKKRHKFDSGDGTSCKRCSCKKSKCLKLYCECFAAGVYCSEPCSCIGCMNNQSHTETVLSTRQQIESRNPLAFAPKVIHTSEPGLELRDFSNKTPASARHKRGCNCKKSSCLKKYCECFQGGVGCSISCRCEGCKNAFGKREGAAVLSIEEPKQGLEEKDVCVKEEKSEIEKQLVVYQTPDDAPAENVLTTPSMVQCRPLACRPPPSSKKSSKKPRSSTKLTGHPSRLCNLQAPPKTDTMLSPFENYAEMVLGDSTSDILKGNSSPQTSVKVVSPNKKRISPLRMGTGLSPICRSGRKLILKSIPSFPSLGGDVNNEDPETKLPAP

SEQ ID NO: 3199 - protein, 728 aa, Candida tropicalis
MSKKSNSTNNPGDPRVKKNAFVHKLYTMLNDPNLSHLIWWTTNNVEGNTFALYPGKEFANCLTRYFKHGNVASFVRQLHMYGFHKVSDPHNSSSSSSALSINHINSPYSMNIVHQHQNNAGGAHNNKDVPPIWEFKHSSGKFKKGDEKSLALIKRRSSSNSSSGSRNNSYNETLTLQNHVHPVPQQPMYQEYPIPQQNITYDPYNLNMNFQQQQPPPPPPQPFMYYNNQPQPVPPPLPPPPPLAANQQQLPTPQFVYGQPYFQYPGSIIPPQSQPQPVPQPPPQAAAPPVPSGVTQFTNFSQFPSPSPQQPISQMMNLQPSQNSASNTPQIQQPTPQHVEPPTKRQDCTPDHVKLESLSKSPHQNSAGYNATLQFRKIWDDNNGPVARQRNPSLLYDPLTTIPPTTTPQQQSKSNEGSSSESILPPPSQLNRSSSLNSVPLPLTSSQPSIMAATPPEMFRRSTTPLLHSLSHSSYNNGNTTSRLSNSIPRNSSPLALSSTTAESTPTPNIVSSSSSQPSTSSGLNIPNVTKKPSLFSSSLQERLRPSVFDIHHNHNHQSGIKSPSTIQDTYSKKNSIVSNTSSIFSNKSSISSIASTNQHGINNNRPSLSSITNSHVKEEVEEEVKREEIVIKNGKSILNNDNSKSWTPMNGNASVAQDREQRSLTESPNLKSEICVPENKKVSVNSLLKDDDNEDKTKMGAKNHHLDFNDNNEVHKSRIVTIEKEEN

SEQ ID NO: 3200 - protein, 281 aa, Triticum aestivum
MATTVDWRSYRPDLPAAMYHMVDSRDQVMHAFAPATAQGAAPTISFAFPCPGAEQSAGLLRGASYLTPAQILQLQSQLHHVRRAPGAAMAAVGQPMKRHGVAALPARPATKLYRGVRQRHWGKWVAEIRLPRNRTRLWLGTFDTADEAALAYDAAAFRLRGESSRLNFPELRRGGEHHGPPLDAAIDAKLRSICHGEDMPQSQSDETPAPTTTLTPISFPDVKSEPVCSVSESSSSADGEVSSCSDVVPEMQLLDFSEAPWDEFLLRKYPSLEIDWDAILS

SEQ ID NO: 3201 - protein, 439 aa, Oryza sativa
GCRFRTRVSLPLPTGHHRRSPSIPRAIAASSLVLPLPPHPGEHILRHRCLLRSPFIARASTASSLVLPLPPHPGEHILRHRRLLRSPSIARASEGRRRSSCCFRRIDKMPNRATHWCYACRRPIRVSGQDITCPNCNDGFIQEISEIGGSLNTYGIFDPSFDERRDRSFGMVEAMSDLMRQRMAEMGRNRVLDFHGTRGASSHQGRQPTVRPMLIFGSNAPDRVSSSSEEADILLRQGRRIGADRPNFSRFLVGPSLEALFEQLLLHNNRQGPPPAPQSAIDSMPVVKINLRHLRDDPHCPVCTDKFEVGTEAREMPCKHLYHAECIIPWLVQHNSCPVCRHPLPSSSHRSGSTRSSSTHSNEAISHGVARSDADPVPVPVARSDDSRNHEMHGSFSFLWPFDSPTPDSSSYTHEGGVGEPTVHDDAGQMTYSEWHYDY

SEQ ID NO: 3202 - protein, 200 aa, Glycine max
RECDVPIHRANEHTQKHNRFLLTGVKLSGTSLDPAASSTNCTHGSEGRNNARSRMNRPRSSVSNEENASNSSCKVEDNVASDTGSVSTSSISEYLIETIPGYCFEDLLDASFAPNGFCKNQNYDRHRRFRTKIFKLLGRVWFELRRFQNLNAIDDQLFVKICWKISSFVFVICISFWAPCCILYDFFFILYSRPLFRPLI

SEQ ID NO: 3203 - protein, 434 aa, Zea mays
  misc_feature (106)..(106): Xaa can be any naturally occurring amino acid
MPCLEQIPMATGETAVDRREDPRDMDLSGEEHVRPKARKPYTITKRRERWTEEEHGRFLEALQLHGRAWRRIQEHIGTKTAVQIRSHAQKFFTKVVRESSPGSNAXPRAPRLAIQIPPPRPKRKPAHPYPRKADGAAKKPAPELKRLEKTSLRDRVRDEGSPTSVLASARTALRAEVSGSVVANSSSASRSPALSDAGSNERGDGGGSLASSVDREDGCASPRTRAPCTKVLCDAHEVSRLGSGAPVVKLFGNKVVVVKVKDLETDTPPASVAEAARNGSPTNGAAGASSWKPWPELTCLVPRRDGFAAQPIVSPPCAVFYYPQASAQEHQQASEPLDHRRAQREGSSPTGSSVASSAAAESRHGPGQENASDGYAALRAAIPRPTKRASSASFGGRGFVPYKRCAAESEAARPVALALAPGEEADGDLTRLCL

SEQ ID NO: 3204 - protein, 319 aa, Solanum demissum
MTTSSSDAPCVDHNQKSKNQDKKQQAKKPTTTKDRHTKVDGRGRRIRMPATCAARVFQLTRELGHKSDGETIEWLLQQAEPAVIAATGTGTIPANYSSLNISLRSSRHHSASNYLAHNNINNFGHVYHDRNYFNGVGLFSSENNSFFPSGNLNMLQAKEELCDDDDNDNDNNNNTGRIKRRSEDKDLQHNNYHMSNMLQSSTYGSIPASHQIGHIPATTLYMMTNNNNNTSHHDPNNCSMWASPSNSNIENSNIRGGLLNFMNFHQPILGTRGGGGGGTAAEGQWGMLTAAMNSYRQSGGHASGSSNQHNGGDDHQHHS

SEQ ID NO: 3205 - protein, 226 aa, Oryza sativa Indica Group
MAKTRQPQKRVLESFTIKGPDGVIKPGDTVLMMAPDSSKKPYVARVEEIEATGPQASQVKFKVRWYYRPEESIGGRRPFHGSKEVFLSDHYDSQSADTIEGKCYVHTFRDYTKLRSVSAEDFFCRFEYKSATGSFVPDRIAVFCKCEMPYNPDNLMIQCEDCSDWFHPSCVEITIKEAKKLEHFYCKSCIAENGKDLQKSNGATAQSEEKLYLKEKIDPKKVSNVR

SEQ ID NO: 3206 - protein, 425 aa, Oryza sativa Indica Group
MMGSGMPHMYFASSSHGTGAHYQSPGGAPITMAVPDMGFLVAGIGMAPSSFVMPEGALAASYSAMATVPVGVVVPQQQSSRFGGNNGNPGSFKGAWTRQEDEVLKQMVILHGDRKWATIAKSLPGRIGKQCRERWTNHLRPDIKKDVWTEEDDRMLIEAHKTYGNRWSVIARCLPGRSENAVKNHWNATKRSLKSKRRMKKKSVQVVNSPPGQLSPLEEYIRSQYPSAVETTPLPPAVPAPPSDVIVHGAGSVSAGPTVATQEPTGTNPSEMGIYLGLGNPAGPTTQQLAAMNLNMSLAPDLNAYNDQREGYYLPFVPQGNLHYGMHVPAPPVQQQQQQGISVDQGLHSSCLSLYHPFPGTHPVSLDFGCQSSNHANAGGYYSEAGPSSGSGSGDPDDVDVIQMASRQFLMPSEAEVTLDLTRFK

SEQ ID NO: 3207 - protein, 1040 aa, Cryptococcus neoformans var. grubii
MSRVPSGSQQPQYTQQPLYHPSSVHSQSASVQQTHQQYHPHAGQPMAFQGDPHAYSYDRQSQINTWQANPGAAGSMEYHSAVAGSSRGADPYQPYSQPHRSSPSQPVTAGRTQPASAQQYTPWAPVQASATTTPSSRGGGVKLEDLMSNDSRADGKSQPLSSIPLSVSASFDTRSQFSAGPQGASTEKEKDKERDKATQQQGPSEFIKKLYKMLEEEQAQYGSSRAKKGEKGKRGSVGWGANGTSFVVWDMNDFTTKILPQTFRHSNFSSFVRQLNKYGFSKIKHVDAGTGSIKENIWEFQHPNFQAGGKSDLESIKRKPVAPKKTNNQEGDENSPRYVGLSNEDQSRMHLMEDRINILEDALAKSRSEADEARMREMAMMGLVRDMIGHIAASESEAIGSPAATTGHSPRVLHLLKSLDNLARAYPPEMYHSNIARQPTTMPYTPAQPQSHQSFLNAAYNPAFSGSSVGGAAQAQASPHTDGTGSRGSLSGPSTGEIKPPASSSRLRAASNAGVVPPGSVNASVPVASQPSGNPPAGPVAHVEDPAEDVIEIPNQMQDMYGGESVSIAPLFVETPAWLTEGTTIPLTMYRKQSDGQALKAVYQAFAAGGKLPAGEGQDEDGNAIASGSSTSAAEIMAGSSQMGLQQSYDAGPSTSTGIPLPMDGSPSSESSSRKGKGKKSRGTSLKEQRESKLKPHWAQTPRILVVEDDIVYRTLSKKFLQKFGCETETVENAQGAVDKMNGTKYDLVLMDIFFGPNMDGRKATSLIRQFNNYTPIISMTSNAQPQDVDSYYQSGMNDILAKPFTKNHLFTILDKHLVHLRHAQLYERLIPLGVGVPPLSDQHVQEALAVSAATLQNTNGQLQLENGQTAEAQNEQQDSNGELELGIRNPLAGSGWSDEAYQLVLAQFLQTGVMPDITTISAVSSSPNPNGFDGTIGTSIVFGESSGFSRKRSIEAINDDNWDGQAQTPASAQAQVQAQTQNTIMQGDQQQGMSLQMPTNVGMGMDVNMGNMPESGMMNQDMSNDSDGRETKRARGMAG

SEQ ID NO: 3208 - protein, 241 aa, Picea sitchensis
MQIGAPPEVVARLDALTNEYENQQHRTTVSIGMDPELDQFMEAYCEMLTKYHEELTKPFKEAMSFLKKIEAQLNSLSKGTIRISPSAENDEKTEGGASSEEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 3209 - protein, 287 aa, Oryza sativa Japonica Group
SRRHGDGRGVVHRRRRRRGAEERQLLKGEIAVHPLCEQLVAAHVGCLRVATPIDHLPLIDAQLAQSSGLLHSYAAHHRPFLSPHDKQELDSFLAQYMMLLCSFREQLQQHVRVHAVEAVMACREIEQSLQDLTGATLEEGTGATMSEDEDETAPMLEGPMDMGSDGHDLMGFGPLMPTDSERSLMERVRQELKIELKQGFKSRIEDVREEILRKRRAGKLPGDTTTILKQWWQQHSKWPYPTEDDKAKLVEETGLQLKQINNWFINQRKRNWHNNSQTSTLKSKRKR

SEQ ID NO: 3210 - protein, 346 aa, Oryza sativa Indica Group
MPPPLEARDYIGLGATPASSSSSCCASTPVAEVVGAHLALRLGLPGSESPARAEAEAVVVDAALTLGPAPPPRGGAKRGFVDSLDRSEGRRAAATAGDDERGVREEEEEEEKGLGEAAAGAPRAAKAQVVGWPPVRSYRKNTLAASATKTKGEDQGKSEVGCCYVKVSMDGAPYLRKVDLKTYSSYEDLSLALEKMFSCFITGRSSSHKTSKRDRLTDGSRADALKDQEYVLTYEDKDADWMLVGDLPWDLFTTSCRKLRIMRGSDAAGIASDNLSNGNSLRDHWNRQPEAQNSDDYPNLGKIAFLQCSWVDLPYASLPETRSSESLMTIPILLAGISAYLCNIPY

SEQ ID NO: 3211 - protein, 415 aa, Yarrowia lipolytica CLIB122
MEDDKTTATPPTEFVWKLYMMLEEGNDNTVFWTPDGRSFVISDTIEFSKTTLPRHFRHKNFSSFVRQLNKYDFHKVKSTNDDGEPVYGENGWEFKHPNFLQFDTSGIDSIRRKLPEKRRAEGPSGYRELEDELHDLKRKHESLQKHFTSLSEDFSNAIGKLSGLQESLKKKEETMNHVFSMLAEFEYRFERLGMSQDDTASFDHIKRRRTDPSAAAQAQAQAQAQAQAQAQAQAQAQATTNYDDHMWPSTTHTWLPLHPPQVRRDSNGKAHPDGHADNTAESTEIHQNGEVQKILIASDDSDCVKICSTLLQKAGQVVEVIPDGVDAVEFLQTSASHVGLVLMETVLPRLDGCSAVELIRSMNRQVPIIMINDGSVNPKLEFLLQSGYVNEVLARPFNKDDFFKAVSPHVSLASY

SEQ ID NO: 3212 - protein, 387 aa, Oryza sativa
MGPQCSGPGGSFARTGRSPTEEAISEDREFQSLLVSGVLICSWCKIIEGNLMRALGEAPSPQMQKIAPPPFHPGLPPAPANFSSAGVHGFHYMGPAQLSPAQIQRVQAQLHMQRQAQSGLGPRAQPMKPASAAAPAAAAARAQKLYRGVRQRHWGKWVAEIRLPRNRTRLWLGTFDTAEEAALTYDQAAYRLRGDAARLNFPDNAASRGPLDAAVDAKLQAICDTIAASKNASSRSRGGAGRAMPINAPLVAAASSSSGSDHSGGGDDGGSETSSSSAAASPLAEMEQLDFSEVPWDEAEGFALTKYPSFRRLLAGVVFVSGVSDVYLVFGNSGLNFIQKNSGLGKTEATPTLEVEPRREEAAPALEAMPRREEVTPAPEAEAEAEA

SEQ ID NO: 3213 - protein, 371 aa, Oryza sativa Japonica Group
MGKGRAPCCAKVGLNKGSWTPEEDMRLVAYIQKYGHANWRALPKQAGLLRCGKSCRLRWINYLRPDLKRGNFTAEEEETIIKLHGLLGNKWSKIASCLPGRTDNEIKNVWNTHLKKRVSPEQKKGGGKSKKKTTCTDVLVPSPSPSSSTTTTTNCSSGDSAGEQSNTSKEEEEETDKIEIPMLELDPCCFDFDMLVDPVVPDTYCPAVSASASASAPTSPCSSTSPSCARAGVDPLLDLPEIVDLGPELWSIMDGGAGDGCTEAPPPAWSNAAAAAAANATVATTTSLEEEEGKEWWLEDLEKELGLWGPTDDYHCHPGPQGQPGRAGPPPSAVVEDPVSCYFQAGPTAAATWQGHEPSAVITSNPMDYYV

SEQ ID NO: 3214 - protein, 588 aa, Oryza sativa Japonica Group
MSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGTGKGGQKQPVHRKSIDTFGQRTSQYRGVTRHRWTGRYEAHLWDNSCKKDGQTRKGRQGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKAIEAAPDHVPIGRELGATEEASAATVTGTDWRMVLHGSQQQQAAACTEATADLQKGFMGDAHSALHGIVGFDVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 3215 - protein, 230 aa, Ostreococcus tauri
MATTPVDDAIDAALMGSSDWLNEFFSTFDGDVASALLDDVEAFEQPLVGDHEAEVGQVPRGESESGLESKKRKAVDEVENEVENASVGNGVRTSTLSEGAKKTKSTREKKRRDALNSRFEELQAVLEPGAATKADKATVVAAATVFIKRLRAEHARLAEGIMRLQEDNIQKAKLTKALAIEREALRKEKQILLHEKLRIEAQLQGFLANMPFASPADGFKCPPGRLPQHS

SEQ ID NO: 3216 - protein, 748 aa, Oryza sativa Indica Group
MDTPDRPPRAAATAAVEMLRPFAAPDWGLIVLEVSIQDSPVFNFINSLSPIPPPKPSDSAHNVQLFKSSDLAPVSSIFASPHVNPAKESKLPIREDSVQLSRESHSPNSVRTRTGATSSIIRMIRCKNIVSENCSITCYLNDSTSSKASQPIQLCGGSAESDTNQNTDGKKDPTTEQDRTDIEFVLLDQCGPEKMDSSQSGNNACENQLSEQHKDELGSFDGGYMFAHQPHSDMLRLAPPFESETQLVNETLQTDNVYCETLLTDGPSGSYTQNSAPDPHLYWAGAVEGCATDYTPQMLPGACQSQLVPNDQINNKLNEPSDYMPMDHNVSSQNLRGMRRRCLFNEKSGAANEGAKNSSARHSTNSTTPRRKISSSDNNLKTLRTPPCALPGIGLHLNALATVPKDKMVPHNDIQSSLNQASNVPSAVGSSPPTDDPHTINDDSSQTAVVAYVGESSQGSPKKKRHKFDNGDGTSCKRCSCKKSKCLKLYCECFHAGVFCSEPCSCQGCLNMPSNMETVLSTREQIESRNPLAFAPKVIRTEPGQELAGGVGCSVSCRCEGCKNAFGRREGVALLGIEEAKRGCEEKDGGVKEETTDNDKQLVIYQDSINLTPAESVLATPSVVDYRPLVALPPLSSKKPRSSTKLGGYSSRLEGHLKSDILLSPFESYAEMMLGDGTSNVLKGESSPQTSVKVVSPNKKRVSPPRIGTGLSPICKSGRKLILKSIPSFPSLGVDITNEDPNTSSLAP

SEQ ID NO: 3217 - protein, 194 aa, Glycine max
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAMDLSSASDELSQIIELPSLESTDDGSVDLKKEFVFVDSLDAWMYQPPFGFDTEQDTGFEGLMWNY

SEQ ID NO: 3218 - protein, 313 aa, Glycine max
MEGLSMKEPYFCDRPSSTRIFSSSDPPEAPPSPSTPLQHSHEKKKQLCVEEEEELEKEPKQHVSVTLLDLNIISGEDDNSCTPEGPELNLITCLDVGSSSNNANSSSETTTPLGGSSDHTEPRVFSCNYCHRKFYSSQALGGHQNAHKRERSIAKRGHRFGSQIMAFGLPLLHHNNNIRFASMASLPLYHSNRGTLGIQAHSMIQKPSSSHLHVNGFGGSYAHHHGWSRPIIDQQPGIAKLAAPDFHHRTKSALSSSQSSVGRFEIIVNSSNTMLNSAASNKEIGGCVASGGTCLKTTTNQEEMKHLDLSLKL

SEQ ID NO: 3219 - protein, 433 aa, Zea mays
  misc_feature (283)..(283): Xaa can be any naturally occurring amino acid
  misc_feature (317)..(317): Xaa can be any naturally occurring amino acid
RPSLCTAAPQPTRASVRKSKSSALSLTHARIDRSSSTHRRRRQINGQLTKVDPRRRHGKRPLPADEEEEEEEEELPPPPAKYEQLDQEEKHHVVVSQLQAGATFSGGRGSSSSSVAGPSPEAYAQYYYSARADHDASAVASALAHVIRASPDQLPPQQAACLYGAAGAPVLRQGEGDHPQPQAAAHHHPGGHVAAEEEQGAGLRRHYRGVRQRPWGKWAAEIRDPKKAARVWLGTFDTAEDAAIAYDEAALRFKGTKAKLNFPERVQGRTDLGFVVTRGIPDXPPAPAGGGGEPGSNAAGAGAAALAARPPDRHAVXYPYPDLMQYAQLLQGGRGGGDHAAAVQQQLMMMGGRGGNLPFSFSPPSSWSAPPQILDFSARQLITQPGPPSSPAAPGGAAPSTPSSTTTASSPSASASGSAWPYGGEHHRNKKDA

SEQ ID NO: 3220 - protein, 687 aa, Brachypodium sylvaticum
MAGTSDRGSIMEDWMAMPPTPSPRTLMSSFLNEDFSSGPFSNLFSENGSNKPHDHSEKRGEFVDLRDQVPAQSAEATLQKDISLEPNLFNANQKPNPHGGLAERMASRAGFSIPKIDTSRVGSSTVIRSPIAIPPGLSPTTLLESPVFLYNSMAQPSPTTGKLPFPATNANSTIPPAARMNEDHTFSNDVFSFQPHLGSKAPSFSTVEKGYNACPSNQSLSNIHQRESSLQLSFTAVKDTADETIVKPKTSDSMFGDDHSYSEEQEDDETDQNGEYSSATISTPDEDGYNWKKYGPKQVKSTEYPRSYFKCTHPNCPVKKKVERSQVGQITEIIHKGTHNHPLPPLNPHSGVPLSHISDPQVNARKNPGLQAGLNSASLWENGKSGCIQDVQSEGVDARPATRLPVSAYGDTSIVESQDAVDVSSTLSNEEIDRATHGTVSLDCDGGEDETESKRSTITAAAATTSTTSTIDMVTAASRSVREPRVVVQTTSEVDILDDGYRWRKYGQKVVKGNPNPRSYYKCTHPGCSVRKHVERASHDLKSVITTYEGKHNHEVPAARNSGHASSGSGSAPASVPQVNLSHRWQEQAQGSFGQFGGSTPFGSFGLPPRGHLGAAGNFRFGMVPPGMSIPMPAAHQQSMMQGYPGLMMPEGQPKTEPGPQSGFPEANAASSAYQQMMSRPPFGSQM

SEQ ID NO: 3221 - protein, 284 aa, Zea mays
EPTPMEDHDVKESDDGGEGENLPPGSYVVLQLEKEEILAPHTHFCLICGKGFKRDANLRMHMRGHGDEYKTPAALAKPTKDSGADHAPVTRYSCPFVGCKRNKEHKKFQPLKTILCVKNHYKRSHCDKSYTCSRCNTKKFSVIADLKTHEKHCGRDKWLCSCGTTFSRKDKLFGHVALFQGHTPALPMEDVKVSEASEQPQDSEPMNEMARSNVYSFPCSSSDGISNLDMKMADDVRGYFSPLNFDPCFGALDDFTRPGFDISENPFSFLPSGSCSYGQQNGDS

SEQ ID NO: 3222 - protein, 330 aa, Glycine max
MNQKFIGKPPATVDLDRMPERGSHHRRSHSDTSFRFAANFDDLLLFDPSDFDISGLPSPLPLPSPVSAGLVPMSVDSDESGKQPRPAGASAGGHLRSLSVDSDFFDGLGFGGDERGAGKGGGGERRVGHHRHSNSMDGSSTTSFEADSAMIMDGVKKAMAPDKLAELALMDPKRAKRILANRQSAARSKERKIRYTSELERKVQTLQTEATNLSAQLTMLQRDTTDLTTENKELKLRLEALEQEAQLREDLNEALKEELQRLRAQSTRLGAIGGNPSFGGIFNQLASQLAMQQLSNSAPHQQTQHQPQVGMPPPPSGQNHPNFMDFNQQK

SEQ ID NO: 3223 - protein, 664 aa, Zea mays
MALWALPVGFRFHPTDEELVSHYLKGKITGQINSEAEVIPEIDICKCEPWDLPGKSLIRSDDPEWFFLAPKDRKYPNGSRSNRATVAGYWKATGPDRNIKSKGDKSKQFTIGKKKTLVFHRGRAPKGERTGWIMHEYRTTEPQFESGKQGGYVLYRLFWKPEEKTERSSPKEMDRSGNSPTTIRSSRDNQEANEEANTPLNKKSLESALHDPIELPNSAETPAGPRKMCLADRNDNLVATAPVVSHIPFQGHAAGVAKVDPSAAASAHFVNPQNGNDDCNNFMSDFTPILPHENAFFTGTQQGAFGFDGNGIMNHPDALDAFLNQTLVDTDEHSSTTSKVQYDSDIPTEFANHWNMQDEHQDWWEKLDFEPYEPTLLPYDTTDLDVLSVDSGADSFNDLFNVTGITLRPQQLDSTVQPDCVFPDQGTALRRLKLQVVECGESITKDESEDEVSCVESPNYFDESVEFAAEKGVASYGDGADSTGIVIRSRYPAPSSSSESSFTQQGTAMRRLRLQLGLNEGTCPSSGDSSSCIVDESESQQKAEIEEDASTNLAGSVDNLPGNSHDDEQKDIPEHDAEMSVSGVKSVLRLRKTSAESLKDVKQEDCLEPDGRAPMQRVGFQSSIIWLVLSVAVLLLLYCGVWMSMICILVRCFAHMGSWHQPDV

SEQ ID NO: 3224 - protein, 278 aa, Arabidopsis thaliana
MSNITKKKCNGNEEGAEQRKGPWTLEEDTLLTNYISHNGEGRWNLLAKSSGKSCRLRWLNYLKPDIKRGNLTPQEQLLILELHSKWGNRWSKISKYLPGRTDNDIKNYWRTRVQKQARQLNIDSNSHKFIEVVRSFWFPRLINEIKDNSYTNNIKANAPDLLGPILRDSKDLGFNNMDCSTSMSEDLKKTSQFMDFSDLETTMSLEGSRGGSSQCVSEVYSSFPCLEEEYMVAVMGSSDISALHDCHVADSKYEDDVTQDLMWNMDDIWQFNEYAHFN

SEQ ID NO: 3225 - protein, 304 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDSAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGIITPKVE

SEQ ID NO: 3226 - protein, 199 aa, Oryza sativa Japonica Group
MQSQIVCHGCRNILLYPRGAPSVCCAVCHAVSSTAPSPGCKHWPEFAGSAEGLGQHDFIRIGGFTGMDIAHLICGGCRTLLMYTRNATSVRCSCCDTVNLVRPVSSIAHLNCGQCQTVLMYPYGAPSVKCAICNFITNTGMNTMRHLPPNGTSYTAPSTSAPTTQSQNVTVVVENPMTVDAKGKLVSNVVVGVTTGGKK

SEQ ID NO: 3227 - protein, 238 aa, Picea abies
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 3228 - protein, 341 aa, Oryza sativa Indica Group
MCGGSILSDLHLPVRRTVNAGDLWGDAGKGRDGGDGLKKRKGSSWDFDVDCDDDDDDFEADFEEFEDDYGDDDDVGFGHDDQESDMNGLKLAGFSTTKLGLGGSRKRKTRYRGIRQRPWGKWAAEIRDPRKGVRVWLGTFGTAEEAAMAYDVEARRIRGKKAKVNFPDAAAAAPKRPRRSSAKHSPQQQKARSSSSSPASLNASDAVSKSNNNRVSSAGSSTDATAAAIAIDDGVKLELLSETDPSPPMAAAAAAWLDAFELNDLDGSRCKDNAFDHQIHKVEAAVADEFAFYDDPSYMQLGYQLDQGNSYENIDALFGGEAVNIGGLWSFDDMPMEFRAY

SEQ ID NO: 3229 - protein, 223 aa, Oryza sativa Indica Group
MEVEAATRRFHLWLRGLRGLRRELRAARWADDPAQLGSLVGRFVAHVECYTAARAEMDPVWTLSAPWASPVERGAAYWLAGWRPTTLVHLLYTESGRRFEAQLPDLLLGVSSGNLGDLSPSQLAQIDDLQRRTVAEEDGLSREMALVQEGHGAVAAGGEVDVDGIVGRVRGVLGRADALRLRTVKRAVEILEPAQAAELLVAAADMEIGFREFGLKYSSARSD

SEQ ID NO: 3230 - protein, 434 aa, Zea mays
MDMNESGEKGMEGNASSGIPVDWQTQFSAAAFSCAPPQQQQVPMMDSAFASAGLWASTSQAMALSDAGGRSAARAGFLAPVPGFLPQGLAHFPVDSGFIERAARASCFGGGGGGGVMAAFGAAADHQPMNSAFSGSSEALLDHQRTKDGSDKGEPELGRNGHDGVLSSEAAAAGDCSSKGTSDSKKRRRPNEVMGGDQVQSSNLPADSANESVHSKDKGEESSLATTTTGPGKSKGKGARETSESQKEDYIHVRARRGQATNSHSLAERLRREKISERMKLLQDLVPGCSKVTGKAVMLDEIINYVQSLQRQVEFLSMKLATVNPRLDLNIEGLLSKDLLRFPGVPSSSLGFSPEMMHPQLQLSQPGLIQGGAAGMANPDVFRRIMQAQLSAKDGSQMPPHALNGAFSDVAQQQMAYPSSQDLSIGPSQDGFQM

SEQ ID NO: 3231 - protein, 190 aa, Zea mays
  misc_feature (107)..(107): Xaa can be any naturally occurring amino acid
  misc_feature (123)..(123): Xaa can be any naturally occurring amino acid
YISTLNSQGPFFFLHLEALFEQLLLQNNRQGPAPAPQSAIDSMPVVKINRRHLDDDPQCAVCKDKFEVGAEAREMPCKHLYHTDCIIPWLVQHNSCPVCRHPLPSQXSGSTSSARPSAYYNEXADPPGVTRADLEPAPGNYGSESQESHVPFSFLWPFGPSSSYQYEENVDEPAVYDPNQIAYSAWHYDH

SEQ ID NO: 3232 - protein, 344 aa, Medicago truncatula
MMQGSGELTVPPGFRFHPTDEELLYYYLRKKVSYEAIDLDVIREVDLNRLEPWDLKDKCRIGSGPQNEWYFFSHKDKKYPTGTRTNRATTAGFWKATGRDKAIYHTNSKRIGMRKTLVFYTGRAPHGHKTDWIMHEYRLDDDDNAEVQEDGWVVCRVFKKKNTNRSYQQEIEEEDHHMINHMRSTNGPNHFLEPKHHHHMQQLGLYDYNNNTTTTFDGTIHLPQLFSPESAIAAPPTSFHNSSMDILECSQNLLRLTTTNTSSGLNLMQQQQQQGERLISGSDWSFLDKLLASHNGMDLNLRNKLCNTPNNHQAAPSAVGTSSAQKFPFHYLGCESHDIMKFSK

SEQ ID NO: 3233 - protein, 337 aa, Arabidopsis thaliana
MEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 3234 - protein, 279 aa, Vitis vinifera
MASSKKDLDRIKGPWSPEEDEALQRLVQKHGPRNWSLISKSIPGRSGKSCRLRWCNQLSPQVEHRAFTPEEDATIIRAHARFGNKWATIARLLVGRTDNAIKNHWNSTLKRKCSSITEDMIADGHAQPPLKRSASVGAGTTVSGHNLSPSSPSGSEFSDSSAPGMASSLVYRPVPRTGPIKIEAASSTNDPPTSLSLSLPGSDSCEVSNHLSGSDHNCELGLGMSEKPFFTPEFLAVMQEMIRKEVRNYMSGMEQNGLCLQTEAIWNAVMKRIGIGKIE

SEQ ID NO: 3235 - protein, 580 aa, Physcomitrella patens subsp. patens
MFPMKKYMSPGTFQQRPRSTGSLYIPEKLQSPYGSVMNGGDMVPLSPADPKPRLRWTPELHERFVDAVTQLGGADKATPKSVMRIMGVKGLTLYHLKSHLQKYRLGKQLTRDQHFHNKDGNSDLQRSNSLSDGGMAQKSQNMQHGLQMSEAIQLQLEVQQRLQDQLEVQRHLQMRIEAQGKYLQAILQKAKETLASHTSESPGLEAAHAELTELASKVTTVGYLSDFSNLGMPPMAQPDPLMALHELPRQPSRNSDTSSQKSFLTNLTGNAEDSGAVSGSGEPRGLTEDEDGVGQESSAQFHEEMSANRLHPQGSGNSRGFQGGLAHAATTTALAGVVPSSSSHCNPITSFWHMNSFQNMTSSPMSGSLCEVVQDYRTDNSNPNQLANSLIMERLSSSQGVGIHHLSGMHHTQNGLGFMHGGSTSASYTSLQDLYCSSGDTLRGGLVKAEMNLAERNHIIQCRGSELDLNSGWERVCLHRCNPSDRLAAPGGASNLRHQVIAKTLFWNVEEPSHVIDRRVLSYACRKVVTQLLPGVSSWALARLNMDELLLEMPGCIIEYDVILHNDMVEYEARDSRNDY

SEQ ID NO: 3236 - protein, 863 aa, Vitis vinifera
MASMMTAGVKRAEVLVSTSEANGDSFQKMRALHGRTTGPTRRSTKGQWTAEEDELLCKAVQRFKGKNWKKIAECFKDRTDVQCLHRWQKVLNPELIKGPWSKEEDEIIIELVNKYGPKKWSTIAQALPGRIGKQCRERWHNHLNPAINKEAWTQEEELALIHAHQIYGNKWAELTKFLPGRTDNAIKNHWNSSVKKKLESYLASGLLAQFQSLSYVGNPNPSSSFKMQNNGDDTGQLYVAIAEETSECSQGSNVINCSQSEPDTENMAINATENFKMTEDSSERKDHNNFGTSCSTSLEESAVLEIHHMDAFFDQQLLCEIGTSESKDCQFSSHELPGASLLDVSRESPGLSGTPQYCISLNGSHDTGPTLLQSSVGFKSSTSTENILIDSDKLEHLLISENDYSEITLSEAVIHGNFRCVNAENLSNNIDSDGGTSSLHCQSDLQSSATTGSLALESYITQGSVLGQTLELEIFTSSCNDFIDIDSPDGETDKAGDHLKLDKAKNAPKLVPVDIFSLANAESMGTLPSMDDNKSQHLKSDGKKDASGLAPVDLLSSENSDSTQAQPSMDNNTTVLVEEKNSRALFYEPPRFPRLDIPFVSCDLMASGSDMQQEYSPFGIRQLLIPSMNFSTPCSLQDSPCRGGTPDSILKNAAKSFTSTPSILKKRPREVVSPSEQARGEKNPERETNLLGLFCANDFPSLDVIFYENGPCNPSLSSTERNSLSPHYKKVNLDHVFEEGKEGIANSESRVSEKGKVKQGTNVFGAKAKCEVDTTSQTVSWVFHPLYLLTCNVKTRNNTVVHLLKNVAVCGSQTYCMVNFKLGLMLHRSLCAPLLQYLILLNMRLFQDDLTYNTSLFNFITYF

SEQ ID NO: 3237 - protein, 155 aa, Physcomitrella patens subsp. patens
MNNKAPIPVGFRFHPTDEELVGYYLHGKVGRFQRDQLIQELDLYKIEPWDLHEVCRIGDDAPEHQSDWYFFSHKDKKYPTGNRANRATTAGFWKATGRDKPIHTQRQVIGMRKTLVFYKGRAPNGQKTDWIMHEFRLDDCPGASPNYLIQARSCP

SEQ ID NO: 3238 - protein, 330 aa, Glycine max
  misc_feature (102)..(102): Xaa can be any naturally occurring amino acid
  misc_feature (139)..(139): Xaa can be any naturally occurring amino acid
  misc_feature (146)..(146): Xaa can be any naturally occurring amino acid
  misc_feature (166)..(166): Xaa can be any naturally occurring amino acid
  misc_feature (191)..(191): Xaa can be any naturally occurring amino acid
  misc_feature (211)..(211): Xaa can be any naturally occurring amino acid
SSEIDLVPSENEVQPGEDFQQNSPKKKRCKLEPAGEGESCKRCNCKKSKCLKLYCECFAAGVYCIEPCACHDCFNKPIHVETVLQTRQQIESRNPLAFAPKXIRSSDSVSEIGDDPNKTPASARHKRGCNCKKSSCLKXYCECYQXWWLGCSISCRCEGCKNTYGXRMGSVPSGLEAEPEEETEACEKGGXEKALQKTETQNTEDHPDFAXATPLPLSRPLLPLPFSSKGKPPRSFVTTISGFALFASQKLGKPNPLWFQAKHFQTVPDEEIPDILQGDSFPITCIKTFFPNGKRISSPNCDLGSFPSRKGGRRLILQSIPSFPSLTPHP

SEQ ID NO: 3239 - protein, 194 aa, Oryza sativa Japonica Group
MEGMSKLAGGGGDVTFVGGGRRMAAAAAAALRLVELDLIGTVGAAVPGQATAPRLLVVSPAPAKEEERDGDDDGEPRQLFACHYCRREFYSSQALGGHQNAHKRERTLARRGAGAGAGGEQASSSSFAIHHGAFVSASPGWMARVLHGEAPPAISVAGDGGGGERWWWGGGNVGYYWPRDGDDQTRQLDLTLKL

SEQ ID NO: 3240 - protein, 353 aa, Oryza sativa Japonica Group
MESFASLAGGGSSSTTARLPELIPPENPDRISPPPLLYQLLAGSASSARHGHGHHHGGGGGAAAAAVQGLQVSPAGAEAAMKAEIMSHPQYSALLAAYLGCKKVGAPPDVLTKLTAVPAAQQQLDAADGHPRRRHEPRRDDDVPDHQLDQFMDAYCSMLTRYREELERPILEAAEFFSLIRSLVNSNCEGTGSSEEEQDTSCPEAEEIDPSDKQLKHQLLMKYGGSLGDLRQAFSKRTKKGKLPKEARLKLLHWWELHYDKWPYPSEVEKMTLAQTTGLDQKQISNWFINQRKRHWKPTPVAGMTFPTVEAAGGGFRHSGHDGGLAAAAAAAALPLYMGSWPFVVDGMYRLGS

SEQ ID NO: 3241 - protein, 346 aa, Ostreococcus tauri
MKLRGREKSANEKTKEEPVTPVIAEPARGQSEEAVVPSDDFLCLFDESTREAATLANQTTHWEEVFAQHGGDVVGEHFPHFEDLKYKPLSGRTLASTSTGRVSKRRSGTRKPKAQLNRLQLPQNQLQLQPPLPPPVPVPMYRSSTGKPRSSKYNGVCRHAKSGRYEAHVWLRESRRQVYLGGYLEEEFAAEAFDIIVLKLARIGSRSRTGSRPLKMNFPEGRYANLLQLIDSLTLDELIMEVRRHSEGFARGSSGYRGVTRHANSKFEARLGVPRSNHMYLGLYDSAEKAAVAYDQALVQVRGRRASTNFPLYNYDEHIRQYEMTKARQNVSQGKQHVTFQQLDDY

SEQ ID NO: 3242 - protein, 302 aa, Arabidopsis thaliana
MMKDPTGYRFSPTGEEVINHYLKNKILGKTWLVDEAISEINILNHKPSKDLPKLARIQSEDLEWYFFSPIEYTNPNKMKMKRTTGSGFWKPSGVDRKIRDKRGNGVVIGIKKTLVYHEGKSPHGVRTPWVMHEYHITCLPHHKRKYVVCQVKYKGEAAEISYEPSPSLVSDSHTVIAINGEPEPELQVEQPGKENLLGMSVDDLIEPMNQQEEPQGPHLAPNDDEFIRGLRHVDREPVEYLFANEENMDGLSIMNDLTIPMIAQQEDLILSEWEGFIAATFFSDNNNNNNLNVHQLTSFLPG

SEQ ID NO: 3243 - protein, 562 aa, Ustilago maydis 521
MKRTTDPVGGPQQKRPNTEFTIHDVEIADATTMSLAPQQTAEDSKHFFKPIGEYVADHDQAAPSASLADAATADAGEQKMVEEISSLCMECHKEGTTRMLLTYIPYFREVIVVSFFCPHCGNRNSEIQSAGQIQQKGCLYTVHVTNTADLNRQVVKSEFCTVNIPELQIEIPPKKGQLTTIEGVISDTLRDLELDQPLRKHMQPDAYAKIEQICDKLRDILGEDKASEQDQVNADDENVSSGLRSLGPVGASSSSMSAEEKDKRKVPAFSIRLDDPSGNSFVEFMGDVQGRGMSDAKWSKRDYPRSKEQNELLGLSGPAALGNQDDNDEQVHTTGFDKNAGETEFDNEEVYTFAGTCSSCNAPLETRMKKVNIPYFKDILIMSTNCENCGYKDNEVKSGAAISEQGRKLTLKVQDKEDLSRDVLKSETAGFAIPEIDLHLSPGTLGGRFTTLEGLLQQVYDELSERVLMRGDSSSQAATFEGFLGKLKSVISCETLPYTVILDDPLANSYIQNPYAPDPDEQIVEQRYTRTYDQNEDLGLNDINVDNYQHDVPAQTAPNTLV

SEQ ID NO: 3244 - protein, 843 aa, Glycine max
MASSEVTMKGNCLNHNDGGATEPHSPSTAKDAEAALFRELWHACAGPLVTVPREKERVFYFPQGHIEQVEASTNQVADQHMPVYDLPPKILCRVINVQLKAEPDTDEVFAQVTLLPEPNQDENAVEKEPPPPPPPRFHVHSFCKTLTASDTSTHGGFSVLRRHADECLPPLDMSKQPPTQELVAKDLHANEWRFKHIFRGQPRRHLLQSGWSVFVSSKRLVAGDAFIFLRGENGELRVGVRRAMRQQGNVPSSVISSHSMHLGVLATAWHAILTGTIFTVYYKPRTSPAEFIVPYDQYMESLKNNYSIGMRFKMRFEGEEAPEQRFTGTIVGIEDSDPKRWRDSKWRCLKVRWDETSNTPRPERVSPWKIEPALAPPALNPLSMPRPKRPRSNAVPSSPDSSVLTREASSKVSIDPSPANGFPRVLQGQEFSTLRGNFAESNESDTAEKSVVWPPAAVDDEKMDVSTSRRYGSESWMSMGRNEPTYSDLLSGFGASGDPSHLSLKDQMSPAYSARKQSLDHEGKLHMPHPWPVMPSSLSLNILDSNTKGPAHGGDTTYQARGNLRYSAFGEYPALHGHKVEHSHGNLMPPPPALLTQYQSPCSRELMSKQVSAKTCEAVKPKDGDCKLFGFSLISGPIVPEPSLSQRNVSEPAGQMHLTAHQQRTSENDEKSDHSKGSRPVDDLVVDDHDRPLQTSQPHTKDVQAKPLSGSARSCTKVHKKGIALGRSVDLTKYSGYDELVAELDQLFEFGGELLSTKKDWLIVYTDNEGDMMLVGDDPWQEFCAMVRKIYIYPKEEIQKMSPGTLSSKNEENQSVMASDGADAKVVKCQPHQKFNSENGLDA

SEQ ID NO: 3245 - protein, 351 aa, Antirrhinum majus
MEGGGGSSSNSCMIGFGENTSSNNGFCPMTMMMMPPPSMASSHPNGNTLFFPLPSTNNSHQGLNHRTSASTMLEDQHNNNTITSTGYYFMDGNDNDSVKAKIMAHPYYHKLLAAYINCQKIGAPPEVAVKLEEACASAATMGRNSVSRIGEDPALDQFMEAYCEMLSKYEQELSKPFREAMLFLSRIECQFKALTLSSSDSACGEAMDRHGSSEEEIDVDNSLIDPQAEDRELKGQLLRKYSGYLGSLKQEFMKKRKKGKLPKEARQQLLDWWSRHYKWPYPSESQKLALAEQTGLDQKQINNWFINQRKRHWKPSEDMQFVVMDAAHPGHYYMDNVLGNPFAMDILPTLL

SEQ ID NO: 3246 - protein, 238 aa, Picea abies
MEHLNTAAAQASSSLYGVGMAEYGDAGVSSMMALITQHEPHDSESIMSTRMPSSFSSFHGHADCLLSAAMFQASQGDHKLKRQPGMDQFVSEQAGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 3247 - protein, 212 aa, Glycine max
MGRGGTAAAAVEIAEPGSRPVFFKEPRYRGVRKRPWGRFAAEIRDPMKKARVWLGTFDTADEAARAYDTAARTLRGPKAKTNFPLSPPFYHPDPFSDHRYFDGAGAGEDFQDHRRPTSSGMSSTVESFSGPRAAVPATAPVTAGRRYPRTPPVIPEDCRSDCDSSSSVVDDGEGDNVASSFPREPLPFDLNALPLDDADVATDDLFCTVLCL

SEQ ID NO: 3248 - protein, 353 aa, Antirrhinum majus
MEGSGGGGMMAFGENNNNNSNNGFCPSNMMMPQLASNCEGGYSTTPFVPLVPFTNHHHHHQEMNRQRSTVVGGSSMVYEEGHQNNSNAITSTGYYFMDSTNCDESSLKAKIMAHPHYHRLLAAYVNCHKIGAPPEVVSRLEEAAAAMARHGTISVGEDPGLDQLMEAYSEMLSKYEQELSKPFKEAMLFLSRIESQFKALTVSAARGEAMFRNGSSEEEIDVNNSFIDPQAEDIELKGQLLRKYSGYLGSLKQEFMKKRKKGKLPKEARQQLLEWWSRHYKWPYPSESQKLALAESTGLDQKQINNWFINQRKRHWKPSEDMQFVVMDAANPQYYMENILGNPFPMDISPALL

SEQ ID NO: 3249 - protein, 329 aa, Oryza sativa Japonica Group
MALEAVVFPQGHFGYGCGRDSPAYGMPWCDVLAAAGGGGGFGEFYGVDEWDDQLQVASVDEWEVASKDNSDASTEGKAAAAERAEPVAAGRRKRRRTKVVKNKEEIECQRMTHIAVERNRRRQMNEYLAVLRSLMPASYSQRGDQASIVGGAINYVKELEQLLQSLEVQKSLKNRSGAMDAAGDSPFAGFFSFPQYSTSPRTGCSAAASAGSSGSASSVVMDDTAGSAESGRQSAAIADIEVTMVEGHASLKVLARRRPKQLLKLVVGLQQLRIPPLHLNVTTVDAMVLYSFSLKVEDDSKLGSVEDIATAVHQILGSIQQQEAVLSIS

SEQ ID NO: 3250 - protein, 533 aa, Arabidopsis thaliana
MELPQPRPFKTQFKTQGRKPTHDFLSLCSHSTVHPDPKPTPPPSSQGSHLKTHDFLQPLECVGAKEDVSRINSTTTASEKPPPPAPPPPLQHVLPGGIGTYTISPIPYFHHHHQRIPKPELSPPMMFNANERNVLDENSNSNCSSYAAASSGFTLWDESASGKKGQTRKENSVGERVNMRADVAATVGQWPVAERRSQSLTNNHMSGFSSLSSSQGSVLKSQSFMDMIRSAKGSSQEDDLDDEEDFIMKKESSSTSQSHRVDLRVKADVRGSPNDQKLNTPRSKHSATEQRRRSKINDRFQMLRQLIPNSDQKRDKASFLLEVIEYIQFLQEKADKYVTSYQGWNHEPAKLLNWQSNNNQQLVPEGVAFAPKLEEEKNNIPVSVLATAQGVVIDHPTTATTSPFPLSIQSNSFFSPVIAGNPVPQFHARVASSEAVEPSPSSRSQKEEEDEEVLEGNIRISSVYSQGLVKTLREALENSGVDLTKASISVEIELAKQSSSSSFKDHEVREPVSRTRNDNVKQTRKPKRLKTGQ

SEQ ID NO: 3251 - protein, 299 aa, Glycine max
  misc_feature (185)..(185): Xaa can be any naturally occurring amino acid
MDTAQWAQGIGVVKQPMEGSKPPPPPPPPMLERRARPQKDQALNCPRCNSTNTKFCYYNNYSLSQPRYFCKTCRRYWTEGGSLRNVPVGGGSRKNKRSTPPAPPSAPAPTKKLSDLATPNFPQSASQDPKIHQGQDLNLAYPPAEDYSTVSKFIEVPYSTELDKGTTGLHQNPTSSSTTTSASSXHQLSAMELLKTGIAAASSRGLNSFMPMYNSTHGFPLQDFKPPHGLNFSLEGFENGYGGLQGIQEGPTGGARILFPTVEDLKQQVPSTNEFDQQNRSQEGSAHGYWNGMLGGGSW

SEQ ID NO: 3252 - protein, 341 aa, Arabidopsis thaliana
MEGGGRGPNQTILSEIEHMPEAPRQRISHHRRARSETFFSGESIDDLLLFDPSDIDFSSLDFLNAPPPPQQSQQQPQASPMSVDSEETSSNGVVPPNSLPPKPEARFGRHVRSFSVDSDFFDDLGVTEEKFLATSSGEKKKGNHHHSRSNSMDGEMSSASFNIESILASVSGKDSGKKNMGMGGDRLAELALLDPKRAKRILANRQSAARSKERKIRYTGELERKVQTLQNEATTLSAQVTMLQRGTSELNTENKHLKMRLQALEQQAELRDALNEALRDELNRLKVVAGEIPQGNGNSYNRAQFSSQQSAMNQFGNKKNQQMSTNGQPSLPSYMDFTKRG

SEQ ID NO: 3253 - protein, 267 aa, Physcomitrella patens subsp. patens
MVEKRNAATLKAKRGGALLTHLTTPSSSIAKKSAFGGFDRFPCSSSQQAAFKGVRMRAWGKWVTEIRDPTSKARIWLGSFSTAEMAARAYDAAVVCLKGPSAPELNFPDSLPNYIPNSRSPKDIQAAAAAAATASLPAATPLAIGADSRSHEVQRQVSEDWIFPSLSCIPELHEDMTLQDFEIAPEMKVDAGSSSAAMEDWINNELFGGLEESSNNESDLYQELLKLAECLDTAESSCAISQHESISGLNFSRQDNTGYDSSLWCFT

SEQ ID NO: 3254 - protein, 367 aa, Triticum aestivum
MGKGRAPCCAKVGLNRGSWTPEEDMRLIAYIQKYGHANWRALPKQAGLLRCGKSCRLRWINYLRPDLKRGNFTVEEEETLIKLHNMLGNKWSKIAACLPGRTDNEIKNVWNTHLKKRVAASAGEQKKGGAKGKKKTTCADVPAPSPSPSSSTTTTTTTTTNCSSGESGEQSNTSKELELELELEKIEIPMLDLGFDLDMLLDTVTNTHCPAISSAPTSRCSSASPTCVVDDGALLDLPEIDIVPELWSIMDGEGGAGACAETAQVPWSNAAPCDGKGPEASAATADDEDGKEWWLEDLEKELGLWGPIDDYQYQQPDPQGLSGRADPLSASVDDPVSSYFQAGPASATSTIHGPEASAVLTDIPMGL

SEQ ID NO: 3255 - protein, 292 aa, Triticum aestivum
MMAEAWMDVLPPPAPYFAGQPCWAVQQERRGGGAWTLEENKVFEEALAAIDLDAPDRWEMVALMLPRKTVADVVNHYRALENDVGFIEAGLVPFPHYDSSSPSSGFTLDWDGGAAGAGGFRRGYCLKRGRADQERKKGVPWTEEEHRLFLKGLKKYGRGDWRNISRNYVTSRTPTQVASHAQKYFIRLTSGGKDNKRRSSIHDITTVNVPDDDDRDSPSGSPPSVVTTVDTKPSPSYGGQRHAFVPSTLPAGTLGGGHPYGNVKLEHQSSFMSGAGLDLDDSLLLQMQCGQL

SEQ ID NO: 3256 - protein, 180 aa, Triticum aestivum
MQSQIVCHRCRRVLAYPSGAPSVCCAMCRAITAVPPPAPAVEMAQLICGGCRTLLMYTRNADTVRCSCCSTVNLVRPVNNIAHVNCGRCRTTLMYPHGAPSVKCAICDYITNITNTGINTMPPAPCPRPTSNESAYNASSASVPTPQPQNVTVVVENPMTVDEKGKLVSNVVVGITPGKN

SEQ ID NO: 3257 - protein, 365 aa, Zea mays
MYHPQCELLTMAHETPDLDAGQPHLTVSGVASIPAELSFHLLHSLDAAAAVNPVTAPPQSTIDYFLGGADPHQQAMQYEPLPPAAGGHHQYTMDMFRDYCDGHYPTAEPYIRGTMTGALVFGATDDDDSAAAYMPGGHFETSPPPPRATGRGRKRGRALGGGFHAVLANGVEKKEKQRRLRLTEKYTALMHLIPNVTKTDRATVISDAIEYIQELGRTVEELTLLVEKKRRRRELQGDVVDAAPAAVVAAAGEAESSEGEVAPPPPAVPRQPIRSTYIQRRSKDTSVDVRIVEEDVNIKLTKRRRDGCLAAASRALDDLRLDLVHLSGGKIGDCQIYMFNTKIHKGSSVFASAVAGRLMEVVDEY

SEQ ID NO: 3258 - protein, 246 aa, Vitis vinifera
MSDYSWRVGGTSGISDSENGVGAVYLRKLTSSKYKGVVPQPNGRWGAQIYEKHRRIWLGTFNEEGEAAKAYDVAARRFRGHAALTNFMVSGKGIQDDIETTFLNSHSKAEIVDMLRKHTYNDELEQSAHNYGSKESGADVMESKPSVCERVQLFDKAVTPSDVGKLNRMVIPKQHAEKHLPLQLASSSKGGLLNFEDNGGKIWRFRYSFWNSSQSYVLTKGWRRFVKEKNLKAGDIVSFHRFNWVG

SEQ ID NO: 3259 - protein, 423 aa, Arabidopsis thaliana
MAVEDDVSLIRTTTLVAPTRPTITVPHRPPAIETAAYFFGGGDGLSLSPGPLSFVSSLFVDNFPDVLTPDNQRTTSFTHLLTSPMFFPPQSSAHTGFIQPRQQSQPQPQRPDTFPHHMPPSTSVAVHGRQSLDVSQVDQRARNHYNNPGNNNNNRSYNVVNVDKPADDGYNWRKYGQKPIKGCEYPRSYYKCTHVNCPVKKKVERSSDGQITQIIYKGQHDHERPQNRRGGGGRDSTEVGGAGQMMESSDDSGYRKDHDDDDDDDEDDEDLPASKIRRIDGVSTTHRTVTEPKIIVQTKSEVDLLDDGYRWRKYGQKVVKGNPHPRSYYKCTTPNCTVRKHVERASTDAKAVITTYEGKHNHDVPAARNGTAAATAAAVGPSDHHRMRSMSGNNMQQHMSFGNNNNTGQSPVLLRLKEEKITI

SEQ ID NO: 3260 - protein, 306 aa, Oryza sativa Japonica Group
MASSSQTTVSMEVAMKVEGSGGGGGDGEEGEVVAKKEEEVAAAAAAMELDLLGALRAEEVMPAEKGKAAVVMVGEAVAPSVEERASAVAAAAANGGGGGGEARRRLFKCNYCQRKFYTSQALGGHQNAHKRERSLAKRGAAVAAAAAAAGRGLYGFGDPFVPHHLRFRSLWPYPAAAGAARTTPFLGRGSASAAAAAAAPAAPFYGAVHHGWSTQPPSSLQGIAARHAAAERPVYPADAFGYGAGSSSSRATGAPASAGLRWAEGGGSGTIHSAAAAAAAGEQHTAAEVKAQEEMSSSKIDLTLKL

SEQ ID NO: 3261 - protein, 139 aa, Brassica rapa subsp. pekinensis
MRKGRGSSAVPPALHGSVKEPRYRGVRKRPWGRFAAEIRDPLKKSRVWLGTFDSAVEAARAYGAAARNLRGSKAKTNFPIDCSPSSPLQPPNYQNHHRNLAPNQNQMDPFMDHRLYGGGGGSFPEQQQVISRPASSSLS

SEQ ID NO: 3262 - protein, 326 aa, Oryza sativa Japonica Group
MTLPPGFRFHPTDDELVGYYLKRKVDSLKIELEVIPVIDLYKFEPWELPEKSFLPKRDLEWFFFCPRDRKYPNGSRTNRATSTGYWKATGKDRKIACAGEVFGLRKTLVFYKGRAPGGERTDWVMHEYRLCQDLAHGVSNFIGAYALCRVIKRHEAGLHGEPPAAKAKGMISKVSSSSSLVTVEHQLSSRGNASPSFTPTNNGSPLVDEMFVGGGGGDPFQLLPSCVPYHGGDACGFDLPPLCMPQTQDPFFSDAGFTQAAPPLYGDVMGSVSEHELKWDTLGGYSGGGGGELWNAAAAPLLCRQASDGDDLTAWFTAADDNMSVF

SEQ ID NO: 3263 - protein, 318 aa, Vitis vinifera
MEEVYGLNSTSDYSDKVLMSPENLILPADYQSFFSSAAAFRDYRIPVFGSNELISVASAISETASITPEIQREEDVSSVIKAKIASHPCYPRLLEAYIDCQKVGAPPEIACLLDEIRRENDVCKRDAVSTCLGADPELDEFMETYCDMLEKYKSDLARPFDEATTFLNKIEMQLGNLCNDASIRSLPDEAVVSSDEDFSGGEEVQEAQPRGEDQELKERLLRRFGGRISSLKLEFSKKKKKGKLPKEARQTLLEWWNLHYKWPYPTEADKIALAETTGLDQKQINNWFINQRKRHWKPSENMQFAVMDNHSGQFFTDD

SEQ ID NO: 3264 - protein, 235 aa, Matricaria chamomilla
MIRNNAFDSDFALLESVRRHLLDDNAPPMSCRSNNFLFPHLSDSWGELPLQQNDSEDMLIAKFLNEALPLQQNDSEGIITPEMTSSSENIFFVKSEPETSSFQPKSLGSQKGKHYRGVRRRPWGKYAAEIRDPAKNGARVWLGTYETAEDAAVAYDMAAYRMRGSRALLNFPLRINSGEPEPVRITSKRKTTSPSEGLVVKKVKVELEMSTQAEFPLVYGCYYCVILGPFLVKCF

SEQ ID NO: 3265 - protein, 499 aa, Arabidopsis thaliana
METEDDLCNNNWGSSSSKSREPGSSDGGNSTFAGFTSQQKWEDASILDYEMGVEPGLQENIQANVDFLQGVRAQAWDPRTMLSNLSFMEQKIHQLQDLVHLLVGRGGQVQGRQDELAAQQQQLITTDLTSIIIQLISTAGSLLPSVKHNMSTAPGPFTGQPGSAVFPYVREANNVASQSQNNNNCGAREFDLPKPVLVDEREGHVVEEHEMKDEDDVEEGENLPPGSYEILQLEKEEILAPHTHFCTICGKGFKRDANLRMHMRGHGDEYKTAAALAKPNKESVPGSEPMLIKRYSCPFLGCKRNKEHKKFQPLKTILCVKNHYKRTHCDKSFTCSRCHTKKFSVIADLKTHEKHCGKNKWLCSCGTTFSRKDKLFGHIALFQGHTPAIPLEETKPSASTSTQRGSSEGGNNNQGMVGFNLGSASNANQETTQPGMTDGRICFEESFSPMNFDTCNFGGFHEFPRLMFDDSESSFQMLIANACGFSPRNVGESVSDTSL

SEQ ID NO: 3266 - protein, 1436 aa, Ustilago maydis 521
MSIGSGEASSDSIQVHPGPAAAGSTPSANPEPLPHTPTPPLPSKQQQSALISSQQQQIQHHQQGQLPSPQDASSTSIAPVTTSADPAPSTPATTPPTDQAPQRPPPPASAVSLHAAAAAANRQAGAQSNSTSQLAPSSASNGKTGADSAPKKAAKPKTTKAPGATKPKQKRKANQAGVNDEVVYRPALSTAGGTIGAAPDSTIPAMLSAAGGGRKAMPELVLPFQLPFVDVRPEMPMLDNASVQAAMAMGASETSSLDTGSDSDDYSVLSDNSDLDQEAEESRKDARRRKREPATIEESLVLLQSLRQSRLSHLSSLLTPFSQRVRSGMIYPNVLPLSLLHGLNPRDPHVLIQLGRADIHVGPHVFLKTKFWEVRPDYELPPTMNTLGGMHAPGPYATLSVYPRLPVPQPMAQQLPQPQPAKLPLPRAAPSPVAPQPSVPLARPPIAPNKSPVARPATTSTPAATASNATMPATLNPPASRQISLTTSAVLPTPTLPATPMQSSTAVRPVVTLKAAIPAPATPTASTPMVKLPALSAGIASTPTTASATSLSTAPKVSIPVAASPPVSGSTTPTSASSDSKPATSITTSTATPLAPKPMSVSVSLPRPPMTTPSLPRPPSINQNNVPSSVNPATSSSSSAAGSAAPRKALSPVSAASAEQGGTGANANVNATPSAASPLAAKVAAAPFETSTSTNAASATVSSQGSTAAKPAAPTNTNANTASPQAPSRPSGVPPPPAIDAVLVSRVNATAALNPELQELLHIAASGKANPNQLKALGVWIQAITAQLRQDEARNAAAAGNTAAASGSRAGNTASTTAEGKKSKKSKVDEAAKASKKQAKIEEREAKKKAKAEAKAKAQADKQQAQKQQKQKQAHAQPQQTPQQQKTQQTQHQPPVSNKLRHPPPGWPTDGPPKPPVIIVEFRENPSMRFILPLWKCLVERTEGVERPSSPKVKKERRSFFDNDSDDEDSPRIEPELKLSFFAPSLGSDAADGSGLRELEEELKRKAAEEAKLNAASAASTGGQGDAARSSASPEAASAAVASDKAVDDSTSSQEKKKKGGPSDGSSKKGSKATNQASSDASLSSDYSQSKKHEVYPLTWSIKGGVTESLWEAFGRVPGTMTCQPVKREPEIELEPDVAEFLVPEIRYHLLDLPMEEIKIHKETTDTFVDLYSQMPDRRFILPRVAPALLPAGLEDHLHDRFAVRTQCVQDRPIVKRKAGAREDDVSFSYEGIGLTVIGPNGVKTEPGATAPPKPPKRKRHVATHNPDGSIKSCGACGKTKTPMWRRGPKGPSQLCNACGARWKAGRLVVPEVAPAPIIEAEEDKSKEEEARKEDEVQASMHGSNALVIPQSSGADDASYTVMASNGLVGAAAFGDHFSLSSKDESGIDFGASHLSRGSSSPSPFIRSPIPEDDVMPASVDPSMLSGSNRVFSHRR

SEQ ID NO: 3267 - protein, 342 aa, Zea mays
MDTFSHVPPGFRFHPTDEELVDYYLRKKVASNKIDLDVIKDVDLYKIEPWDLQEKCKIGMEEQNDWYFFSHKDKKYPTGTRTNRATTAGFWKATGRDKPIYTKSCLVGMRKTLVFYRGRAPNGHKSDWIMHEYRLETTENGTAPEEGWVVCRVFKKRVATVRRMADGAPWFDNHVAGGFMPDLVGSVPRQLMHHHPNAVAAVYSGQQQLYHCKPELEYHHLLPSQDAFLQQLPQLESPKPPPAYIAAQGSCSLQSPDDASGYTARQLPMTEAAYMDDSVTDWRVLDKFVASQLVSHGGDDTAKETAYSSPAQAFQSENRQPEEALDFASTSASGDGEASMWK

SEQ ID NO: 3268 - protein, 274 aa, Triticum aestivum
  misc_feature (73)..(73): Xaa can be any naturally occurring amino acid
  misc_feature (168)..(168): Xaa can be any naturally occurring amino acid
MDAQYNPRTVEEVFRDYKGRRNGLARALTTDVEEFFRQCDPEKENLCLYGFPNEHWEVNLPAEEVPPELPEPXALGINFARDGMQEKDWLSMVAVHSDAWLLSVAFYFGARFGFDKSDRKRLFGMINELPTIFDVVSGKSKTKAPTNNNHSNSKSKSNNKMKTSEPRXAKQPKPQLKEEDHEDEAPDAGEDGGGAAGGGGGGEEHGDTLCGACGDNYGQDEFWIGCDMCEKWFHGKCVKITPAKAEHIKQYKCPSCMGANGGGSGSNKRARPSS

SEQ ID NO: 3269 - protein, 313 aa, Vitis vinifera
MEMESCVPPGFRFHPTEQELVDYYLKRKINSLKIDLDVIIEIDLYRMEPWDIQDRCKLGYDEQNEWYFFSHKDKKYPTGTRTNRATAAGFWKATGRDKAVILRNRIIGMRKTLVFYKGRAPNGRKTDWIMHEYRLQTSEHGPPQAKGWVVCRAFKKPTSSHKQSYEAWSHAYYVRDSSHVEPPSLPATLSPMHMVHPNQGFYQRYFGSEQELMYNHGIMNNQAFEIPQLDSPSALSPSLATKEVFEHNGMNNSEYFEDENSDHAKQYIDWKNLDDLLASQLADTTSSAPLVPYNSELGAQNPVSHLLGCFPDL

SEQ ID NO: 3270 - protein, 238 aa, Picea abies
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDASSPHFNVDNEEYAIKSKILAHPQYPSLLGAYIDCQKIGAPPEAVARLDALTREYQNQQRRTVSIGMDPELDQFMEAYCE

SEQ ID NO: 3271 - protein, 136 aa, Triticum aestivum
MEGEAPQSHQLLLHGVSLDLRLDTATATHQLRGARRPASPAPTPVAFDQAGKEAFSCNYCHRKFLSSQALSGHQNAHKLERTLAKRSRDASSTAATAAQTATPSSHWPHAGGELWAYSASAAAPDSTTMAPLMGMG

SEQ ID NO: 3272 - protein, 164 aa, Triticum aestivum
  misc_feature (92)..(92): Xaa can be any naturally occurring amino acid
  misc_feature (102)..(102): Xaa can be any naturally occurring amino acid
  misc_feature (105)..(105): Xaa can be any naturally occurring amino acid
  misc_feature (117)..(117): Xaa can be any naturally occurring amino acid
  misc_feature (123)..(123): Xaa can be any naturally occurring amino acid
  misc_feature (125)..(125): Xaa can be any naturally occurring amino acid
AAKPKAVKADKPKKRKDPNAPKGALTAYILFSNAKRDMVKKENPDIAFGAVAKKISELWKDVTSSEKAKFAKMAEDDKKRYEKEMADYKARXGGAGDEKPAXEGXEPAKAASESDGXDEDDDXEXDTKTHHPPSKLISPSTSSVISPGLRSHFFCSRWNPQRGR

SEQ ID NO: 3273 - protein, 227 aa, Plantago major
MVESCTKMNFEETELRLGLPGGAAAAGEKTTNNNNYGKRGYEQTVDLKLNLSSKDLPNQTDLAENKKNDQPVKPPAKAQVVGWPPVRNFRKNVMAVQKTEKAEESGGSAAFVKVSMDGAPYLRKVDLKMYKTYEELSDALGKMFSSFTMSKCDAQGMMDFMNESKLMDLLNGSDYVPTYEDKDGDWMLVGDVPWEMFVGSCKRLRIMKGTEAIGLAPRAMEKCKSRS

SEQ ID NO: 3274 - protein, 262 aa, Musa acuminata
MAYRTPETQGRPPEAKDKQITSKGTSKDGGELTGKWGNGGKGTSGAAENSSQSDDSATEGSSDTREDGSQPKDHSLARKRSYGNMIAEGEASHPLDTAEHSGANAESTYSGRSRTAKKLPVSAPGRATLPGSQTNLNIGMDFWGATHAGSVPMKDDRELRRERRKQSNRESARRSRLRKQQECEELARRVTDLESENSALRVEIESIKKLRGELKAENKSIMVSCFITCIICLGMAVILHVDMGWVQFLSSHGFCWSDPNCV

SEQ ID NO: 3275 - protein, 229 aa, Nicotiana langsdorffii x Nicotiana sanderae
RGKIEIKRIENTTNRQVTFCKRRNGLLKKAYELSVPCDAEVALIVFSSRGRLYEYANNSVKATIERYKKACSDSSNTGSISEANAQYYQQEASKLRAQIGNLQNQNRNMLGESLAALSLRDLKNLEQKIEKGISKIRSKKNELLFAEIEYMQKREIDLHNNNQYLRAKIAETERAQQQQQQQMNLMPGSSSYELVPPPQQFDTRNYLQVNGLQTNNHYTRQDHPSLQLV

SEQ ID NO: 3276 - protein, 591 aa, Gibberella zeae PH-1
MATAHMAVRTDTFPHSTSRSHSHSHQSMGARIIPIPTPTIKMSPPSNGDPMEITSPAPSSNGNHNSDSEANGNGQSNDRPKNSPAPDSNTVTSNSVNNSNSMPAPPPAAAAVHQPKIVQTAFIHKLYNMLEDPNIQHLISWSASAESFVMSPSADFSKVLSQYFKHTNISSFVRQLNMYGFHKERDVFHTGNPDTTLWEFKHGNGNFKRGDLVGLREIKRRASRHALVHRESNYTKPVTSQPGTPAEPVPLPPDSADARLLNIEHTLFDLSNRLQRSEENAHYMHVKNQAAMETMNRLLHFNQELSRTMLSIVPAESPISRDVIALQGEIQRQVDVLRTIEEPPQEPPYTGRQQYFAGVENAPVSPRQLAQDDQRRGPTLNVPSARSQNFYKPPVPSNLSAGTRRQYGSISGGSTTQSSPLRTAPPPPPPAPHPLSNVETVPGPGSLARRHTAADIRAHGWQPTPSPFASGAPSGAWPPSPSRAAPEEQRIRDSLSTYSLQNASQAHPHSRPTTPPPPFVNGLGGGSDTFGGWSWGSAGRENKNLSVKDHSAPTTRRGSMAHILNPSDTAERSDEDEDPRGDDDRKRKRMQ

SEQ ID NO: 3277 - protein, 250 aa, Triticum aestivum
  misc_feature (208)..(208): Xaa can be any naturally occurring amino acid
MASAGAAIGARAARACDGCMRRRARWHCAADDAYLCQACDASVHSANPLARRHHRVRLPSSSSPAATSSLQHADPDEPAWLHGLKRRPRTPRSKPGMVGKHGAPAAAKAAAASAVPDLEAEDSGSGIVGDNDDGHGVEVDDEDLLYRVPVFDPMLAELYNPVPVDEFREPLEQKPSVCCFSSLARQPSSEYASRRGPAPPTGSPGFDXVPDMDLRSFARENGGPCSWEGVKDGVSITWGSLDEEKPPLNP

SEQ ID NO: 3278 - protein, 206 aa, Nicotiana langsdorffii x Nicotiana sanderae
MEFQSDLTREISPQRKLGRGKIEIKRIENTTNRQVTFCKRRNGLLKKAYELSVLCDAEVALIVFSSRGRLYEYANNSVKATIERYKKACSDSSNTGSISEANAQYYQQEASKLRAQIGNLQNQNRNMLGESLAALSLRDLKNLEQKIEKGISKIRSKKNELLFAEIEYMQKREIDLHNNNQYLRAKIAETERAQQQQQQQMNLMPG

SEQ ID NO: 3279 - protein, 180 aa, Triticum aestivum
  misc_feature (153)..(153): Xaa can be any naturally occurring amino acid
MQSQIVCHGCRSVLLYPRGAPSVCCAVCHAVTSAPPPGMEMAQLICVGCRTLLMYTRNATTVRCSCCDTVNLARPAPPVNSIAHVNCGQCQTVLMYPYGASSVKCAICNFITNIGMNTVRPLPPTMHAPNGISYSVPSTSAPSAQSQNVTVVXVENPMTVDDKGKLVSNVVVGVTSGGKK

SEQ ID NO: 3280 - protein, 296 aa, Glycine max
MMKNDREKGNEVDQSYIQQHHSLSMPMMFSGFNREKEMSAMITALTRVVCGDYSLVHHNIDNTNSAIVGGGGGDDVSNMASGSMPPSSTSLSHGGNSVLKRRREDDNTSDFLRGGSFPAILTTAEGSSTIRRRRANTVYDYEYRREKVKVEEEEEARRKYRGVRQRPWGKWAAEIRDPLKARRVWLGTFETAEDAARAYDQASLRFRGNKAKLNFPENVRLRHTETLQGSRASSNFYDNSYSHVHDLPVSLYDQTTMASSSTISMTSPQAPPSIYPTHLLPAWSSGYAYNSSSSSA

SEQ ID NO: 3281 - protein, 642 aa, Oryza sativa Japonica Group
MASGGGSSNWLGFSLSPHMPAMEVPSSSEPSTAAHHHHHHHPPAAAAAAGAMSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGTGKGGQKQPVHRKSIDTFGQRTSQYRGVTRHRWTGRYEAHLWDNSCKKDGQTRKGRQVYLGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKAIEAAPDHVPIGRELGATEEASAATVTGTDWRMVLHGSQQQQAAACTEATADLQKGFMGDAHSALHGIVGFDVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 3282 - protein, 268 aa, Oryza sativa Japonica Group
MVTALAHVIRAAPDLHLPHHPSSSASAAAHPQQASSFYPTAAAAASSPSDQLAAAAAAEEQGRRRHYRGVRQRPWGKWAAEIRDPKKAARVWLGTFDTAEDAAIAYDEAALRFKGTKAKLNFPERVQGRTDLGFLVTRGIPPAATHGGGYYPSSSPAAGACPPPRQQQTVVPYPDLMRYAQLLQGGVGGSYMPFGGAATMSSSTVSSSSAPQILDFSTQQLIRAGPPSPMPSSGSGSATAAASSTTSASSPGAWPYGGSERKKKDSSS

SEQ ID NO: 3283 - protein, 277 aa, Zea mays
MPSDKAKAPKKKGEEDPGIPPAPCEGEISHEPHRQRSLNGRTTGPTRRSTKGNWTPEEDAILSRAVQTYQGKNWKKIAESFPDRTDVQCLHRWQKVLNPELVKGPWSKEEDEIIVQMVNKYGPKKWSAIAQALPGRIGKQCRERWHNHLNPAINKEAWTQEEEITLIHAHRMYGNKWAELTKFLPGRTDNAIKNHWNSSVKKKVDSYISSGLLSQVPCLSLIECPAQCDSLSAMDQQNNGGTDCNDQNTSVGLSSDLQVNVDANKKEHMTLTRPCVK

SEQ ID NO: 3284 - protein, 216 aa, Nicotiana tabacum
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGSDMEETLVEAIYTAEQSENAFYMHDEAMFEMPSLLANMAEGMLLPLPSVQWNHNHEVDGDDDDVSLWSY

SEQ ID NO: 3285 - protein, 208 aa, Triticum aestivum
  misc_feature (10)..(10): Xaa can be any naturally occurring amino acid
DVRGRPSILXDLETEFGSGPWLLFRGQLPGHLSEANSGFDVFVNGRRGVGMRRADVADYFVGPGLEDLIEQLTHNDRRGPPPASQSSIDAMPSVRITARHLTGDSHCPVCKDKFELGSEAREMPCKHLYHSDCILPWLEQHNSCPVCRYELPTQSSSGASCSRSRSTNQNDSSSSSSSSGRTSGRQRRRNPFSFLWPFRSSSSSTGSR

SEQ ID NO: 3286 - protein, 1054 aa, Oryza sativa Japonica Group
MGAPKQKWTAEEESALKAGIAKHGAGKWRTILKDPDFSNVLRYRSNVDLKDKWRNMNVTVNASGARDRVKAPVVKKPRSAPKHEGHSTSTAIAAVTSDGDDDVAEPVPLATSTSSKRSLSRLDNIIVEAVRSLNEPTGSYKTAIANYIEEQYWPPADFDHVLSSKLNDLTASGKLIKVNRKYRIAPSSSLSEGRSSKVVLLEDIKKEPTKLDREDVAVLTKSQIDAELARMRTMTAEEAAAAAARAVAEAEAIMAEAEAAVREAEAAEADAVAAQAFAEAAMATFKNRSSAKLVIALSTSVLVSNDHSSLKLPVGAGAASVSSDLVRDVFNLVWLLFNSKSLKGPCILLFGCRSSTRIGSVWFLFRFVGGELRKKNTFLWGFGRIEMEGTAQQGFPAMFLLRLGRCLSTFTSYSRNFDESYSYSHSYWLILKRGKNAFISDFFPLYLFPLLSKSAILGRLIEENSDSDECVIILSDIPGGAKSFELVARFCYGLKIELSSENVVYLRCAAEHLEMTEETSGDNLINQTESFFNQVVLRSWKDSLEALRTCDGLLPHAEDLHIVKRCIESLAGKASIDPDLFGWPVSEHSTMQSPGGSVLWNGISTGAKVRNCSSDWWYDDASSLSFPTYKRLISSMESRGIKQEIIAGSLTYYAKKFLPGLNRRQSTGPMPLPAATLSDEEQRRLLEEIDRMLPLQRGLISTNVLLWLLRTAMILKVDRACISNLEKRVGMQLDEATLEDLLLPNFSYTMDTLYNVECVHRILDHFLAMDQTMGGGGASPCLDDVMASPSLAPITAVAKLIDGYLAEIAPDINLKPLKFQSLAAVLPEYARPLDDGLYRAIDVYLKSHPTLPEAEREQLCRLIDCQKLSLEACTHAAQNERLPLRVVVQVLFFEQLQLRTSVAGCLLVSDNLEASSRTLRGGGAVAASGEAGCWARAALRENQALRVGMDSMRLRLMELERECSDMRQEIRKLGRGRRRLRGGGGIVAGGKDGGGWAARVQRMLTPRMMKLQMCSAQHDAAEQQRMNNEHKKVEKVAKNKKQLSMDDGDDEEEA

SEQ ID NO: 3287 - protein, 83 aa, Physcomitrella patens subsp. patens
MESPSSSRRQESEVRKKAKVEGDTRHPVYRGVRKRPWGIWVTEIRRPKKKSRIWLGSFATAEMAARAYDCAALALRGNGALLN

SEQ ID NO: 3288 - protein, 443 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPQSTFSIVPPTPSYYFPTPNGSPGPNQSGVATHLPRGSSCAVPCTQVHSPIPMKGRPLFNDRDLEGKGTQKEGSSTGSNAESVDAEYLEIEAQSSRNVVEESVRVRASVPSLFERRANSTKRVKGFVPYKRCLAERGVSSSTLTGEEREEQRTRLCL

SEQ ID NO: 3289 - protein, 443 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSCSPDLCLSEPENQSPTSVLSTLGSDAFGTVDSTKPSEQSSPVSSAVAENSGDLVLSEPFDFVVEESRSSPARAYATSNPANQACVKLELFPEDNDFVKEGSDEASSTQCLKLFGKTVLVTDAHMPPTDETLTRSSFPAKYLPWDSECPQSTFSIVPPTPSYYFPTPNGSPGPNQSGVATHLPRGSSCAVPCTQVHSPIPMKGRPLFNDRDLEGKGTQKEGSSTGSNAESVDAEYLEIEAQSSRNVVEESVRVRASVPSLFERRANSTKRVKGFVPYKRCLAERGMSSSTLTGEEREEQRTRLCL

SEQ ID NO: 3290 - protein, 226 aa, Zea mays
MGAARDSAAAGQKHGTGTRCELCGGAAAVHCAADSAFLCLRCDAKVHGANFLASRHVRRRLVPRRAADPEASSAASSGSSCVSTADSAESAATAPAPCPSRTAGRRAPARARRPRAEAVLEGWAKRMGFAAGPARRRAAAAAAALRALGRGVAAARVPLRVGMAGALWSEVAAGCRGNGGEEASLLQRLEAAAHVPARLVLTAASWMARRPDARQEDHEEGWAECS

SEQ ID NO: 3291 - protein, 205 aa, Brassica napus
MEPSSLRANQSSILSEIERMPEAPRQRISHHRRARSDTFFSGESIDDLLLFDPSDVDFSSLDFLNAPTPQTQPQPQPSPMSVDSPPEETSSNGAPPIPLPPGRHVRSFSVDSESNFFDDLTATEDTQFARPTSSEGRKGHHHRSNSMDGATSSGLFNMDSILAAVNCKDGAKKNMGMASDRLAELALLDPKRAKRILANRQSAAR

SEQ ID NO: 3292 - protein, 142 aa, Pinus strobus
EEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 3293 - protein, 150 aa, Picea sitchensis
MDQVSLQPGFRFHPTDEELVSYYLKRKVRGQRFDFNAISEIDLYKFEPRDLPGKSCLQSRDLEWYFFNPKDRKYPNGSRTNRSTKDGYWKTTGKDRPVCSASQTVGMKKTLVYHTGRAPRGERTNWVMHEYRLEGKDLKMSNPAQVISII

SEQ ID NO: 3294 - protein, 142 aa, Picea glauca
EEVEDGSGGETDFQEVDHHAVEDRELKDHLLRRYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 3295 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRDSSNGDASSVKSIEIPPPRPKRKPMHPYPRKMATPLKGGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3296 - protein, 228 aa, Zea mays
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWK

SEQ ID NO: 3297 - protein, 195 aa, Vitis vinifera
MAPRSINEGSSKKVMNKGAWTSEEDRKLAEYIEVHGAKRWKTVAFKSGLNRCGKSCRLRWLNYLRPNIKRGNISDDEEDLILRLHKLLGNRWSLIAGRLPGRTDNEIKNYWNSHLSKKLQQKENKTETSTAKETAPQKPEDIAEGSGEEDKGSGYPDINFDVNEFFDFSAEGSCGLEWVNKFLELDEESWLAKKR

SEQ ID NO: 3298 - protein, 245 aa, Zea mays
MDGAEDDGTEWMMHGAGGKGKGGGALDKNKKRFSDEQTKSLESMFATQAKLEPRQKLQLARELGLQPRQVAIWFQNKRARWKSKQLEREYSALRDDYHALLCSYESLKDDKRALLKQLEKLAEMLHEPPQGKYYGGNADDVRSGGVGGTKEEEESTDACAGAALYSSECAGGGRFIAHFLADDDVGAALFRPPSSPQPTAGLLTSSGPPEHQAPFQFHSGCCWPSSSAEQTCSGSQWWELESLSE

SEQ ID NO: 3299 - protein, 155 aa, Fragaria x ananassa
PKRPAGRKEFRGTRHPVYRGVRRRDSGKWVCELREPNKKSRIWLGTFPTAEMAARAHDVAAIALRGRLACLNFADSSWRLPLPASTDPKDIQKAAAEAAEAFRPEKDLRRVDDKMDEKEVAERTTMSDGVIFMDEEAVFGMPGLLTNRAEGMLLP

SEQ ID NO: 3300 - protein, 328 aa, Physcomitrella patens subsp. patens
MGDNSPRTDTSTDIEGDAKFEDGHHTITGGSNTSDHEAGNKNGDSKALRRLAQNREAARKSRLRKKAYVQQLESSRIKLNQLELELQRARQQVFSLHITHVWPVTPGFSAAFDMEYGRWVEEQHRQMSELRAALQAQVADTDLRVLVDRGMIHYDDIFRLKAVAAKVDVFHLFSGVWKTPVERCFMWIGGFRPSELLKTLTPQIEPLTKQQLLNICNLQQSSLQAEEALSQGLEALQLSLSDTLSGGSLGSSSNVSNYMDQMAGAMTKLGTYEAFVHRADNLRQQTLQQMHRILTTRQAARGLLAMGDYFARLRALSSLWLARPRELD

SEQ ID NO: 3301 - protein, 264 aa, Brassica napus
ARGPNPPPNLNPGGGFFPMADPFSTLLPLLFGSSSSSTANPSFSGQPSMQPRSTRNDAFDPVSFLQNHLQHLRSSGTHVQFVIENHPSDPSNRIPGNLGDYFFGPGLEQLIQQLAENDPNRYGTPPASKSAVDGLPTVKVTKDMLRSEMNQCAVCMDEFEDGGDVKQMPCKHVFHQDCLMPWLELHNSCPVCRYELPTDDPEYESRVQGRGGEASGGGQGAVETGRRFSIQVPLPFRGRDGDGDGSGSGASGTGGGANLETRRD

SEQ ID NO: 3302 - protein, 123 aa, Triticum aestivum
MVSALSHVIRATPDQQQAYYPAGSAAVSGEQQHQHDAAAAAAIAEEQGRKRHYRGVRQRPWGKWAAEIRGPQKAARVWLGTFDTAEDAAIAYDEAALRFRGTKGKLNFPERVQGRTDLGFVVT

SEQ ID NO: 3303 - protein, 287 aa, Populus euphratica
MGTLIQGSNATSMSMDSTKKRKRASNKSVAETLQKWKEYNEYLDAQGDEGNKPVRKVPAKGSKKGCMKGKGGPENSVCNYRGVRQRTWGKWVAEIREPDRGPRLWLGTFPTAYEAALAYDNAARTMYGPRARLNIPDVVNSTSSSKDNFSAVTPSYYYSAASSADSVTTSTHSEVCAYEDPNQNVLSHAEDWMTNISSQAEVCEQNASSQTEVYEQNVSSQHVEDCSRGVEKNSKLSQDELKIQPENPSWANDCHDYGWDEIFSVEELLGDIDSGMTGAEGYFSLGF

SEQ ID NO: 3304 - protein, 384 aa, Zea mays
LGVPSVKHMFPFCDSSSPMDLPLYQQLQLSPSSPKTDQSSSFYCYPCSPPFAAADASFPLSYQIGSAAAADATPPQAVINSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAASGPSDRPSSNNLSHHSSLSMNMPCAAAELEERERCSSALSNRSAGRMQEITGASDVVLGFGNGGGGYGDGGGNYYCQEQWELGGVVFQQNSRFY

SEQ ID NO: 3305 - protein, 210 aa, Sabal palmetto
MESFSDCSMDSPLAQRSASDEEVYATVSSAPPKRRAGRTKFRETRHPVYKGVRRRNADKWVCEVREPNKKSRIWLGTFPTAEMAARAHDVAAMALRGRSACLNFADSAWLCPVPRSSSPKDIQRAAMEAAEAFRPQTESDAAESREDAAMAMIAGPSLAATDDPFSMEDGLNFGMQGYLDMAAGLLMEPPPIYADEEVSDGDVSLWSYSI

SEQ ID NO: 3306 - protein, 210 aa, Sabal minor
MESFSDCSMDSPLAQRSASDEEAYATVSSAPPKRRAGRTKFRETRHPVYKGVRRRNADKWVCEVREPNKKSRIWLGTFPTAEMAARAHDVAAMALRGRSACLNFADSAWLCPVPRSSSPKDIQRAAMEAAEAFRPQTESDAAESREDAAMAMIAGPSLAATDDPFSMEDGLNFGMQGYLDMAAGLLMEPPPIYADEEVSDGDVSLWSYSI

SEQ ID NO: 3307 - protein, 221 aa, Oryza sativa
  misc_feature (111)..(111): Xaa can be any naturally occurring amino acid
  misc_feature (183)..(183): Xaa can be any naturally occurring amino acid
  misc_feature (197)..(197): Xaa can be any naturally occurring amino acid
MAPVGLPPGFRFHPTDEELVNYYLKRKVHGLSIDLDIIPEVDLYKCEPWELEEKSFLPSKDSEWYFFGPRDRKYPNGCRTNRATRAGYWKSTGKDRRINYQNRSIGMKKTXLVYYKGRAPQGIRTSWVMHEYRIEESECENAMGIQLQDSYALCRILKKNVVLGEFDKKGECSSSQAKGNEEXVTDFGDAGQSSGAXNENDKDNSWMQFIAEDLWCTTKLK

SEQ ID NO: 3308 - protein, 156 aa, Oryza sativa
  misc_feature (6)..(6): Xaa can be any naturally occurring amino acid
KEIISXRSTTTTTTTAPAGDVNLDLRLVHSTAAGRQHTAATRNPAPPLAAAGDDRAFSCTYCRRRFYSSQALGGHQNAHKLERSLAKRSRELSAGVTTAAAPPPPHPELGWPYPPQGGAAAAVVSWIADGGRRYGYRVHAAAAGGDAEDIDLSLKL

SEQ ID NO: 3309 - protein, 494 aa, Zea mays
MSARPPPPPRPRLALPPRSTAESLFTGAGDASPGPLTLASALFPSDADGGGGPGGASSSAAGAATFTQLLTGSLAPPPQQQQHEAQTGGGGVARAGPALSVAPPASSFAGASLFTVPPGLSPSGLLDSPGLLFSPAMGGFGMSHQQALAQVTAQATHSPLRMFDHLEQPSFSTAATTSGALHHMNSAASMAGISDMTMATANNENPSFQSAEASQRYQVNAPVDKPADDGYNWRKYGQKVVKGSDCPRSYYKCTHPNCPVKKKVEHAEDGQISEIIYKGKHNHQRPPNKRAKDGNSSAFDQNEQSNDTTSGLSGAKRDQDNIYGMSEQAYGLSDGDDMDDGESRPHEVDDADNESKRRNIQISSQRTLSESKIIVQTTSEVDLLDDGYRWRKYGQKVVKGNSHPRSYYKCTFAGCNVRKHIERASSDPRAVITTYEGKHDHEPPVGRGNNQNAGIPQQKEGQNNISSNQASLSRPDFSNANQMPIGILQFKSEQ

SEQ ID NO: 3310 - protein, 139 aa, Pinus strobus
EDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 3311 - protein, 852 aa, Oryza sativa
MATAEVGGGGGEGDAAAAAVARGGGGGGGGGGGEDALFTELWSACAGPLVTVPRVGEKVFYFPQGHIEQVEASTNQVGEQRMQLYNLPWKILCEVMNVELKAEPDTDEVYAQLTLLPELKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKRNYSIGMRFKMRFEGEEAPEQRFTGTIVGMGDSDPAGWPESKWRSLKVSWRKASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGWMQMSKPESYSEMLSGFQPPKDVQTPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 3312 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKGGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPQSTFSIVPPTPSYYFPTPNGSPGPNQSGVATHLPRGSSCAVPCTQVHSPIPMKGRPLFNDSDLEGKETQKEGSSTGSNAESVDAELSGDKNMEIEAQSSRNVVEQSVRASVPSLFERRANSTKRVKGFVPYKRCLAERGMSSSTLTGEEREEQRTRLCL

SEQ ID NO: 3313 - protein, 371 aa, Zea mays
  misc_feature (110)..(110): Xaa can be any naturally occurring amino acid
MGSSGADTPSKEQQPPATSGAAIPPVYPDWSSFQAYPPIPPHGFFPSPVASSPQGHPFMWGAQAMIPPYGTPPPYVMYPPGVYAHPSMPPGAHPFTPYAITSPNGNADAXSGNTDGKPSEGKDKSPTKRSKGSLGSLNMLTGKNPSEHGKSSGASGNGVTSQSGESGSDSSSEGSEGNSHNDSHHKESGQEHDGDVRSSRNGVSRLQSEGKLNQAMAILPIPSSGPATDPTTNLNIGMDYWANTASSAPAIHGKATSTTVPGAVVPAEQWTQDEHELKKQRRKQSNRESARRSRLRKQAECEELAQRADVLKQENASLRDEVNRIRKEYEELLSRNNSLKEKLEGKQHKTDEAGLNNKLQHSGDDSQKKGN

SEQ ID NO: 3314 - protein, 131 aa, Picea glauca
DFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 3315 - protein, 196 aa, Oryza sativa
  misc_feature (28)..(28): Xaa can be any naturally occurring amino acid
MQSQIVCHGCRSVLRYPSGAPSVCCALXTRAITTVPPPAPVMEMAHLICGGCRTLLMYTRNADTVRCSCCSTVNLVRPVNNIAHVSCGQCRTTLMYPYGAPSVKCAICHYITNTGMNTVAPTPSPMPTSSGSSYNAPPSGSSYNAPPSGSSYNAPPPTSAPTSRPQNVTVVVENPMTVDEKGKLVSNVVVGVTTGK

SEQ ID NO: 3316 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSCSPDLCLSEPENQSPTSVLSTLGSDAFGTVDSTKPSEQSSPVSSAVAENSGDLVLSEPFDFVVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3317 - protein, 134 aa, Pinus strobus
EVEFHEVDPHAEDRELKDQLLRKYSGYLSSLKQEFLKKKKKGKLPKEARQKLLDWWTRNYKWPYPSESQKIALAESTGLDQKQINNWFINQRKRHWKPSEEMQFVVMDSPNPHNAAFFLEGHLRTDGTAFSMDC

SEQ ID NO: 3318 - protein, 178 aa, Canavalia gladiata
MATEEVNKPPSLPPYPEMVMKALDALNEPSGSNKSAISKYIESTYGELPDGHATLLAHHLNKMKDSGELVFLKNNYMKPDPNAPPKRGRGRPPKPKVPLPPGTVLSPPRPRGRPPKDPNAPPKSPKTKVSTGSGRPRGRPKKIARSPAAVAPTPVPSGRPRGRPPKVKPQLTEVSVES

SEQ ID NO: 3319 - protein, 129 aa, Brassica napus
MGCCQSRIDRKEIVSRCKARKRYLKHLVKARQSLSVSHALYLRSLRATGSSLVNFSSKETPLHLHHNPPSPSPPPPPPPARPQQPPLSPSSETTWTSTTTSSALPPPPPPPPPPPPQPSSTWDFWDRSS

SEQ ID NO: 3320 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDLEGKETQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 3321 - protein, 321 aa, Glycine max
  misc_feature (163)..(163): Xaa can be any naturally occurring amino acid
MEMQVSIILRSLFWRLFSSFNRKKENFNMNSSSDFISKELKYILDQIESTRSTIFGSASNIHSNGEKQSENVAHIPSVGNNQTPKVRKPYTITKQREKWTEEEHQKFLEALKLYGRGWRQIEEHIGTKNAVQIRSHAQKFFSKVVRESEGSAESSIQPINIPXPRPKRKPLHPYPRKSVNSFRGPTIPNETEISPSTNLLVAEKDTPSPTSVLSTVGSEAFGSQFSEQTNRCLSPNSCTTDIHSVSLSPVEKENDCMTSKESEEEEKASPASRPLSTVSNPKMCMKPEFSSKEIEDATDMPQTTSIKLFGRTVSMVGNQKS

SEQ ID NO: 3322 - protein, 106 aa, Heptacodium miconioides
TAHGLRDRRMRLSLQIARKFFDLQDMLGFDKASKTIEWLFTKSKKAIKEVTLNHPQMKNKCRGSREKNESFVSECEVESAIENVNDGERLERGKAQKLAYDPLARE

SEQ ID NO: 3323 - protein, 370 aa, Citrus sinensis
MAAFSYQQHHHPFLLDSSEFIEEGSFFSQLYYPPKFPTHDDHQEMIVVNNNSNNLLDAAAVFKTSCGDNHNHHSDDNCNEPSNNNSLATKNQSTAVSSTEQQVTQSTVTTTATTTRMDKKRKNRTNASSSFNSAQSKDPREVKSKKQKKGNVNDAKKEEKENSPKADSEKKVAKEPPKDYIHVRARRGQATDSHSLAERVRREKISERMKILQKLVPGCDKVTGKAFMLDEIINYVQFLQNQVEFLSMKLASVNPMFYDFGMDLDNTFMVRPDDQQNLNSIIAASASAPQVQCSPTAQLTAFADTTTAFAPADHRNNYPVLDTALLLQQGQRPNALIYQDNGNSLLWDVEDQKQRFLNPSGFTSNLCSFN

SEQ ID NO: 3324 - protein, 219 aa, Arachis hypogaea
MTPLAFSQFYEKWFDLLHHLVNQLSDFASSIANSKEEYISPLVAAKQEEKLAQLIGKVMLHHEEYFRAKSLITENDPLSVVASPWATTLERSLHWVTGWRPTTAFHLVYTESSVLFESHIGDILRGVNTGDLGDLSPTQFRRVSELQCDTVKEENQITDELSDWQDTASHLMGPRAESKERIERLICITRKRMIYGSERCAAWLVAVAATRRLNPHNVC

SEQ ID NO: 3325 - protein, 84 aa, Heptacodium miconioides
TAQGLRARRMRLPLQIARRFFDLQDMLGFDKASKTIEWLFAKSKKAIKELTKNIPNMNKKGGCGPISFSSEGEKNKRQLGKGRE

SEQ ID NO: 3326 - protein, 237 aa, Oryza sativa Japonica Group
MVTVREEMRKGPWTEQEDLQLVCTVRLFGDRRWDFVAKVSGLNRTGKSCRLRWVNYLHPGLKHGRMSPKEEHLIIELHARWGNRWSRIARRLPGRTDNEIKNYWRTHMRKKAQERRGDMSPSSSSSSLVYQSCLLDTVPIISMDGGDIHDDRSCMARVLKSTQSVMDGYTMDQIWKEIEAPGAPSLLGIDEGKDKACSNLPCPLLTSTMSDYSCPEVFWKIDNEETRMLATQSGYGK

SEQ ID NO: 3327 - protein, 259 aa, Solanum demissum
MGRFDKEGLKKGPWTPEEDQKLLSFIDKHGCGSWRALPAKAGLQRCGKSCRLRWINYLRPDIKRGKFSLQEERTIIQLHALLGNRWSAIAAYLPSRTDNEIKNYWNSCLKKSHMAEWESARLEAEARLVQKSKILFHNNNSHNYNINPSTVSQQLPYYQQLPCLDILKAWQMTSTKLPTINDISHAILRNNSKNKKLDSSIPSSTLNSSENIFANNAPTTKVGDDHQNLHNLSTINSCFEDDHLQTELPSFMQEFSGFY

SEQ ID NO: 3328 - protein, 94 aa, Kolkwitzia amabilis
TAQGLRDRRMRLSLQIARKFFDLQDMLGFDKASKTIEWLFAKSKKAIKEVTLKHPQMKNNFRNREEKNESITSECEVESPIANVYGEKGKAQKE

SEQ ID NO: 3329 - protein, 302 aa, Solanum lycopersicum
MSSVCSDKSSSTPAVTGGGFGGEIMLFGVRVKVDPMRKSVSLNDLSQYEQPNANNNNNNGGGDNNESSKVAQDEGYASADDAVQHQSNSGRERKRGVPWTEEEHKLFLLGLQKVGKGDWRGISRNFVKTRTPTQVASHAQKYFLRRSNLNRRRRRSSLFDITTDSVSVMPIEEVENKQEIPVPAPATLPPVETTKTNAFSVAPAVAPIIFPVQVNKSRENPTLFRHDHANSSMLVGPVPMFSMPNPSKSIDLNANHNSTIEPSSLSLRLSLSLDQGQASSTRHSAYNVMSSFSNGESIIRVA

SEQ ID NO: 3330 - protein, 84 aa, Kolkwitzia amabilis
TAQGVRARRMRLPLQIARRFFDLQDMLGFDKASKTIDWLLAKSKGAIKELTKNLPSRNGKGGCGYFSDSFKGGKNKRDLGKARE

SEQ ID NO: 3331 - protein, 94 aa, Linnaea borealis
TAQGLRDRRMRLSLQIARKFFDLQDMLGFDKASKTIEWLFAKSKKAIKEVTLKHPQMKKIFHNREEKNESISTEYEIDSAIENVYGEKGKAQKE

SEQ ID NO: 3332 - protein, 224 aa, Brassica napus
MASPTSLNSTPTDLVRRKKRQSASSSAASPRRNNAASATAGDGESHARWRSEKQQRNYSAKLVQALQQVRLSSSAAETPSPTAKKRGKAVREAADRALAVSARGRTLWSRAILANRIKLKFRKQKRPRPAAIPAVITTGSSSSSNSGRWKKRRVTVVKLNKKSIPTVNRKVRVLGRLVPGCKKESVPVILEEATDYIQALEMQVRAMKSLAELLSGSNSAPPPI

SEQ ID NO: 3333 - protein, 630 aa, Candida glabrata CBS 138
MDYEVNANQIPVLGIEQGLIPDNLDGSVKADTATSTAMNMNDKSEISNDGSHSIHTSNPNNNGENGKNGGKPASNDFVRKLFNILESNQYSNIVRWSNTGDSFVVLDTGKFTTQILPNHFKHSNFASFVRQLNKYDFHKIKRTNEERQKSIYGEQSWEFENPNFKINDEKSLDLIKRKTPAQRKVMLEDASAPSQKTPELLSVQSENKLKSALLSNTVKKDIFNNLRKRVDKMQKDMDTVMMDNYNLKSDYQKLATKYNTLLDSLITFRTVNENLINNFNALCNVLSSKGVELPSSVYENMNINIPVPSGQSPVNISPSPSLGIPIKNSTMSPSLPSMKSLQNTPSLTGKLSTNQRLDLPPNSQGILSDTNVGQTESPEIQMPISSNSSSTTKEVDQNIVLRKGFHVLLVEDDSVSIQLCSKFLRKYGCTVQVVTDGLSAISNLEKFRYDLVLMDIVMPNLDGATATSIVRSFDNQTPIIAMTGNIEDQDLITYLQHGMNDILAKPFTRNDLHSILIRHLKDRIPLCDQNRGSGITSESPNLPPTQHIISSQQNNEQNSSLPQSLPPIHPPNHQSPLFNNRASNITPLAPLNSAMSPQSPSHLERPLTNRSPLGMTPLNDGQPAFKKQHT

SEQ ID NO: 3334 - protein, 242 aa, Nicotiana tabacum
MGRGKVQLRRIENKINRQVTFSKRRGGLVKKAHEISVLCDAEVALIVFSHKGKIFEYSSDSCMEQILERYERYSYTERRLLASNSESSVQENWSLEYAKLKAKIDLLQRNHKHYMGEDLDSLNLKDLQNLEQQLDTSLKLIRSRKNQLMHESISMLQKKEKAIQEENNMLSKKIKEKDNTVGQQVEWHQQNQVPTSTSFLLQPHPCLNIGGNYQEEAEEARRNELDLNLDSLYPCHMGCFAT

SEQ ID NO: 3335 - protein, 211 aa, Trachycarpus fortunei
MVNFSDYSMDSPLAQRSASDEEAYATVSSAPPKRRAGRTKFRETRHPVYKGVRRRNADKWVCEVREPNKKSRIWLGTFPTAEMAARAHDVAAMALRGRSACLNFADSAWLCPVPRSSNSKDIQRAAVEAAEAFRPQTERVDAAESREDAAMAMIAGPSLAAADDPFYMEDGLNFGMQGYLDMASGMLMEPPPIYADEEVSDGDVSLWSYSI

SEQ ID NO: 3336 - protein, 227 aa, Paulownia kawakamii
MAREKIQIKKIDNATARQVTFSKRRRGIFKKAEELSVLCDADVGLIIFSSTGKLFEYASSSMKEILGRHNLHSKNLDKLEQPSLELQLVEDSNYSRLSKEVAERSHQLRRMRGEELQGLSIEKLQHLKKSLESGLSRVIEKKGEKIMKGDQSTSRKGKQLMEENERLRQQVADISNDCKNNAASDSENIVYDEGQSSESVNACNSVGPPQDYDSSDTSLKLGLPYSG

SEQ ID NO: 3337 - protein, 210 aa, Ravenea rivularis
MESFSSDSMDTPLAQRSASDEEAYATVSSAPPKRRAGRTKFRETRHPVYKGVRRRNADKWVCEVREPNKKSRIWLGTFPTAEMAARAHDVAAIALRGRSACLNFADSAWLCPVPRSSSPKDIQRAAMEAAEGFRPQTEPDAAKSREDATMAMAAGPSLAAADDPFYVEDGLNFGMQGYLDMAAGLLMEPPPTYADEEVSGSDFSLWSYSM

SEQ ID NO: 3338 - protein, 484 aa, Physcomitrella patens
MNVSEGCSTLTGAQLKYSTDKSNMSYETVYRDAAVESPQREVSNESGSTLKEHDYFGLSEVLSSNSSSGKQPEKCCREELNLNESATTLQLGPPAAVKPSGQADGDDAHDEGAGPENPAKRSAYHMQQESLADGRKAAAEMGSFKIQRKNILEEFRAMKAHAHMTKSPKTVQTMQHNMHVSYSGAQMAFGGAKNNGVKRVFSEAVVANHNAASGVGVGVREGNDDVSRCEEMNGTEQLDLKVHLPKGMGMARMAPASGSPSFDNMQGPLNPFFRKSLVSKMPVPDGGDSSANASNDCANRKGMVASPSVQPPPAQNQTVGWPPVKNFNKMNTPAPPASTPARACPSVQRKGASTSSSGNLVKIYMDGVPFGRKVDLKTNDSYDKLYSMLEDMFQQYISGQYCGGRSSSSGESHWVASSRKLNFLEGSEYVLIYEDHEGDSMLVGDVPWELFVNAVKRLRIMKGSEQVNLAPKNADPTKVQVAVG

SEQ ID NO: 3339 - protein, 382 aa, Secale cereale x Triticum aestivum
MTVDRKDAETAAAAAPFEIPALQPGRTCGAEESTRSHVLVKPIGSSNLPCNEYALLARQNPKGDAQPVASILRKKRPRRSRDGPNSVSETIRRWKEVNQQLEHDPQGSKRSRKPPAKGSKKGCMQGKGGPENTQCGFRGVRQRTWGKWVAEIREPNRVSRLWLGTFPTAEDAARAYDEAARAMYGALARANFPVHPAQAPAVAVAAAIEGVVRGASASCESTTTSTNHSDVASSLPRQAQALEIYSQPDVLESTESVEHYSHQDSVPDAGSSIARSISEEDVFEPLEPISSLSDGESDGFDIEELLRLMEADPIEVEPVTGGSWNGVEIGQQEPLYLDGLDQGMLEGMLQSDYPYPMWISEDRAMYNPAFHDAEMSEFFEGL

SEQ ID NO: 3340 - protein, 396 aa, Oryza sativa Japonica Group
MVGGGRERNGGVRQYNRSKVPRLRWTPDLHHCFVHAIHKLGGQDKATPKRVLQLMGVGGLTISHVKSHLQMYRNMRNDLGMQGIQVQQVDQEHTYGGGVEVWTDMQQCDHDECDVPCCSCHSPKPRKEPLLHLQLKSSGMNIDEPGTRARIAAPNVRSCRDDAAASATETRRRRGGRPEEVDDDANASTSPRISQLQLLRLRGHGIRESDMSPSTSLQCYYVRSQRTTTMPPGAAAAAAGGDGGSQCYAAPRYSSSSKLKFLGFVVTSGPPPPRLPPPAACCCGSDDNIPFQVGTFAPHRVAPPTASCGGGGGGGRAEARPSSSYRSVWFEPAAAAAASNNGVAPDGEHDDGCSLSLSLALDTGCAGAGGSLVSSTTSSSSGSRISLDLSLSTLDS

SEQ ID NO: 3341 - protein, 503 aa, Physcomitrella patens
MKFSNEVVHKSMNITEDCSALTGALLKYSTDKSNMNFETLYRDAAVESPQHEVSNESGSTLKEHDYFGLSEVSSSNSSSGKQPEKCCREELNLNESATTLQLGPPAAVKPSGHADGADAHDEGAGPENPAKRPAHHMQQESLADGRKAAAEMGSFKIQRKNILEEFRAMKAQAHMTKSPKPVHTMQHNMHASFSGAQMAFGGAKNNGVKRVFSEAVGGNHIAASGVGVGVREGNDDVSRCEEMNGTEQLDLKVHLPKGMGMARMAPVSGGQNGSAWRNLSFDNMQGPLNPFFRKSLVSKMPVPDGGDSSANASNDCANRKGMVASPSVQPPPAQNQTVGWPPVKNFNKMNTPAPPASTPARACPSVQRKGASTSSSGNLVKIYMDGVPFGRKVDLKTNDSYDKLYSMLEDMFQQYISGQYCGGRSSSSGESHWVASSRKLNFLEGSEYVLIYEDHEGDSMLVGDVPWELFVNAVKRLRIMKGSEQVNLAPKNADPTKVQVAVG

SEQ ID NO: 3342 - protein, 226 aa, Zea mays
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQQMPQVLTAGTMVVAAAAENILTEDGQSSESVMTALHSGSSLDCDDGSDISLKLSLP

SEQ ID NO: 3343 - protein, 212 aa, Elaeis oleifera
MESFSSDSMDSPLASRWASDGEAYATVSSAPPKRRAGRTKFRETRHPVYKGVRRRNADKWVCEVREPNKKSRIWLGTFPTAEMAARAHDVAAMALRGRSACLNFADSPWLCPVPRSSNPKDIQRAAMEAAEAFRPQTEPNADKSREDAAMSMAGGPSLATADDPFYMEDGLNFGMQGYYLDMAAGLLMEPPPILYADEEVSDGDVSLWSYSI

SEQ ID NO: 3344 - protein, 260 aa, Glycine max
MHPINTGDDSTLSSPIPQYGQISNSCLIETQDPSLQPLNQGGNGRKRHYRGVRQRPWGKWAAEIRDPKKAARVWLGTFDTAEAAAAAYDAAALKFKGSKAKLNFPEHVLLPPPPISSSSPPCNNNNNHHSYYYGSSALAPLAPPPQHVYDQTPPPQQQPLLSSSAQEEGFPNLMQYAQLLWSRDDDDLQRIASGLHQHHHHNEAFYDSSSSTLFSSTSTTYSMTVSDQQQNIGDDTSTPKGAEYNYGGCFFRGSDFHDKN

SEQ ID NO: 3345 - protein, 209 aa, Elaeis guineensis
MESFSSDSLDSPVARQSASDEETYATVWSVPPKRRAGRTKFRETRHPVYKGVRRRNADKWVCEVREPNKKSRIWLGTFPTAEMAARAHDVAAMALRGRSACLNFADSAWLCPVPSSSNPKDIQKAAVLAAEAFRPRTESDATESREDAAMAMSAGPSVAADDPFFTEDRLDFGMQGYLDMAEGLLIDPPPMNADEEESDGGVSLWSYSI

SEQ ID NO: 3346 - protein, 309 aa, Vitis vinifera
  misc_feature (148)..(148): Xaa can be any naturally occurring amino acid
  misc_feature (162)..(162): Xaa can be any naturally occurring amino acid
  misc_feature (186)..(186): Xaa can be any naturally occurring amino acid
MMQIRRIKGPWSPEEDEALQRLVQKHGPRNWSLISKSIPGRSGKSCRLRWCNQLSPQVEHRAFTPEEDATIIRAHARFGNKWATIARLLVGRTDNAIKNHWNSTLKRKCSSITEDMIADGHAQPPLKRSASVGAGTTVSGHNLSPSSXSGSEFSDSSAPGMXSSLVYRPVPRTGPIVLPTQKIEAXSSTNDPPTSLSLSLPGSDSCEVSNHLSGSDHVKIQNQILQSPAIPPVQLQQNPGSPRNIQNCELGLGMSEKPFFTPEFLAVMQEMIRKEVRNYMSGMEQNGLCLQTEAIWNAVMKRIGIGKIE

SEQ ID NO: 3347 - protein, 178 aa, Canavalia gladiata
MATEEVNKPPSLPPYTEMITKALDSLNEPNGSNKSAISKYIESTCGELPDGHSTLLAHHLNKMKESGELVFLKNNYMKPDPTSPPKRGRGRPPKPKVPLPPGTVLSPPRPRGRPPKDPNAPTKSPKAKVSTGSGRPRGRPKKIARSAAVVAPTPGPSGRPRGRPPKVKPQLTEVSVES

SEQ ID NO: 3348 - protein, 344 aa, Cicer arietinum
GFREFKDDSDFDEDEEDDDDDEGLLVGGKGFTFSSNNTKSFKTFSRGSTAAKSVSPKSNEQAEKACKRKRKNQYRGIRQRPWGKWAAEIRDPRKGVRVWLGTFNTAEEAARAYDAEARRIRGKKAKVNFPEEAPVTSSKRFKPNLENKLVNKNLNSFNPNGNKMFNFGENVENYYSPMDQVEQKPLVNNNNQYANMGPFSGNGVQHSQISPSADVTAYFSSEHSSNSFDYSDLGWGEQGPKTPEISSMLSAAAPLESESQYVQNNMQSNNNQNMLPVEDNSAKTLSEELADIESQLKFFETPYDDNWGDASLASFLGGDATQDGGNPMNLWSFDDLPSISGGVF

SEQ ID NO: 3349 - protein, 278 aa, Nicotiana tabacum
MVRAPCCEKMGLKKGPWIPEEDQILISFIQTNGHGNWRALPKQAGLLRCGKSCRLRWTNYLRPDIKRGNFTKEEEETIIQLHEMLGNRWSAIAAKLPGRTDNEIKNVWHTHLKKKLKDYKPPQNSKRHSKSKNHDSKGPTTSESSNNSDLTIINTQKHIDSPVLAPNSPQISSSTEMSTVTLVDDHQMVVIKQEVMESSEYFPEIDESFWTDELTTDNNWSSTDHVMVAANQELQVQLPFSSFKEENVDILATKMEDDMDFWYNVFIKTDDLPELPEF

SEQ ID NO: 3350 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRDSSNGDASSVKSIEIPPPRPKRKPMHPYPRKMATPLKGGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECTRSTFSIVPPAPSYYFTTPNGSPGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3351 - protein, 238 aa, Oryza sativa Japonica Group
MSISVNGQSCVPPGFRFHPTEEELLNYYLRKKVASEQIDLDVIRDVDLNKLEPWDIQERCKIGSGPQNDWYFFSHKDKKYPTGTRTNRATAAGFWKATGRDKAIYNAVHRIGMRKTLVFYKGRAPHGQKSDWIMHEYRLDDPATDTAAATPTVTSAAAAAAAMAAAADGGQEDGWVVCRVFKKKHHHKEAGGGGGKHGGDGSAGAKAAHAYSSSDDALDQILQYMGRTEKYILASHYL

SEQ ID NO: 3352 - protein, 159 aa, Oryza sativa
MGRAPCCEKMGLKKGPWTPEEDKVLVAHIQRHGHGNWRALPKQAGLLRCGKSCRLRWINYLRPDIKRGNFSKEEEDTIIHLHELLGNRWSAIAARLPGRTDNEIKNVWHTHLKKRLDAPAQGGHVAASGGKKHKKPKTRRSQPPPPPGRGVAERSARRR

SEQ ID NO: 3353 - protein, 443 aa, Solanum peruvianum
RMSVDVGAPSPRSIQMDEQVNPGEEYAPKIRKPYTISKQRERWSEEEHKKFLEALKLHGRAWRRIEEHVATKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPQSTFSIVPPTPSYYFPTPNGSPGPNQSGVATHLPRGSSCAVPCTQVHSPIPMKGRPLFNDRDLEGKGTQKEGSSTGSNAESVDAEYLEIEAQSSRNVVEESVRVRASVPSLFERRANSTKRVKGFVPYKRCLAERGMSSSTLTGEEREEQRTRLCL

SEQ ID NO: 3354 - protein, 382 aa, Triticum aestivum
  misc_feature (291)..(291): Xaa can be any naturally occurring amino acid
  misc_feature (351)..(351): Xaa can be any naturally occurring amino acid
AYLGDTIEQVCTKKQAGTGPEFPGFRRPTVSVVHLAGHHHQWTLPFAGAGQAATASRKHPAERKRRGGGGFMDSGSRSSGGAGFDDDDGLAARREVSSSLQELAVRVDAKGGSCSGSGTDQLPNTPKSKHSATEQRRRSKINDRFQILRDLLPHTDQKRDKATFLLEVIEYIRFLQEKAQKYEASFPEWNQENAKLLPWSNMYFRSSWKNAQSKGQIAEDASPDPSQFIRNGASPGFNITGKLDDNHTAVASAAISGAPDQAETDHMASVSCRSADTPTNIMNNVSPQSQXQWADPSGVDDCAVNSGVFNNPQLMIDEGTISVSSHYSQSYLIRDSCLQSSGIDLSQATLXVQINLGKRAVKRLRLNNPQFQEPTGLGRRNN

SEQ ID NO: 3355 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRDSSNGDASSVKSIEIPPPRPKRKPMHPYPRKMATPLKGGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKESSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3356 - protein, 340 aa, Vitis vinifera
MATAVEVSALQLIRQHLLGELSPKNIVVTDLTVGEEWSNGLNSEVSTSQSDSFCSQAASCDSPVTISELFGSTDLSADFFGFVPSSTSEQSQSNFFEFETKPQIIDLTSPKGLNSSHFFEFETKPQIKDTTKTKSLDSSSQSTGKDRKPSLKISVPRPTKEIEWLEFAEPKQAATVEPAQNISHPEEKKHYRGVRQRPWGKFAAEIRDPKRRGSRVWLGTYETAIEAAKAYDRAAFQMRGSKAILNFPLEAGKSAETSADYGRKRCREAETEETEVEANPPAKKEKLPEADTITHVQNDTPLTPSFWDFDLDSVGCLFNVPPMSPLSPHPKFGFPQLMVI

SEQ ID NO: 3357 - protein, 171 aa, Triticum aestivum
IMATNCEHCGYKSNEVKAGGSISDKGRRITLNMTEAEDLSRDILKSETCGLSIPEIDLELTQGTLGGRFTTVEGLLRQVHDELQGRAPFIQGDSGTDESKQKWANFLDSVNKVADGKMFPVTLIINDPLANSYLQNLYAPDDDPEMTIEDYERDWETNEELGLNDMKVDNY

SEQ ID NO: 3358 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENCGDLVLSEPFDFAVEESRSSPARAYATPNPANQACVKLELFPEDNDFVKEGSDEASSTQCLKLFGKTVLVTDAHMPPTDETLTRSSFPAKYLPWDSECPRSTFSIVPPTPSYYFPSPNGSPGPNQSGAATHLPWGSSCAVPCTQVHSPIPMKGRPLFNDRDLEGKETQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 3359 - protein, 826 aa, Arabidopsis thaliana
MDGREAMAFPGSHSQYYLQRGAFTNLAPSQVASGLHAPPPHTGLRPMSNPNIHHPQANNPGPPFSDFGHTIHMGVVSSASDADVQPPPPPPPPEEPMVKRKRGRPRKYGEPMVSNKSRDSSPMSDPNEPKRARGRPPGTGRKQRLANLGEWMNTSAGLAFAPHVISIGAGEDIAAKVLSFSQQRPRALCIMSGTGTISSVTLCKPGSTDRHLTYEGPFEIISFGGSYLVNEEGGSRSRTGGLSVSLSRPDGSIIAGGVDMLIAANLVQVVACSFVYGARAKTHNNNNKTIRQEKEPNEEDNNSEMETTPGSAAEPAASAAENNPTLITGYIKAAIVVLFTLWVIRVYDFWVGFKCMDGREAMAFPGSHSQFYLQRGVFTNLTPSQVASGLHAPPPPPGMRPMSNPNIHHPQASNPGPPFSMAEHRHSDFGHSIHMGMASPAAVQPTLQLPPPPSEQPMVKKKRGRPRKYVPDGQVSLGLSPMPCVSKKSKDSSSMSDPNAPKRARGRPPGTGRKQRLANLGEISSEWMNTSAGLAFAPHVISVGSGEDIVSKVLSFSQKRPRALCIMSGTGTVSSVTLREPASTTPSLTFEGRFEILSLGGSYLVNEEGGSKSRTGGLSVSLSGPEGHVIGGGIGMLIAASLVQVVACSFVYGASAKSNNNNNKTIKQEIKPKQEPTNSEMETTPGSAPEAAASTGQHTPQNFPAQGMSGWPVSGSGSGRSLDSSRNPLTDIDLTRGSSSIHYVSAVHIFVVVDFSLGMLKPDISGLRPELSVPYCNILNVTEPPHFQATQRDCNSFISLIKASFGFFNICVQFGFGFECLVLEMK

SEQ ID NO: 3360 - protein, 261 aa, Triticum aestivum
MTATSRPQHPNGSLAPASDGGESFAKFFECWILEQSRDLAALRAAATARPDDADLRRLVDRVLGHYEHYYRAKSAAASADVLPMFAPSWISATESLYLWCGGWRPTSAIQLLYSKSGLQLEAQLPAFLDGGSLRGTATLGGLSAEQLQAADQLQRRTVRREREIEEAAAGAQESLATTKMVELAGKGGMDAAEGMELEMDAKAEAMKRVLEMADGLRLETLRGVVGLLRPAQAVHFLVAAAELHLAVHKFGRRKDGAAAAE

SEQ ID NO: 3361 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEGNDFVKEGSDEASSTQCLKLFGKTVLVTDAHMPPTDETLTRSSFPAKYLPWDSECPQSTFSIVPPTRSYYFPSPNGSPGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3362 - protein, 366 aa, Oryza sativa Japonica Group
MESCVPPGFRFHPTDEELVGYYLRKKVASQKIDLDVIRDIDLYRIEPWDLQEHCGIGYDEQSEWYFFSYKDRKYPTGTRTNRATMAGFWKATGRDKAVHDKSRLIGMRKTLVFYKGRAPNGQKTDWIMHEYRLETDENAPPQEEGWVVCRAFKKRTAYPARSMVETWDYSLHERNIMSAAAAAAFADPSAAYAQMRRQHRSGRFKQEAELDGAATALLHYSSHLAELPQLESPSAAAAPLQPNPSQLATAGEDDDCKGDNGGRRAKKARAAGDKVATTTDWRALDKFVASQLSPGECGSMEATAEAAAAAVAGVSSPLDHGDDDMAALLFLNSDERDEVDRWTGLLGSGAGASGVDGDLGICVFDK

SEQ ID NO: 3363 - protein, 386 aa, Oryza sativa
  misc_feature (367)..(367): Xaa can be any naturally occurring amino acid
MMMSSSADHFSNNNNNQAMYLEQDEDFSQMIMELCDFDASSTTQARHGGEAAAAAAGNARAVLTYLTFLEQKIGHLRGIISSTPNPPPQIVAAELSCIVVQLVSISKNLAAARRGGDDADADAKHDGSSDADEGADGDGERAPPRGSYEVVQIEKEEILAPHVHFCGVCGKGFKRDANLRMHMRGHGEEYKSAAALAKPGGSPSRSPAAADAAARRRFYSCPYVGCKRNREHKSFQPLKTPTCVKNHYRRSHCDKSFTCRRCNVKRFSVVADLRTHEKHCGRDRWVCSCGTSFSRKDKLFAHVAIFDGHSPALPPEDYDDDAASGQLPHAAGEAVGRTVDTNRFFSDGLMIKGSMEDERGSLSPMGXLDYCEFDGIDLFAAAAFDF

SEQ ID NO: 3364 - protein, 402 aa, Zea mays
MPCLEARKPYTITKRRERWTEEEHGRFLEALQLHGRAWRRIQEHIGTKTAVQIRSHAQKFFTKVVRESSPGSNASAGAAPAIQIPPPRPKRKPAHPYPRKADGAAKKPAPELKRLEKTSLRDRVRDEGSPTSVLASARTALRAEVSGSVVANSSSASRSPALSDAGSNERGDGGGSLASSVDREDGCASPRTRAPCTKVLCDAHEVSRLGSGAPVVKLFGNKVVVVKVKDLETDTPPASVAEAARNGSPTNGPAGASSWKPWPELTCLVPRRDGFAAQPIVSPPCAVFYYPQASAQEHQQASEPLDHRRAQREGSSPTGSSVASSAAAESRHGPGQENASDGYAALRAAIPRPTKRASSASFGGRGFVPYKRCAAESEAARPVALALAPGEEADGDLTRLCL

SEQ ID NO: 3365 - protein, 491 aa, Physcomitrella patens subsp. patens
MKFSGEGSSVLTGAQLKYSSDKPNMNFETVCKDAHAESSQHEESSESGTTLKEHDYFGLSEVSSSNSSGDKQPEKGCSREELNLNESATALQLGPPAGLKPTGQSDVVLAEEEAAGPENPAKRPAYHLQQNSTVDVKKPVAEAVSTKNQRKIIEEFRAKKAAQDAKAMQSMQHNVRASYPGAQSVFPGAKNNGVKRGFSEAVGTNFNASSGAGGAVREGNCDMNRGEGVGGTEQPESKVNLHQSMGMSRMAPGSGGQNGSAWRNINLEKMQGPLSTIFRKSLMSKITLQDAGDSSIKCSSDVINRNKAIAPASNEQPLAQNQTVGWPPVKNFNKNNTPAPPPSAPATACRSVPMPRRGASSSSSGNLVKIYMDGVPFGRKVDLKTNNSYEKLYYTLEDMFQHYINVHGCGGRSSSCGDSHSLASSRKLNFLEGSEYVLIYEDHEGDSMLVGDVPWDWFIDAVKRLRIMKGSEQVNLAPKNPDSMKAQGAVG

SEQ ID NO: 3366 - protein, 243 aa, Physcomitrella patens subsp. patens
SIPEVFHIDDLLDFSCDDIGGPILGGHLPLSGVTTESSMIGGETSISSSPIEAKNETLEPALEDIEVKTDLCVPCDDLADLEWLSSFVEDSFTKLSPTSVLETSATSSELTSPDYRDVCVPGRARSKRSRTGAKIWTSRILSTSSSVNSLESMGADSKGRKKNQDNSQPWRCMHCQTQRTPQWRTGPMGPKTLCNACGVRYKSGRLLPEYRPAGSPTYVASKHSHSHKKVLEMRRERELRIQQ

SEQ ID NO: 3367 - protein, 559 aa, Candida albicans
MSSLQQPIPPNSTLATTASSNQSGSNDFVKKLFLMLQEDSYKEVVRWTAKGDSFVVINTNEFTKDILPKHFKHSNFASFVRQLNKYDFHKVKISNKAKASYPYGEDAWEFKHPEFRINDAEALENIKRKGPTAKKSASNVTIKTEANNNGTQPTCNHNYSQLVSATNHLKEQVESLKKDKHSLYQEISVLERKYKTVVENIVAINTFNERYYRSMNVLINSIVQNGMKLPPLDFPPPVQLGPDSGIGSNLGPISSDTALPSISHHLSSPLPHHQQLLNRTIRPISSPIDGIPLVKLQQQSLGQNLQAPIGTPSAVPFSEEASSSIQAATPAPLAQPVAQPINQPPPPPPPPATQQQPLPPPPPPATATSQIPSAPPPPTQQQVGTSSSSVPTISPKSQGIVVSNSASPTTSAQISTTSVPNPKFHVLLVEDDNVCIQLCRKFLVKYGCSVTVVTDGLNAISTVEHTKYDLVLMDIVMPNLDGATATSVIRSFDTKTPIIAMTGNIEDNDLVTYLQNGMSDILAKPFTKDDLYAILSKHLLDPKENKQDNEPTVKKQKLS

SEQ ID NO: 3368 - protein, 101 aa, Lonicera reticulata
TAQGLRDRRMRLSLQIARKFFDLQDMLGFDKASKTIEWLFSKSKKAIKEVTLNHPKMKNTREKKESIVSECEVESAIENVNGERTERGKAQKVACGHLARE

SEQ ID NO: 3369 - protein, 723 aa, Phaseolus vulgaris
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPSNPYPRKTTIGTATLHSGAKDGNLVESSHNNQALDLEKEPLPEKYDLDEGLTTVKENKDENCSKVFKVIQEVPCSSISSANRSSISMSVPLGNSCVLKEITSSVKEVITRDENTESFLTVELGNRNLEINDGKQANGTSKNSTLENSDALQTKLVQNEKTDGLDSALTIDGMQGNQNYPRHVTVHVVDGKLGTSTQNPSQDMLFRDSMFQPIGGDNGQPNLFTNSAPTNTSESQNNTARSSVHQSFLPYPPFTQHNQDDYQSFLHMSSTFSNLVVSTLLQNPAAHVAASFAATFWPYANPETSADSPRCSQGGFTSRQIGSPPSVAAIAAATVAAATAWWAAHGLLPLCLPLHAAFACPPASVTAVPSMNPPVQDQKHPEYSEAPQAQHSDSKSLAVISSDSETGNAKLNTSPKATDHVTNETISEHLDSDKTKGRKQVDRSSCGSNTASSSDVETDALGKDEKGKEEPETPDANNLAIEFSNRRRSIYNLTDSWKEVSSEGRLAFQALFSREVLPQSFSPPHALKNKDQMDITNDYKQNIADRNEDLDSKKCSSNALHKIPSFVENNVGLLTIGLGQGKLKTRRTGFKPYKRCSVEARENRVGANCEEKGCKRIRLEGDTST

SEQ ID NO: 3370 - protein, 324 aa, Chlamydomonas reinhardtii
MAGVASREQLGPAAAAAVATAAATAAAAAGPSSAAPGSPPHAGGGGVSSSGGGGGGGGAAVSVVRSLTLDALRPHFDRTIREASRALRVCATELKRRCRTLGFSRWPHRKLDSLRRMAEELESDPGFNAAEKQEMLRVVTENRRAIIQHPDAPLDEATRRIRQLQLRNIKAMTARERRNQQQQQQQHQHQQPSSLASSAAAGTAAGAGVGSLRAGGGGGGGGGGGGATSSSGTSATAAAGGRDGGGGGGGGGVTSRGRGGGGGGGSGGGGGRRGSSSRGSGRRRRAVAAAAAVASDTEDDESGVGVEEDDIDIGEGQGEGGNEE

SEQ ID NO: 3371 - protein, 285 aa, Hordeum vulgare
APEYYFPTLVSSAEENMASFAATQLGLNLGYRTYFPPRGGYTYGHHPPRCQAEGCKADLSGAKRYHRRHKVCEHHSKAPVVVTAGGLHQRFCQQCSRFHLLDEFDDAKKSCRKRLADHNRRRRKSKPSDADAADKRRTQASKAAASTKGKAAGSSSKSTGTGDGMDIQVQLGSGDLSKDQDETMGQGEVVKEMQVDPKGKASMQLQQQQQQGHHVHGLHLQSQHGFPFPSTSAGSCFPQSQAVSSTDNTSNIGQVQQEQLGSLGFHQHSNILQLGQAMFDLDFDH

SEQ ID NO: 3372 - protein, 84 aa, Lonicera reticulata
TSQGLRARRMRLPLQIARRFFDLQDLLGFDKASKTIEWLFAKSKKAIKELTKNIPNMNEKGKCQTFSDSFEGEKNKRELGKARE

SEQ ID NO: 3373 - protein, 449 aa, Arabidopsis thaliana
  misc_feature (284)..(284): Xaa can be any naturally occurring amino acid
MPTLYKKAGCLGIREFMWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAINFRGVEADINFNIDDYDDDLKQMTNLTKEEFVHVLRRQSTGFPRGSSKYRGVTLHKCGRWEARMGQFLGKKYVYLGLFDTEVEAARAYDKAAXIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHRNQIFNSTSTPHQNWLQTNGFQPPLMRPS

SEQ ID NO: 3374 - protein, 86 aa, Morina longifolia
TAQGVRARRMRLPLKIARKFFDLQDMLGFEKASKTIEWLLAKSKGAIKELTKTIPVITNIGDQGISEYSSEGERNKRELGTKAARE

SEQ ID NO: 3375 - protein, 212 aa, Dypsis lutescens
MESFSSDSMDSPFAQRSASDEEAYATVSSAPPKRRAGRTKFRETRHPVYKGVRRRNADKWVCEVREPNKKSRIWLGTFPTAEMAARAHDVAAMALRGRSACLNFADSAWLCSVPRSTSPKDIQRAAMEAAEAFRPRTEPDAAKSTREDAGTSMAAGPSLASADDPFYMEDGLNFGMQGYLDMAEGLLMEPPPILYPDEEVSGGDVSLWSYSI

SEQ ID NO: 3376 - protein, 211 aa, Cocos nucifera
MESFSSDSMDTPLAQRSASDEEAYATVSSAPPKRRAGRTKFRETRHPVYKGVRRRNADKWVCEVREPNKKSRIWLGTFPTAEMAARAHDVAAIALRGRSACLNFADSAWLCPVPRSSNSKDIQRAAVEAAEAFRPQTERVDAAESREDAAMAMIAGPSLAAADDPFYMEDGLNSGMQGYLDMASGMLMEPPPIYADEEVSDGDVSLWSYSI

SEQ ID NO: 3377 - protein, 199 aa, Oryza sativa Japonica Group
TEEQIRSLESMFHAHHAKLEPREKAELARELGLQPRQVAIWFQNKRARWRSKQLEHDYAALRSKYDALHSRVESLKQEKLALTVQLHELRERLREREERSGNGGAATTAASSSSCNGSGSEEVDDDDDKRNAAAGCLDLEPPESCVLGGATCATPADVSVESDQCDDQLDYDEGLFPESFCATPELWEPWPLVEWNAVA

SEQ ID NO: 3378 - protein, 175 aa, Glycine max
KKKMIHKEIERQRRQEMATFYASLRSLLPLEFIKGKRSISDHMNEAVNYIKHMQKHIKELGAKRDELKKLSNHSNNMENNHEGLHTSCNFTVHEKNGIMGIEITSVFREEKPKISKLLQFLTEEGLEVVSFFSTEVNGRLLHSVQCEFQQWTTIVAAEITATVKLAVADFRSPDC

SEQ ID NO: 3379 - protein, 280 aa, Oryza sativa Indica Group
MYSSPTKAPFCEKEGLRRGAWSPEEDDRLVAYIRRHGHPNWRALPKQAGLLRCGKSCRLRWINYLRPDIKRGNFTADEEDLIVRLHNSLGNRWSAIAAQMPGRTDNEIKNVWHTHLKKRLDDERKLAAAGGGGGRRPQTRKQPKAAKSAAAVKREATPSVSVDTSSGVTCSTVTESSPSSADGDHRRQQQQTQHAAVKEESFSSGGELPAAAAAPTAAADMDESFWSSTEVTGMMAGLGDMDEELAIAGTSSAAAARSDDMEFWLKMLLESGDMRDLAVL

SEQ ID NO: 3380 - protein, 1789 aa, Aspergillus nidulans FGSC A4
MPTSDKSRQTSAGKSFFGRKLHKERPVEDRWDAHGSWESLAPPSSAAGSRSSRYSKRSSIQSVDFGADIDPSLLSTSAGPITSIPFESLSTDTQSPIPVDYLSKAETSPRKEPSPGHLAKGVGDFHQYPAWDPSAMRNHQQFSHPTGPRPPPHAAGVAMSSSATGDKGARYQQWGRPGSSAGNAGLSHHSSSTVDSSTNSRMSIDQASIHSSLSSNTRGSSYISTDGSSRTTLPSHSNDRSNYYAAMNSGRGSSAQGAIPPAQPRVQNTEQYLTRPRDDRVVDQLFLELMQKRGWQNLPEQARRQMMAYPASKKWTLVHQDRLTELQGEQKRKQKARETHGYDGPSGILERADEEGSPEWYVKKVMDDTITSKQLASLSVSLRTQPISWVKAFVEAQGQIALTNVLVKINRKKVTGPVPAPPSGDKDLDREYDIVKCLKALMNNKYGADDALAHQQIIVALISSLLSPRLNTRKLVSEVLTFLCHWAEGQGHERVLQAMDHVKNHQGETGRFDAWMRIVEVTIDGRGKMGSLVGASEEYRSGGIGMENLLMEYAVSTMILINMLVDAPENDLQLRCHIRAQFISCGIKRLLSKMEGFQYEVIDKQIEHFRENEAIDYEDLLQRESSSTKDSIEGEVKDMTDPLQITDAIASRLNGTRAHDYFLSALQHLLLIRENSGEDGLRMYQLVDAMLSYVAMDRRLPDLDLRQGLTFTQSLLDRLHTDAEARRAYDESLEARQIAEAALAERDEMKAQVELGADGLVRKLQKQIEEQTGIIELQSRQNEMLKAELADVQRLRAQELQRNELETRELYLMLRDAQDIAASNAKKSNMGEAETDPAHMRGILDREKLLTRLEKQLERTKTQFKLEGKVWGQHDPSDRLRELREQMDGDAGPREAFEEQARLNLSLNPVGSVYRKKTYIQGMEDTATEELGQTDDEVVYAKARLVDLHRPRMDPEQATGLLGEIAAKVPKIDADDAKDEGKPTESEQPAEGAATKGDEQGVDDTVAVDKATAAPPPPPPPPPAHPGLSGAAPPPPPPPPPPPPGAGAAPPPPPPPPPPPPGGLGGPPPPPPPPPPGGFGGPPPPPPPPGGFGGPPPPPPPPPGGAFGVPPPPPPPGTVIGGWRANYLASQGAPSHAIPVMSSIRPKKKLKALHWDKVDTPQVTVWATHGTTPQEKEEKYVELAKRGVLDEVERLFMAKETRIFGGGVAAKQRKDKKQIISNDLSKNFQIALSKFSQFPAEEVVRRIIHCDAEILDNMVVMEFLQRDEMCTVPENVSKLMAPYSKDWTGPDAANTEREQDPSELTREDQIYLYTAFELNHYWKARMRALALTRSFEPDYEHISAKLREVVRVSESLRDSVSLMNVLGLILDIGNFMNDANKQAQGFKLSSLARLGMVKDDKNETTFADLVERIVRNQYPEWEDFTEQISGVIGLQKLNVDQLRTDAKKYIDNIKNVQASLDAGNLSDPKKFHPQDRVSQITQRSMKDARRKAEQMQLYLEEMVKTYDDIMVFYGEDNTDDGARRDFFAKLAAFLQEWKKSKEKNIALEEARRRTEASLARKRINVGLANGAGAAGDAPVSPATSGAMDSLLEKLRAAAPQAKDQRDRRRRARLKERHQVRVASGQKIPDLEGAEAPGSGGQNSGATDTNATDSSLLSPTIQEPEGGSSPIASQSEDVADRAASMLQDMLRNSPDPERTRRRRESAEEERRKRRLRRRNGATSGSKDSNDTTPLSPVTEPTSTQGESAEPENLSLSSPPNGEDPTLNPPTIVLSSDASDTPDDEHRPSTS

SEQ ID NO: 3381 - protein, 211 aa, Rhapidophyllum hystrix
MENFSDYSMDSPLAQRSASDEEAYATVSSAPPKRRAGRTKFRETRHPVYKGVRRRNADKWVCEVREPNKKSRIWLGTFPTAEMAARAHDVAAMALRGRSACLNFADSAWLCPVPGSSNPKDIQRAAVDAAEAFRPQTERVDAAESREDAAMAMIARPSLAAADGPFYMEDGLNFGMQGYLDMAAGMLMEPPPIYADEEVSDGDVSLWSYSI

SEQ ID NO: 3382 - protein, 242 aa, Castanea mollissima
MVYPNQSMSLSPQRKIGRGKMEMKRIENTTNRQVTFCKRRNGLLKKAYELSVLCDAEVALIVFSTRGRLYEYANNSVKSTIERYKKACADSSNTGSVAEANTQFYQQESAKLRAQIGNLQNSKQANDGESLSNLTVKELKSLEIKLERGISRIRSKKNELLFAEIEYMQKREVELHNNNQLLRAKIAENERNQQNLNVMPAGGGSYELMQTQQYDSRNFFQVNALQPNHQYPREDQMSLQLV

SEQ ID NO: 3383 - protein, 254 aa, Chlamydomonas reinhardtii
MADETVAVEEVAAAEPASGKKAKTPKAKKEAKPKAPKAKAPKKEASHPPYIEMVADAISSLKERTGSSVPAIKKYIESKYGKDIHDKNWAKTLSLAIKTFVKSGKLVKVKNSYKLGEKVKAETKKKAAPKKAAAPKKAEGEKKKAAPKKEKKPKAEKKAEKKPKSAEKKPKSAEKKPKSAEKKPKSAKKEGEKKKATPAKKAAKPKAEKKPKAAKPAKKAEKKPKAEKKPKAEKKATKAAKPAKKAAAPKKAKK

SEQ ID NO: 3384 - protein, 368 aa, Populus trichocarpa
MALMLDNCEGILLSLDSHKSVPAPFLTKTYQLVDDPATDHIVSWGEDDTTFVVWRPPEFARDLLPNYFKHNNFSSFVRQLNTYGFRKIVPDRWEFANEFFKKGEKHLLCEIHRRKTAQPQVAINQHHHHQHHPHSPFGVNGPSFFPFSSRTSISPSDSDEQANNNWCDSPPLTSPPRGVASATVIGGGGGYNSSVFALSEDNERLRRSNNMLMSELAHMKKLYNDIIYFVQNHVKPVAPSNSYSSSLLLCGPAPYATANPVTSNGSLAQKPLNQLLGYYPTTAPNNPKQAPQVHVLNSPTTTSQSSLTFLEEANNNGCKTKLFGVPLHSKKRLHPEYGSNPGNMETNKARMVLDKDDLGLNLMPPSRC

SEQ ID NO: 3385 - protein, 242 aa, Castanea mollissima
MGRGRVQLKRIENKYRQVTYSKRRSGLLKKAHEISVLCDAEVALIVFSTKGKLFEYSSDSSMETILERYERYSFAERQLVATDSESQGGWCMEFPKLTARVEVLQRNIRNFMGEDLDPLSFRELQNLEQQIDAGLKRIRTRKNQLMHESVMELQKKEKSLQEQNSVLAKKLKENEKNIPEQAHQEQPSLGLLSLPQQPMPSTLSLPSLTIGGAFQERAVDEDAGVQTRPTLMPPWMLRHVNG

SEQ ID NO: 3386 - protein, 417 aa, Arabidopsis thaliana
MMKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLLSEQFLNDVVEPKIEFPMIRSGLMIEEEEDNAESCLNGFFPTDMELEEFAADVETLLGRGLDTESYAMEELELSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 3387 - protein, 443 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPRGSSCAVPCTQVHSPIPMKGRPLFYDRDLEGKGTQKEGSSTGSNAESVDAEYLEIEAQSSRNVVEESVRVRASVPSLFERRANSTKRVKGFVPYKRCLAERGMSSSTLTGEEREEQRTRLCL

SEQ ID NO: 3388 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENCGDLVLSEPFDFAVEESRSSPARAYATPNPANQACVKLELFPEDNDFVKEGSDEASSTQCLKLFGKTVLVTDAHMPPTDETLTRSSFPAKYLPWDSECPQSTFSIVPPTRSYYFPSPNGSPGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3389 - protein, 495 aa, Physcomitrella patens subsp. patens
MPGGGVKDAATNSVATAMAIAGRASRACDVCGSQRARWYCNADNAYLCYRCDQNVHSANALALRHERVRLNSQGNISSQSPRKALVVDTSARKHSRNHTAHAAQSPPSRKRSRLSRRPNPHVSSPVDTLFKPHKASHRGSKVKSESSHEVPNFVTVNIQESSFSFTHDSATVMSMAEYCKGRAAAAAAAAMSMSVDVDTYEELSSGDSDQFLVPTGYLDDFESAAVAPVEDGSSPSEDAEDAPGYEENHHDITDAVDLRDGLELEGGSDDAYRLDFSDIVALREGDEDAFEGDYGETEGDAFEGECGDTEGDGEVEAAASNEQSCVDGFPEEQPNCVVPFTKEYLYKVKSENSVRDGFALIKKEVAAVLRCSLEGEEAKPAAPSLLRLNFDDVLSAWSDRSLWTDGKRPQTVPDDSSEAVGGLDLGLVPDLSKGCAQGQPGTGGDRGREARVLRYREKRRTRLFSKKIRYEVRKLNAERRPRMKGRFVKRTTGCS

SEQ ID NO: 3390 - protein, 443 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEGNDFVKEGSDEASSTQCLKLFGKTVLVTDAHMPPTDETLTRSSFPAKYLPWDSECPQSTFSIVPPTRSYYFPSPNGSPGPNQSGAATHLPWGSSCAVPCTQVHSPIPMKGRPLFNDRDLEGKGTQKEGSSTGSNAESVDAEYLEIEAQSSRNVVEESVRVRASVPSLFERRANSTKRVKGFVPYKRCLAERGMSSSTLTGEEREEQRTRLCL

SEQ ID NO: 3391 - protein, 1196 aa, Oryza sativa Japonica Group
MSSQSVVAVKQITAPDKIVETCPSTKHSAHKLFDVKPDFQGLIDDNLSSSSQSSSIKIELIRSSSLPNILPFQKRSSEPEPESPLSHVSHPNVSEPVYSNSSTFCTSLFSSSSMETEPCRQLGTLPFLPHPPKCEQQVSAGHSSSSSLLVPGGDGDIGNAHDEPEQSDDLKDFLNLSGGDASDGSFHGENNAMAFAEQMEFQFLSEQLGIAITDNEESPRLDDIYGTPPQLSSLPVSSCSNQSVQKAGSPVKVQLSSPRSSSGSATTNKARLRWTLELHERFVEAVNKLDGPEKATPKGVLKLMKVEGLTIYHVKSHLQKYRLAKYLPETKEDKKASSEDKKSQSGSSGNDSVKKKNLQVAEALRMQMEVQKQLHEQLEVQRQLQLRIEEHARYLQRILEEQHKVSISSNSLSLKPPAESQPESPKPTSEKKEAESEAGAATSAQPSSEDKSPDAECKSSPPVCTTQDTQRRRLEKEKHGKTVDKETQKVSCNYCGKVVRTYNRLEHHLAGIRGNVYPCSLVPDSVRQSIKSSLEARKKDWIARKIGKHKSSELPPVRNLSLTSAHACRPLLQPITSGTDQEGSVSWHRCFVHFTNNLVQPGETTQVNAHDVSCNASSSQKGGQTIEVTRPPYQNPCMMNKPPEISSGQRIDPLSFSMENSSSQMQDSESSKEPTNDYLNSQARKSIGKLIFEAGLEPGILHLPSFKDMVDVLAWAQVAIPTYESIMEEQLREIQCHARDLKKHWEMNGCSVILDTWESRCGKSFISVLVHCSKGMLFIKSMDVSDIIDDVDELAVMLFRVVEEVGVLNIVQVITNDESPYMQAAEHAVLKRYGYSFFFTLCADHCINLLLENIAALDHVNEVLIKAREITRFIYSHAVPMELKGKYIQGGEILSSSNLKFVAMFITLGKLVSERINLVEMFSSPEWASSDLASRSSFRHVYEVVKTDNAFWSAAADILKLTDPLITVLYKLEADNCPIGILYDAMDCAKEDIKCNLRDKHGDYWPMVDEIWDHYLHTPVHAAGYILNPRIFYTERFSYDTEIKSGTNACVTRLAKNHYDPKKVAIQMDRYRRKSAPFDSDSAIQQTMEIPQVRWWSAHGTDTPELQTFAIRILSQTCFGASIYNIDRSISEQLHVVKRTYPEQERFRTMEYLHYNLRLAHCEPCVRGASGAQQHSRLTSQLGDWISSGQTTSYYK

SEQ ID NO: 3392 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFAKEGSDEASSTQCLKLFGKTVLVTDAHMPPTDETLTRSSFPAKYLPWDSECPRSTFSIVPPTPSYYFPTPNGSPGPNQSGVATHLPRGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3393 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPQSTFSIVPPTPSYYFPTPNGSPGPNQSGAATHLPWGSSCAVPCTQVHSPIPMKGRPLFNDRDLEGKETQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 3394 - protein, 330 aa, Arabidopsis thaliana
MADTSSRTDVSTDGDTDHRDLGSDRGHMHAAASDSSDRSKDKLDQKTLRRLAQNREAARKSRLRKKAYVQQLENSRLKLTQLEQELQRARQQGVFISSSGDQAHSTGGNGALAFDAEHSRWLEEKNRQMNELRSALNAHAGDTELRIIVDGVMAHYEELFRIKSNAAKNDVFHLLSGMWKTPAERCFLWLGGFRSSELLKLLANQLEPMTERQVMGINSLQQTSQQAEDALSQGMESLQQSLADTLSSGTLGSSSSDNVASYMGQMAMAMGQLGTLEGFIRQADNLRLQTLQQMLRVLTTRQSARALLAIHDYSSRLRALSSLWLARPRE

SEQ ID NO: 3395 - protein, 86 aa, Morina longifolia
TAQGVRARRMRLPLKIARKFFHLQDMLGFDKASKTIEWMLAKSKGAIKELTEKPIPITTNIGDQCISEYSSEGERNKRELGKAARE

SEQ ID NO: 3396 - protein, 333 aa, Arabidopsis thaliana
MSPEEELQSNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLGKVYSSLCS

SEQ ID NO: 3397 - protein, 251 aa, Solanum demissum
MTTSSSDAPCVDHNQKSKNEDKKQQQPQAKKPTTTKDRHTKVDGRGRRIRMPATCAARVFQLTRELGHKSDGETIEWLLQQAEPAVIAATGTGTIPANFSSLNISLRSSRHHSSATNYLAHNNNFGHVYPDRNYFNGVGLFSSENNSFFPSGNLNMLQAKEELCDDDDNDNDNNNNNTGRIKRSKSSSWANSSNNIHQPILGTRGGGGGGTAAEGQWGMLTAAMNSYRQSGGHASGSSNQLNGGDDHQHHS

SEQ ID NO: 3398 - protein, 201 aa, Populus tomentosa
MEFERDLNLEATELRLGLPGTATQQLEKQTPSSNVTKSNKRSLPDMNEDSAGRSESSSVSSNDKKSDEQETAPPTETRVVGWPPIRSYRKNCLQAKKLEAEAAGLYVKVSMDGAPYLRKIDLKVYKGYPELLEVVEEMFKFKVGEPSEREGYNGSEYVPTYEDKDGDWMLVGDVPWEMFINSCKRLRIMKESEARGLGCAV

SEQ ID NO: 3399 - protein, 879 aa, Zea mays
MPSDKAKAPKKKGEEDPGIPPAPCEGEISHEPHRQRSLNGRTTGPTRRSTKGNWTPEEDAILSRAVQTYQGKNWKKIAESFPDRTDVQCLHRWQKVLNPELVKGPWSKEEDEIIVQMVNKYGPKKWSAIAQALPGRIGKQCRERWHNHLNPAINKEAWTQEEEITLIHAHRMYGNKWAELTKFLPGRTDNAIKNHWNSSVKKKVDSYISSGLLSQVPCLSLIECPAQCDSLSAMDQQNNGGTDCNDQNTSVVLSSDLQVNVDANKKEAHDSHSSLCQGVCYPSTETVGSVLPDDLEMDMDEGSGNSIFADDQTLCSTSNQEQSMVPFVVAQEMPVSVLSSVSSAEQKRHLISDAKSLKSELWKDVCLQTLITGDTDDPDASSRLNNPDSSKMDTNFLKEAYPLHTPNPSSVIETVYEPMALVTISPPFICSDGLSFAPENRSKPGEMSDCEAEMVTCSNNFFGNAEQSAKLASSDDRPEAFTMTESTTNCGGEQLTDAKEPVASTAKERLSKDIETMPDKKKGEGALFYEPPRFPGLDVPFISCDLVTSADLQEFSPLGIRQWMRSTMNVPTPLRLWGSPTHDESPDALKTAAESFPCTSSIMKKRQRSLLSPTPDERIEKKSGIAKGVTDISYMITATCSMNATNDEDIVTESAVCAKQPSLKHLDKKLEFSDINKENSDGASEQAKDAQNTQLVDEQHSSPNVVNPNTDLQDNIQPVQILVEQSSNNLISSDHGAKPSCFSVYEAKLWQVLFVNISYELLLLLDWLIPQGFVSPADRTYDALGLVNRLSKHSAAAAVEACEMLASGNTTSDKENKDNTDGKELVTRKSQIKIMAEARVLDFDESPAPARTADKKLGSCHRRSVSSPILPSPNLRSFR

SEQ ID NO: 3400 - protein, 333 aa, Ostreococcus tauri
MSLTARPRGSTFLPSATRANPTPRTGPAGSRCYRTWQKSPQRFAVLTESADTSVSVVTKQAARVEDVRILQRNKVFGVEFLVLLEDSTKVWLSGEYIADDLKTQYDANWWSACRQGEDVALEGILQHSCGTLLYSRDAKQRSPIHFLAGVGNTVTLKELLKERADVNAQDSDGYTAAHLAAGYMHLDALRCLLEAGADAELEDRTGRSVQGLLRTLLANMPVTTATYSRRVSLESILSTIESHIYEEVFPDRILSMRESNSGREYLVRWIDGYEDMWVTEMDISDDVISAFERNVENVVGKEVLTVGDGRTAGKQGKLIQVRKMRLRNRTGIN

SEQ ID NO: 3401 - protein, 338 aa, Arabidopsis thaliana
MSPEEELQTNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLAAAPRAMEKSKMRA

SEQ ID NO: 3402 - protein, 247 aa, Capsicum annuum
MGRGRVQLRRIENKINRQVTFSKRRSGLLKKAHEISVLCDAEVGLIVFSSKGKLFEYSTDSCMERILERYERYSYAERQLNATDVETPGSWTLEHAKLKARLEVLQRNQRHYAGEDLDSLSMKELQNLEQQLDSALKHIRSRKNQLMHESISELQKKDKALQEQNNNLSKQMKEREKQLAQQHTPWEQQNHDHLNSSSFGLPHPFNNNHLGEVYPTAGDNGEVEGSSRQQQQNAAVMPPWMLRHLNG

SEQ ID NO: 3403 - protein, 279 aa, Triticum aestivum
MGRAPCCEKMGLKRGPWTPEEDKILVAHIHSHGHSNWRALPKQAGLLRCGKSCRLRWINYLRPDIKRGNFTDEEEQSIIQLHQLLGNRWSAIAARLPGRTDNEIKNVWHTHLKKRLDPSAQERHQEAKKRKKPAAAARKREGKVKMRKLDALTAKAAPVLSSPERSVSSTLTESTSTASAAAEQHGNSGSSASASASVKEECFTSSEESEEFQIDESFWSETLSMPLDDINDVCMEPHDAFGKPAGADGGDMDYWLKVFMEGGGDDDDNNDGALDLPQV

SEQ ID NO: 3404 - protein, 342 aa, Zea mays
MAAAIDMYKYYNTSAHQIPSSSPSDQELSKALEPFITSASSSSSSSPYHGYSSSPCMSQDSYMPTPSYTSYATSPLPTPAAASSSQSQLPPLYSSPYAAPCMAGQMGLNQLGPAQIQQIQAQFMFQQQQQQRGLHAAFLGPRAQPMKQSGSPPPLAPAPAQSKLYRGVRQRHWGKWVAEIRLPKNRTRLWLGTFDTAEDAALAYDKAAFRLRGDTARLNFPALRRGGAHLAGPLHASVDAKLTAICQSLSESKSKSGSSGDESAASPPDSPKCSASTTEGEGEEESGSAGSPPPPPPPTLAPPVPVPEMAKLDFTEAPWDETEAFHLRKYPSWEIDWDSILS

SEQ ID NO: 3405 - protein, 375 aa, Fagus sylvatica
MCGGAIISDFIAPTGSRRLTADYLWGDRKKPISGKRFSKPVVDLDDEFELDFQGFKDEEESDIDEEEVLVQDVKPFTFSAPPSSGSKPVKSVEFNGQAEKSAKRKRKNQYRGIRQRPWGKWAAEIRDPRKGVRVWLGTFNTAEEAARAYDAEARRIRGKKSKGNFPMRLPVPKRSVKANLQKPLAKANLNSVQPNLNQNFNFMNSDQDYTMGLMEEKPFTNQYGYMDSIPVNADVGLKSFASNNTAPYFNSDQGSNSFDCSDYGWGEQGSKTPEISSVLSATLEGDESQFVEDAVPTKKLKSDSGNAVFIENNTAKTLSEELSAFESQMNFQMPFLEGSWESNMEALFSGDTTQDGNSMDLWSFDDLPVMAGGVL

SEQ ID NO: 3406 - protein, 335 aa, Triticum aestivum
  misc_feature (116)..(116): Xaa can be any naturally occurring amino acid
  misc_feature (194)..(194): Xaa can be any naturally occurring amino acid
  misc_feature (222)..(222): Xaa can be any naturally occurring amino acid
  misc_feature (258)..(258): Xaa can be any naturally occurring amino acid
MDPRFQLPTPVPSSGGAGVRGHHRRAHSETFLRFPDTDLFLDPDGDFSFSDLDFPSLSDDSPAVSDPTPPPPPPMAASSSQTPAPRPPGGTHNRSLSLDAAFFEGLALQGGGSGGXCGGHKRSGSMDGVNSPFEGESALSGGLDYAKKAMPAERIAELALLDPKRAKRILANRQSAARSKERKIKYTGELERKXVQTLQTEATTLSAQLTLLQRDTSGLTTXIENSNFRLQSMEEQAKLRDALNDALREEVQRLKIAXAGQAPKMNGSQFNGGLQQIPSYFSQQHQRQQQQQHQQQMAYLGGHQAQRHHPNHHQSPSNGGQSLSGLSLDDSMDFI

SEQ ID NO: 3407 - protein, 240 aa, Atriplex hortensis
MSYSYPPPLPSNTLNNFLSPKPVTMKTTGGPPKPTKLYRGVRQRHWGKWVAEIRLPKNRTRLWLGTFDTAEEAALAYDKAAYKLRGDFARLNFPNLRHEGSHIGGEFGEYKPLHSSVNAKLEAICESLAKQGNEKQGKSGKSKKKDVANNNNNTSSSSSSSCCTTATAAADAPQQQQRMPENGGDVKTESTSDSEVGSGGSSPLSDLTFGDNEEMGSENFLLESCPSHEIDWDAILSSES

SEQ ID NO: 3408 - protein, 216 aa, Oryza sativa Japonica Group
MAPVGLPPGFRFHPTDEELVNYYLKRKVHGLSIDLDIIPEVDLYKCEPWELEEKSFLPSKDSEWYFFGPRDRKYPNGCRTNRATRAGYWKSTGKDRRINYQNRSIGMKKTLVYYKGRAPQGIRTSWVMHEYRIEESECENAMGIQDSYALCRIFKKNVVLGEFDKKGECSSSQAKGNEEVTDFGDAGQSSGANENDKDNSWMQFIAEDLWCTNKLK

SEQ ID NO: 3409 - protein, 350 aa, Gossypium hirsutum
MAAAMDFISIGVDQSDLYGGELMEALEPFMKSVSSSSPSPSPSPSPSSLPSTSYLSFSSSETQPNFYPDSCCYPYPTPMDSVSCPQQPQTGSTIGLNSLTQAQIHQIQLQFHLHNNQPSYLCQSPQPNTISANSNPMVSFLCPKPVPMKHVGAPSKPTKLYRGVRQRHWGKWVAEIRLPRNRTRLWLGTFDTAEEAALAYDKAAYKLRGDFARLNFPNLRHHGSHVGDYKPLPSSVDAKLQAICESLVQNPKQGSKKKSSKVTADTKSRNNKKSDMAEPKPEENTAKVENSSSLSTVQSESEGSAVSSPLSDLTFSDFDEQPWPEVVSSSETFMLSKYPSEIDWDSILKA

SEQ ID NO: 3410 - protein, 811 aa, Vitis vinifera
MEMRNFRPESHVAQQSRRDKLRVQHQSSTPAHHLEEFPNSLEQLSVHPELNPDLIQVRNVRNGNVLYDPIVLSSEMLNFSSNSHVFLGSKDAMVGQDSNAVSQDASFPNLSHPISSKAAGDPQNCDNWKGLGTQQSCDWIVNYANGTVASESNQNPMYVGEVLSASSMKVNNISASSLDLKPNYSGYQDVQSSITNPSSEISSQDSQKHYGEIHFNSPQLYRNTLQEVVTSAAVGTQGLEMASFAHQNIRDTGRDSWEDGGNELVLLPNFGNQSSALRLDSSVAWMTRPVEGCHQWSGGDLGVLANKSLGDLSTIASDSNAQGLSLSLSSHPSSKIQVAQFGERYESKDLRSGTAAFSCPQDLKVMSSGYLCSDSKPPVSGKGYGNSLHDIVGTSTYTHRSAGPLGPFTGYATILKSSKFLKPAQQVLDEFCKAASPKLVKTCEVTRRTSGDGGNSAVSSSTFYDSNEISEGGVKSSSCESYRPDYQQKKAKLLFMQEEVCRRYKQYHQQMQMVVSSFETVAGLSAATPYIALALKTVSRHFRFLKNAISDQLRHIRKALGEDFAGDASSPRLNFPKHKPGGANLGFLEPQQHVWRPQRGLPERAVAILRAWLFEHFLHPYPTDTDKHMLATQTGLSRNQVSNWFINARVRVWKPMVEEVHMLETKGLAERDQNSGKKDWKSIGEGVSQRDGNQPSNKPSVNAMSDEQLECRGMCPSAGTGDELGAEQWNQEKRSRVECQIPGSMDGSLMGFVPYQRSGVEIGGLGAVSLTLGLRHSVETAQQQQHQQQLQQQEDQLRRQFGGQMIHDFVG

SEQ ID NO: 3411 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGVATHLPWGSSCAVPCTQVHSPVPMKGRPLFNDRDLEGKETQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 3412 - protein, 804 aa, Prunus avium
MKGKQVQVHHHQDLHAGDLHHHHMKDVNIPISDGFGGGGAMEELEDQEDNLGVDPREMWLDDNDQETAFLADVNDPSIFYNDHFPPLPDFPCMSSSSSSSSTPAPVKPVTSSSTSSSISSSSSAASWAILRSDAEEDGERRQQQHHNSYNHRYQYSQVDDQAVDAHALSSTASMEISQPSDLGREGGAIDCMGAMETFGYTDLFESNEFFDLSSIFQSDSLLMEQFQQDDDHQQLLTPHQLQDPNEATAIIPQQQQQQEVAVRDEENNKKDDQNENKEPDDMAMVFLEWLRSNRETVSAEDLRSVKIKKSTIECAARRLGGGKEAMKQLLKLVLEWVQTNHLQKRRSNSLTTKDANIVAQQQQYHDPFQNPNPNTSPRVLEPNPSCSFTQTPWMAPPPHAAYDHAGESLSPLRPRRPPPAAYPSMMGYIAPDQYVNGPGPYQPSPEYHHMIDSGQPTWPSSPFGMGTAHYGSFPDNNIHLAPPPQHRPQAFAGYGSQYQPYQYFPGNGEHQLMRLGSSATKEARKKRMARQRRLVSHHRHGHHHQQQHLNAQMPDHLLHQQHTRLVGNAANLNCANSVPLQANPGNWFYWATATAAPSPSPAMMPSITPEAAPPPPVQQMDRPASTQAQNYNQGRSAAQERQERRQGWKSEKNLKFLLQKVLKQSDVGSLGRIVLPKKEAETHLPELEARDGISIPMEDIGTSRVWNMRYRYWPNNKSRMYLLENTGDFVRANGLQEGDFIVIYSDVKCNKYMIRGVKVRQAGPKSEGNKRPGKSQRNQHASTPAGTNGSSPSSASASATHKKQ

SEQ ID NO: 3413 - protein, 333 aa, Vitis vinifera
MGVPETDPLSQLSLPPGFRFYPTDEELLVQYLCRKVAGQGFSLEIIGEIDLYKFDPWVLPSKAIFGEKEWYFFSPRDRKYPNGSRPNRVAGSGYWKATGTDKVITTEGRKVGIKKALVFYVGKAPKGTKTNWIMHEYRLLENSRKNGSSKLDDWVLCRIYKKNSNSSKPIAAVLPSKAHSNGSSSSSSSHLDDVLESLPEIDDRFFSPNRMNSLRVSQPDEKVNFHNLGSGNFDWATLAGVSSLQELVSGVQSHAQPPAAVNNSNEMYVPSLPPLIQAEEEVQSGLRTQRVDPVMNQGFFPQNSNAFSQSFSNSLDPFGFRYPTQPSGFGYRQ

SEQ ID NO: 3414 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSESENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSAGPNQSGAATHLPWGSSCAVPCTQVHSPIPMKGRPLFNDRDLEGKETQKEGSSTGSNAESVDAELSGEKNMEIEAQSSRNVVEESVRTSVPSLFERRANSTKRVKGFVPYKRCLAERGMSSSTLTGEEREEQRTRLCL

SEQ ID NO: 3415 - protein, 421 aa, Oryza sativa Indica Group
MSAAEDPAKPPPPPPPQLEASGSDPDDPLLRDRVVVIAPPPPPPPPPPPPAPAPALLAPAENASAEAAFAVPPAAIAAVVEANGNSEKKKKSVAFVFWSSISCFWRKTDEGEGCKSCSCKKSKCLKLYCVCFASGSHCSESCGCDPCYNKSIHGVPRSTPALPLKAVQTLETGQDSVEQLIRSPMDFGRRKCTCKKSGCLKKYCDCYQGGAGCSINCKCDDCKNPYGRKVGVILDGKNILAGPTPNERNGTEADSSDDEEDDYYMNRPLSPVSPSPVSRESSFQQETLVGVEVQTMNGHLYPKPLTQVRPESWQLTRRPTEEVRGEAWHYLRRPSEDGTSDVMEGHADPKFQRDNKQLENHVDRYSIPRCIEVMNAMADLSPIEKSLAPDVFLDPSNREIFLSLTVDIRTMWLKRKMKSLV

SEQ ID NO: 3416 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMPTPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEGNDFVKEGSDEASSTQCLKLFGKTVLVTDAHMPPTDETLTRSSFPAKYLPWDSECPQSTFSIVPPTRSYYFPSPNGSPGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3417 - protein, 240 aa, Oryza sativa Indica Group
MERGDEASVNRGWLELRLGVNGGGGVETVPVTAADSSASSEAGEADTVTPSQQQQQQQQGSPSSPAASSAPNKVFSCNFCMRKFFSSQALGGHQNAHKRERSAAKRTPSSSSPYHLHHHRMMMAGAGLPLEAHAAFMRAALRVNPAGSAIHKQQQQHQPPPPITQDATAPRFHDGAAVAAAAAVTPWAPVAPLAYDEVLSSSASSWPGSFRFRTQPEPPPSSEQEPPSEQSKKIDLSLRL

SEQ ID NO: 3418 - protein, 84 aa, Physcomitrella patens subsp. patens
KKGAVKLNKRVRVPRYAIHTRSEIDVMEDGYKWRKYGQKAVKDSPFPRSYYRCTNQTCPVRKRVERKAGDAGLVVTTYEGTHSH

SEQ ID NO: 3419 - protein, 255 aa, Arabidopsis thaliana
MGRGRVELKRIENKINRQVTFSKRRTGLLKKAQEISVLCDAEVSLIVFSHKGKLFEYSSESCMEKVLERYERYSYAERQLIAPDSHVNAQTNWSMEYSRLKAKIELLERNQRHYLGEELEPMSLKDLQNLEQQLETALKHIRSRKNQLMNESLNHLQRKEKEIQEENSMLTKQIKERENILRTKQTQCEQLNRSVDDVPQPQPFQHPHLYMIAHQTSPFLNMGGLYQEEDQTAMRRNNLDLTLEPIYNYLGCYAA

SEQ ID NO: 3420 - protein, 203 aa, Physcomitrella patens subsp. patens
MVILASPTGGPVTQLQLPPGFRFHPTDEELVLHYLCRKAESHVFAIPVIAEIDLYKFDPWDLPGKAIFGEREWYFFSPRDRKYPNGARPNRAAASGYWKATGTDKPIHTSVGGIRKIGVKKALVFYKGRAPKGVKTNWIMHEYRLAEGVCASVHAHRKGSLRLDDWVLCRIYKKSTNAQRTGKERDSSSCVEEVSKLSFGSHS

SEQ ID NO: 3421 - protein, 359 aa, Vitis vinifera
MSPPLLGVGEEEGQSNVTILASSASMESVCQISSGLKERNYMGLSECSSVDSSAISTDSDGNKSSLNLKATELRLGLPGFLSPGREPELCLLSSTKLDEKPLFPLHPSKDLTYTSSQKTVVSGNKRGFADAMNGFSEGKFLANSEVNVMLSPRPSPNKENLGSQPAKMKEMASPKIVQERPRATNETPPNHTGTGNNNSSAPATKAQVVGWPPIRSFRKNTLATTSKNTEVDGKAGPGALFVKVSMDGAPYLRKVDLRNYSAYQELSSALEKMFSCFTIGQYGSHGAPGREMLSESKLKDLLHGSEYVLTYEDKDGDWMLVGDVPWQMFIETCKRLRIMKSCDAIGLAPRAVEKCKNRN

SEQ ID NO: 3422 - protein, 118 aa, Ostreococcus tauri
MNLSLQQLTRLFGVLKIEDAAKELGIGITALKKRCREYGIYRWPHRQLKSLDNLIDELDKLKFGDRDDTCVKEAIVQLKYYKQKIVMDPCYKIPQSVFRLRQAQFKDKHKRSKHSDDD

SEQ ID NO: 3423 - protein, 443 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGVSSSTLTGEEREEQRTRLCL

SEQ ID NO: 3424 - protein, 446 aa, Solanum chilense
RMSVDVGAPSPRSIQVDEQVNPGEEYAPKIRKPYTISKQRERWSEEEHKKFLEALKLHGRAWRRIEEHVATKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAEISGDLVLSEPFDFVVEESRSSPARAYATSNPANQACVKLELFPEDNDFVKEGSDEASSTQCLKLFGKTVLVTDAHMPPTDETLTRSSFPAKYLPWDSECPQSTFSIVPPTPSYYFPSPNGSPGPNQSGAATHLPWGSSCAVPCTQVHSPIPMKGRPLFNDRDLEVKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3425 - protein, 304 aa, Zea mays
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVEARPTKRVSLSPDSPSGSGSGSGSGSGSGSGSDRSDLSHGAGQVYRPVARSGGFEPADCAMSRPLEEEEEEKEDPLTSLSLSLPGTDQRFHHDRAHSQFQELPASPPSPSPPPPPVLSAYPFSPVFMEAMQELIRTEVQRYMASVGVRAGCGAAGGADLCMPQLVDGVMRAAAERVGRMQ

SEQ ID NO: 3426 - protein, 362 aa, Helianthus annuus
MESDGDGGGTSSCLMSFGDTTNNINNNSSNNNNSNNNIGSLCLPPNPPGAYNTTTNNNNLIFSDHHPSAMMLEDNNININDGVGLAFMNPSSSVKAKIMSHPHYPRLLSAYLNCQKIGAPPEVVERLEEACRASVVAAMSSCSGGAGTSDGSGGGMNMIIGQDPALDQFMEAYCEMLIKYEQELSKPFKEAMLFLSRIESQFKAISISTSDSAGGEGGMDKNGSSEEEVDVNNNLIDPQAEDRELKGQLLRKYSGYLGSLKQEFMKKRKKGKLPKEARQQLLDWWTRHYKWPYPSEAQKLALAESTGLDQKQINNWFINQRKRHWKPSEDMQFVVMDAAHPHYFMENMNILGNPYPMDVSLL

SEQ ID NO: 3427 - protein, 101 aa, Triosteum himalayanum
  misc_feature (32)..(32): Xaa can be any naturally occurring amino acid
TAQGLRDRRMRLSLQIARKFFDLQDMLGFDKXSKTIEWLFSKSKKAIKEVTLKHPKMKNTTEKNESIVSECEVESAIENVNGERSERGKAQKVAYGHLARE

SEQ ID NO: 3428 - protein, 186 aa, Collinsia verna
MLGFDKPSKTLEWLLTKSKTAIKDLVQMKSCKSTNSTSGGPNSDCHDQEVESSCPSNSKGKSVLANNSSYNKAKESRAKARARARERTKEKMCIKQQLINEASGYIKSNYHNQFEVSGSRMPNIHCPLSYEEATRELIQEESIVIKRRMKQLNPPIFGMHQQNLNTSSNLNENWDFSAILDQHKFI

SEQ ID NO: 3429 - protein, 110 aa, Brassica napus
MDTAQWPQEVVVKPLEEIVTNTCPKPQPSQPQEPTPDGAAGGVERKARPEKDQAINCPRCNSTNTKFCYYNNYSLTQPRFFCKGCRRYWTEGGSLRNIPVGGGSRKNKRS

SEQ ID NO: 3430 - protein, 338 aa, Solanum demissum
MGRSKCCDEEGLKKGPWTHEEDQKLLSFIDKYGCGSWRGLPAKAGLQRCGKSCRLRWINYLRPDIKRGKFSLQEERTIIHLHAFLGNRWSTIATYLPSRTDNEIKNYWNSRLKKRLMKMGIDPMTHKPNAAGSSKYVANLSHMAEWESARLEAEARLVRKSKILFNKNNNSHNYNINPTTISQQLPYHQQLPCLDILKAWQMTSTKLPTINDISHAILLNNSRNKNLESSIPSTLNSSENIFANNVPTTTKVADDHQNLHNLSTINSCFEDDQLQTELPSFMQEFSGVFPEYTQNSTNGLQVDNIMGSFYGDFEDNKLINWNNFPNYLVNSPIGSPVF

SEQ ID NO: 3431 - protein, 224 aa, Glycine max
MRKGRGGGASAAAAAAVNGSVLKEPRYRGVRKRPWGRFAAEIRDPLKKARVWLGTFDSAEDAARAYDTAARNLRGSKAKTNFPLSPFCYQHPTTDPFFYAGFHDQHHHHNNNNLNNPQRPTSSGMSSTVESFSGPRPPTTTTTTTTTTATPFLTATRRYPRTPPLVPEDCHSDCDSSSSVVDDSDDNIVSSSFRPPLPFDLNALPFDDDAAVVDDDLRCTALCL

SEQ ID NO: 3432 - protein, 358 aa, Helianthus annuus
MEDYLGQNSSSSNTGTTSTTFLYGSGGVAPDTSCLYGRGGNESDPGHGGFHHPDQYHHPMVKIETEKFHNYPPSMVNFHNEDEALKAKIISHPHYSNLLQAYMDCQKVGAPPEVVGRLTAVRQEYEARQRANLGCRENYKDPELDQFMEAYYDMLIKYKEELTRPIQEAMEFMRRIESQLSTLTISSSSSSSPAGRIFISPDESKCEVIGSSDEEQENTSGGETEVAEIDPRAEDRELKNHLLRKYSGYLSSLKQELSKKKKKGKLPKEARQKLLSWWELHYKWPYPSESEKVALAESTGLDQKQINNWFINQRKRHWKPSEDMQFMVMDGLHPQNVATALYMGDHHYMGDGPYRLGP

SEQ ID NO: 3433 - protein, 208 aa, Zea mays
  misc_feature (130)..(130): Xaa can be any naturally occurring amino acid
MAKTKQGNKDVDSYTIGGTNKVVYVGDCVLMRASDSDNQPYVARVEKMEGDGRGSVRVQVRWYYRPEESKGGRRQFHGAKELFLSDHFDLQSAHTIEGKCVVHSFKNYTRLDNVGPEDFFCRFEYKAATXYCKCEMPYNPDDLMVQCDACKHWFHPSCVAMTIEQAKKLDHFVCSDCFKENGSKRLSNAYATSPNFEPKQAEPKRQRR

SEQ ID NO: 3434 - protein, 119 aa, Viburnum rhytidophyllum
TAQGLRDRRMRLSLQIARKFFDLQDMLGFDKASKTIEWLFSKSKKAIKEVTGSLPKTNKNSSSGAKSESFIMSECEVESGTEEIETESMKGVETLVGFHGGERKCRKTRKAAYDPLARE

SEQ ID NO: 3435 - protein, 512 aa, Schizosaccharomyces pombe 972h-
MAAKTVQYDNIYLNLSEKPGKLRIAPSGLGWKSPSLAEPFTLPISEIRRFCWSRFARGYELKIILKSKDPVSLDGFSQEDLDDLINVIKQNFDMGIEQKEFSIKGWNWGEANFLGSELVFDVNSRPAFEIPISAVTNTNLSGKNEVALEFSTTDDKQIPSAQVDELVEMRLYVPGTTAKEDAADGEEVEQNAANLFYESLKERADIGQAAGDAIVSFSEILLLTPRGRYDIDMYETCMRLRGKTYDYKVEYSSINSLFLLPKPDEQHVVFVIGLEPPLRQGQTRYPFLVTQFVRDEDMEVDLNIEETVLKEKYADKVKASYDQPAFEVVSQIFRGLTGRKVTTPAEFLSHEGHAAVKCSYKANEGQLYCLDKSFLFIPKPTLLMNTSDITRVTLSRVGMSVSAARTFDLTFTLRSGTSYQFSNINRVEQSALVAFLESKQIKIHNDLADETQQTLLTSALDDEDEEGDEEMEEALSEDEDFQAESESDVAEEYDENAESSDEEGASGAEGSE

SEQ ID NO: 3436 - protein, 185 aa, Glycine max
  misc_feature (61)..(61): Xaa can be any naturally occurring amino acid
APPPPPASKKGEIDLLTKFLLACPNCIEDVTVKSETALHIAVRCGQFEALQVLVGWLRRTXHKGARDLERTTLNWEDEEGNTILHISSRENNLQALQLLLKTKVDLKAKNLENSTALDVVTSAEIRNALVKAGAKQGSSVTNAPTLADKLRWNITLMGKITIFVLRIRSDITEDQRQAFLIVAAL

SEQ ID NO: 3437 - protein, 437 aa, Glycine max
KAPQWGCIPPQYSETGVPGPPSSQLRRPPPPVNEVIALADSGFTRDEICSEPQQKGMVASLDTEEKSSETMGRKFSEPRQQQESPILKGNLDCVRECSTSVEGNLSSPGTSKTGERRRVKAEKTITLQVLRQYFAGSLKDAAKNIGVCTTTLKRICRQHGIKRWPSRKIKKVGHSLQKLQLVIDSVQGASGAFQINSFYSNFPDLASPNLSGTGFFSTLNQSDNPNSTSTQPEHGSLSPEGASKSPSSSSSQSSISSHSCSSMSELQQQHTTNIASDKDPATVGEYSADVVLKLIRNEAKLKSLSQDRAKLLPRSLSQETLGEHPKTQYQLPLLKTSSSKVDSHRVKVTYGDEKTRFRMLKNWVYEDLLQEIGRKFNVSDMSKFDVKYLDDDCEWILLTCDADLEECIDVCQSSESGTIKLSLQPSSHSVRSFLEFR

SEQ ID NO: 3438 - protein, 115 aa, Physcomitrella patens subsp. patens
SRSSSSTEMCASNVSPSKKVSKLEVGGDSRHPMYRGVRRRPWGIWVTEIRRPKKKARIWLGSFETAEMAARAYDTAALCLRGPGAHLNFPKLASSLPRPLDLSDKSIQAAANDAA

SEQ ID NO: 3439 - protein, 236 aa, Picea sitchensis
MAREKIEIKRRANASARQVTFSKRRRGLFKKAQELSILCEADVALVVFSSTGKLYDYSSSSMKVILDQYILYHSTIQNDGQPTTLEFKSKNLKRIKQQFEDTSQNLRKMHGKELEGLSLKDLQQLEEQLEMGLTSIRSQKVEHRIKEIKELQQKGIQMIEENTKLRGQLNEGYGSLVENNDGCESLFIEPLENQDPQSSESINTYAFNFKLHNSPVKDPEDSVTSLQLGLSSHSEL

SEQ ID NO: 3440 - protein, 314 aa, Pinus taeda
MSCTTGGLSSPVSKPKLRKGLWSPEEDDKLINYMMKNGQGCWSDVAKQAGLQRCGKSCRLRWINYLRPDLKRGAFSPQEEHWIIHLHSILGNRWSQIAARLPGRTDNEIKNFWNSCIKKKLKHLSASTNNSKSISAPNRTSTMNSSITPFSESSAEPLEVMATRYQPSNAFNHEVPTAENQFCIPDVLALRHEQVQSQNQFSIDQDSATNNLISHLWNSNSTAVSSHESFSHAFMSPGLQTQGHVVKTPIKPCDQISWSTPLTREAAGSHACNYSLGCNIPALVESETLKEKFKNDAGDQINENEIMYLPRHLL

SEQ ID NO: 3441 - protein, 264 aa, Gerbera hybrid cv. 'Terra Regina'
MENSDVLELDFSCVDRSMSFPDDTGDMSPQRKMGKGKIEIKRIENTTNRQVTFCKRRNGLLKKAYELSVLCDAEVALIVFSSRGRLYEYANNSVKGTIDKYKKACLDPPTSGTVAEANTQYYQQEAAKLRQQIANLQNQNRQFYRNIMGESLGDMPVKDLKNLEGKLEKAISRIRAKKNELLFAEIEYMQKRELELHNSNQFLRAKIVENERAQQHHMSLMPGSSDYELVTPHQPFDGRNYLQTNDLQPNNDYSCQDQTPLQLV

SEQ ID NO: 3442 - protein, 437 aa, Oryza sativa Japonica Group
MNEKDATDLEERSEASEHGQALSFHGGAMFLQEAQIASPAAANNALTSMANPFPIPPGLWNPPSHNMGLGETSFSSLLGMLSAGAPPPFVATPGFVDSTAGFPCYNGGNLGAMINHPFPGIHQPLGDFQNGVEPCREIEDIEIEGSKNVSQTGEKQQGDGETTHAVDSSSKELSMPGRNGGAGHDEGTRVSCSKKRKRSGQDGGVKHAEGGEQLATVGSAQKNEDDEKGEPKRSSVASGKSSGKQIKDNAGSPKEDYIHVRARRGQATNSHSLAERVRREKISERMKYLQDLVPGCSKVTGKAVMLDEIINYVQSLQRQVEFLSMKLASVNPTLDFNIERILSKDIFQCRGTTASSAFGFFPDIVHPRLHPPKYTQVGMPSIVNPTDAFGRVIHAPLGTNSAFKEPKHQMPNNLNGEFQDVIEMPFTHDHHGSNDQP

SEQ ID NO: 3443 - protein, 246 aa, Gerbera hybrid cv. 'Terra Regina'
MSFPNDSGEMSPQRKLGRGKIEIKRIENTTNRQVTFCKRRNGLLKKAYELSVLCDAEVALIVFSSRGRLYEYANNSVKGTIDRYKKACLDPPSSGSVAEANAQFYQQEAAKLRQQIANLQNQNRQFYRNIMGESLGNMPAKDLKNLESKLEKGIGKIRSKKNEILFAEIEYMQKRENELHNSNQFLRSKIAENERAQQHMSLMPGSSDYELVAPHQPFDGRNYLQVNDLQPNNNYSCQDQTPLQLV

SEQ ID NO: 3444 - protein, 334 aa, Pisum sativum
MDGREAMAFSGGPGSYYLHRGGVEAAGSGSGGFQVPPGFRALPNNGIIAQPNVRAQGGNGDTSSMFSLEPQSHADFNHDISVGASSGAPSSEPVKKKRGRPRKYGPDGSVSLKLSPMSAPANSTQDSGTPSEKRGRGRPRGSGRKQQLAALGDWMTSSAGLAFSPHVITIAAGEDIAAKLLLLSQQRPRALCILSGTGIASKVTLRQPASTNAGVTYEGKFQILSLSGSYLVSEDGGPTNRTGGISVSLSSRDGHVIGGSVAMLIAGSPIQLVVCSFVYGGGSKVKTKQGMITNGESSEPHNDNLGSPASAPPDQNYISSPTGMWPGSQPSDMK

SEQ ID NO: 3445 - protein, 347 aa, Pisum sativum
MDGREAMAFSGGPGSYYLHRGGVEAAGSGSGGFQVPPGFRALPNNGIIAQPNVRAQGGNGDTSSMFSLEPQSHADFNHDISVGASSGAPSSEPVKKKRGRPRKYGPDGSVSLKLTPMSAPANSTQDSGTPSEKRGRGRPRGSGRKQQLAALGDWMTSSAGLAFSPHVITIAAGEDIAAKLLLLSQQRPRALCILSGTGIASKVTLRQPASTNAGVTYEGKFQILSLSGSYLVSEDGGPTNRTGGISVSLSSRDGHVIGGSVAMLIAGSPIQLVVCSFVYGGGSKVKTKQGMITNGESSEPHNDNLGSPASAPPDQNYISSPTGMWPGSQPSDMKSAPAHTGIDLTRG

SEQ ID NO: 3446 - protein, 446 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFDTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3447 - protein, 446 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAEISGDLVLSEPFDFVVEESRSSPARAYATSNPANQACVKLELFPEDNDFVKEGSDEASSTQCLKLFGKTVLVTDAHMPPTDETLTRSSFPAKYLPWDSECPQSTFSIVPPRPSYYFPSPNGSPGPNQSGAATHLPWGSSCAVPCTQVHSPIPMKGRPLFNDRDLEGKETQKEGSSSGSNAESVDAELSGEKNLEIEAQSSRNVVEESVRASVPSLFEGRANSTKRVKGFVPYKRCLAERGMSSSTLTGEEREEQRTRLCL

SEQ ID NO: 3448 - protein, 378 aa, Oryza sativa Japonica Group
MDFSCFNPQPAISHGIPFDSFLLQDELHHHADLDHPFEAEGITVHGSELEGGSVLPFATLHDLDHEFFRRGSRKDFIDNASSIFLLNPKTEVSHLVRDVQVGAFGAYEMNGRLISRNKASRKGIKKADAVKGHWTVEEDRKLVKLVEQFGLKKWSLIGGMLPGRVGKQCRERWFNHLRPNIKKDTWSEEEDMVLIQIHKEVGNRWAEIAKCLPGRTENSIKNHWNATKRRQFARRRNRSTSKSGSTVLQNYIKSLAISPQESQMNNERSESNPSDMMITQGTPCCFDGNNCSQSHTSEENIVPSCGDFAAEMWSGLFDTKEDEEDEAQYLLYDMDTHVDMNCIFSNMDYGSNIEPGLASVVKAECSAESWAVNLKETD

SEQ ID NO: 3449 - protein, 446 aa, Solanum chilense
RMSVDVGAPSPRSIQVDEQVNPGEEYAPKIRKPYTISKQRERWSEEEHKKFLEALKLHGRAWRRIEEHVATKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3450 - protein, 427 aa, Solanum ochranthum
IRKPYTISKQRERWSEEEHKKFLEALKLHGRAWRRIEEHVGTKTAVQIRSHAQNFFSKVVRESSNDDASSVKSIEIPPPRPKRKPMHPYPRKMATPRKSGTLASEKLKRSGSPDFCLSEPENQSPTSVLSALGSDAFGTVDSTKPSELSSPVSSAVAENSGDLVLSEPSDFVVEESRSSPARAYASSNPANQACVKLELFPEDNDFVKEGSDEASSTQCLKLFGKTVLVTDAHMPSSTSGQISLTDENDDEPASQTLPRSSFPAKYLLWDSECPRSTFSIVPPSPSYYFPTPNGSPGPNQSGAATHLPWGSSCAVPCTQVHSPIPMKGSPLFNDRELEGKETQKEGSSTGSNAESVDAEYLEIEAQSSRNVVESVRASVPSLFERRANSTKRVKGFVPYKRCLAERGMSSSTLTGEEREEQRTRLCL

SEQ ID NO: 3451 - protein, 329 aa, Physcomitrella patens subsp. patens
MGDNSPRTDTSTDVEVDAKLDDGHQQVTGGSITSDHEAGTKNGDSKALRRLAQNREAARKSRLRKKAYVQQLESSRIKLNQLEQELQRARQQGLYLGSGSYSGDQIAHSGGAVAFDLEYARWMEEQQRQMSELRAALQAHAADTELRGLVDGGMAHYEEIFRLKAVAAKADVFHVVSGMWKTPAERCFIWMGGFRPSELLKILLPQIEPLTEQQTMSICTLQQTSHAAEENLSSAMESLQQTLADTLSAGSFGSSSNVANYMTQMAVAMSELAALETFVLEADSLRKQTLQQMHRILTTRQAARGLLAMGDYFARLRALSSLWSARPRG

SEQ ID NO: 3452 - protein, 443 aa, Solanum chilense
RMSVDVGAPSPKSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAANSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGVSSSTLTGEEREEQRTRLCL

SEQ ID NO: 3453 - protein, 443 aa, Solanum chilense
RMSVDVGAPSPRSIQMDEQLNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPSTPSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGVSSSTLTGEEREEQRTRLCL

SEQ ID NO: 3454 - protein, 101 aa, Weigela hortensis
TAQGLRDRRMRLSVQIARKFFDLQDMLGFDKASKTIEWLFTKSKKAIKELTLNHQQMKNSHRSREKSESFVSEREVEFVTENVNGERGKAQKVANDPLARE

SEQ ID NO: 3455 - protein, 269 aa, Oryza sativa Indica Group
MPPPSPHPPHRNGNHVPAPSGESFAKFFECWISEQSRDLAALRSAASAATNPAAPPDDAELRRLVDRVLGHYEHYYRTKSAAASTDVLRMFSPSWTSTTENLYLWCGGWRPTAALHLLYSKSGAQLETQLPVFLAGGGLGTGDLGDLSAEQLQAADQLQRITISKEREIENAAASAQESLATVKMVELAGGGGVDAEGMEMEMRSKADGMRRVLEMADGLRLETMREVVALLRPSQAVHFLIAAAELHLAVHEFGRRKDGDGAASPPPA

SEQ ID NO: 3456 - protein, 104 aa, Triticum turgidum subsp. durum
RRWKEVNQQLEHDPQGSKRSRKPPAKGSKKGCMQGKGGPENTQCGFRGVRQRTWGKWVAEIREPNRVSRLWLGTFPTAEDAARAYDEAARAMYGALARTNFPVH

SEQ ID NO: 3457 - protein, 235 aa, Arabidopsis thaliana
VTTSSSSLSHSSSSSSSSTSALRHQSCKNKIKKYKGVRMRSWGSWVTEIRAPNQKTRIWLGSYSTAEAAARAYDAALLCLKGPKANLNFPNITTTSPFLMNIDEKTLLSPKSIQKVAAQAANSSSDHFTPPSDENDHDHDDGLDHHPSASSSAASSPPDDDHHNDDDGDLVSLMESFVDYNEHVSLMDPSLYEFGHNEIFFTNGDPFDYSPQLHSSEATMDDFYDDVDIPLWSFS

SEQ ID NO: 3458 - protein, 1790 aa, Neurospora crassa
MSSHDKNGRATSSSGKASSFFSRATGKNKADKRNASDEGGRYLAADNDAASTHTARSSRHYRDSSVISLDRPDTPESGLNMTAGVVTTIPYDPVSPDNRSPVALDHLPRPDQMPLRRELVPHHLNKGTGDFHQYPTIDQSPSSPYNGQSPSASSSRSTLATANITMASTGRQAQFQQWGPPRESSLPGYNSRGHSYMTTRSSGDNASIYSGRDGHYQEAPGTSHRSSRIGLPSTSSQSSYLSPHAHKDRDTQRLTKVAAGHQGSEGFNFPKPDDDNVIEQMFINLMQKRGWHNLPDQAKRQMIAYPAAKKWTLIYQDRLTEWQGEQKRRQTAKIGQYSNVDITQSSDDEGSPEWYVRKVMENALDSKGLGGLEVNLRTQQIGWVKRFIDCQGQIALTNVLLKMNRKTAYGPAQPDNGRLDKNLDREYDIVKCLKALMNNKFGADDALAHQQVIVALATSLISPRLTTRKLVSEVLTFLCHWGEGKGHVKVIEAMDVVKAQQGENGRFDAWMRLVEVTVDGRGKMGSLVGASEEVRSGGIGMENLLMEYAVATLILVNMLVDAPEKDLQLRIHIRAQFTACGIRRILNKMEAFQYELIDKQIERFRSNEAIDYEDMLERENSSIKDSIEGEVKDLNDPVQIVDAIQQRLNGTKTQDYFVSALQHLLLIRDNDGEERLRMFQLVDSMLSYVAMDRRLPDMDLKQSLNFTVQSLLDKLHTDSEARQALDEALEARQIADAAMAERDEMKERLALGADGLVAKLQKQIDEQAMFIEAQKRRAEGLKSELASLQTLRAKEAQRYELETRELYLMLRDAQDVAASNATKGNAKLGEEDVARMQGILDRERLLERLQMQIERQKTQFKLEGRVWGEVIGPSDRLRALREEMDGFGDDTPEVVPPKDFTNSMLGSVKRSTRIPRKPVGSRSDHVEDVLEESDVEIGDDGEIVYEKPRVVKIRRPVVDPKQTNGMFNELTGKVRRYDASDSEEGDGITTGPSHPSMESQTPITPSDTETPKIQVTDATGPSAPAAASGPPPPPPPPPPPPPPPGFLPGAPAPIPGAGGPPPPPPPPPPPPPPPGGLPGAAPPMPGAGGPPPPPPPPPPPPMPGMAGPASGRFLAQNAGLPTTNSVGLPVVRPKKKLKAFHWDKVDTPLATHWAAHTPSPESREEKYHELSKKGILDEVEKLFMAKEIKKLGGGGAKKDDKKQIISNDLRKAFEIALAKFSQFPVEKVVQMIIHCDKDVLDNPVVMDFLQKDDLCNISDNTAKVMAPYSKDWTGPDAGKDTREQDPNELTRQDQIYLYTAFELHHYWKSRMRALALTRSFEQEYEEITEKMRAVVAVSESLRDSVSLMNVLGLILDIGNYMNDANKQARGFKLSSLARLGMVKDDKNESTLADLVERIVRQQYPEWEDFAKDIEGVIAAQKINIEQLQADAKRYIDNIKNVQMSLDSGNLSDPKKFHPQDRVSQIVQRVMKDARFKAEQMQLYLEEMVRTYNDIMVFYGEDPSDDNARREFFSKLASFITEWKRSREKNIQLEEQRKRNEASMKRKNAQFKALQASEAQGPASPTSTGAMDSLLEKLRAAAPQTRDQRDRRRRARLKDRHQVRIASGQQVPDFNEIPEVEAALQTGKSAASATTDDDGAGNGLVSPDALPPTKEAPDAEEDDVARRAAALLQSFQGGDGAEDDAEKRESLRKSRRQTAAEERNMRRRRREKAQTSTAGEEGKDESTAADGSEAAPSASAEDLSAAEAKTDGPSSPRPGTATGAEASEETETTPTATATDTNPEESKETTG

SEQ ID NO: 3459 - protein, 351 aa, Lupinus argenteus
STYISSGPYPYFSSSSSPYHPFAFFNPENSSSNNTFSHDQLSFPYNIPTTHHYHAPTQETLSNFADCAASAAMFKTDVSGNSNFGFSNFLAKKPASKKDRHSKIHTSQGLRDRRVRLSIEIARKFFDLQDMLGFDKASNTLEWLFNKSKKAMKDLARSKNSSSGVVANSFSSSDSEFEVVSMINQDSIDATQEGVVVDSKDRELKRARIKESREKARARARERTNKKMLSSMKKKYPAIENPQMFNQLRLPFHHPENLAKSPNNKSILSHHHNPHLVCSETPRDDFNLFEESIVIKRKLKQNHVIPKESNFNNNTEHHSFPILSPNLDANNGANGRSNFCAVTNMNLSTGM

SEQ ID NO: 3460 - protein, 209 aa, Oryza sativa Indica Group
MSSSSGSGRSATEARALKIHSEAERRRRERINAHLTTLRRMIPDTKQMDKATLLARVVDQVKDLKRKASEITQRTPLPPETNEVSIECFTGDAATAATTVAGNHKTLYIKASISCDDRPDLIAGITHAFHGLRLRTVRAEMTSLGGRVQHVFILCREEGIAGGVSLKSLKEAVRQALAKVASPELVYGSSHFQSKRQRILESHCSIMSI

SEQ ID NO: 3461 - protein, 351 aa, Lupinus polyphyllus
STYTSSGPYPYFSSSSSPYHPFAFFNPENSSSNNTFSHDLLSFPYNIQPTHHYHAPTQETLSNFADCAASAAMFKTDVSGNSNFGFSNFLAKKPASKKDRHSKIHTSQGLRDRRVRLSIEIARKFFDLQDMLGFDKASNTLEWLFNKSKKAMKELARSKNSSSCVVANSFSSSDSEFEVVSMINQDSIDATQEGVVVDSKDRKLKRAKIKESREKARARARERTNKKMLSSMKKKYPAIENPQMFNQSGLPFNHPENSAKSPNNKSIISHHHNPHLVCNETPRDDFNLFEESIVIKRKLKQNHVISKESNFNNNTEHHSFPILSPNLDANNGANGRSNFCAVTNMNLSTGM

SEQ ID NO: 3462 - protein, 351 aa, Lupinus argenteus
STYISSGPYPYFSSSSSPYHPFAFFNPENSSSNNTFSHDLLSFPYNIPTTHHYHAPTQETLSNFADCAASAAMFKNDVSGNSNFGFSNFLAKKPASKKDRHSKIHTSQGLRDRRVRLSIEIARKFFDLQDMLGFDKASNTLEWLFNKSKKAMKELARIKNSSSGVVANSFSSSDSEFEVVSMINQDSIDATPEGVVVDSKDWKLKRAKIKESREKARARARERTNKKMLSSMKKKYPAIENPQMFNQLRLPFHHPENSAKSPNNKSILSHHHNPHLVCSETPRDDFNLFEESVVIKRKLKQNHVIPKESNFNNNTEHHSFPILSPNLDANNGANGRSNFCAVTNMNLSTGM

SEQ ID NO: 3463 - protein, 159 aa, Brassica napus
  misc_feature (25)..(25): Xaa can be any naturally occurring amino acid
RKPLHKRGRKTSVAESSDYRKHESXSPIYHDGFLWRKYGQKQIKESNHQRSYYKFAYTKDQNCEAKKQVQMIQHNPPLYSTIYFGHHTCQLHQAYATFSMDTSDPQDSHMIRFDHPDSSLHQHQNQSQNQIIYLKDENMMMLPDKSEEWSSPSQWMSSE

SEQ ID NO: 3464 - protein, 346 aa, Lupinus lepidus var. utahensis
  misc_feature (60)..(60): Xaa can be any naturally occurring amino acid
  misc_feature (71)..(71): Xaa can be any naturally occurring amino acid
SGPYPYFSSSSSPYHPFAFFNPENSSSNNTFSHDLLSFPYNIQPTHHYHAPTQETLSNFXDCAASAAMFKXDVSGNSNFGFSNFLAKKPASKKDRHSKIHTSQGLRDRRVRLSIEIARKFFDLQDMLGFDKASNTLEWLFNKSKKAMKELARSKNSSSGAVANSFSSSDSEFEVVSMINQDSIDATPEGVVVDSKDRKLKRAKIKESREKARARARERTNKKMLSSMKKKYPAIENPQMFNQLRLPFNHPENSAKSPNNKSILSHHHNPHLVCSETPRDDFNLFEESIVIKRKLKQNHVIPKESNFNNNTEHHSFPILSPNLDANNGANGRSNFCAVTNMNLSTGM

SEQ ID NO: 3465 - protein, 116 aa, Brassica napus
  misc_feature (93)..(93): Xaa can be any naturally occurring amino acid
  misc_feature (103)..(103): Xaa can be any naturally occurring amino acid
  misc_feature (110)..(110): Xaa can be any naturally occurring amino acid
MKIRCDVCDKEEASVFCTADEASLCGGCDHRVHHANKLASKHLRFSLLNPFSSNNSSPICDICQEKKALLFCQQDRAILCKDCDSSIHSANEXVKKHDRFLLXGVKLSAXSSVYKT

SEQ ID NO: 3466 - protein, 219 aa, Gossypium arboreum
MSMKKEGEILYKKGLWAMEEDKLLIDYVNVHGKGQWNKIANRTGLKRSGKSCRLRWMNYLSPNVKKGDFSEEEEDLVIRLHKLLGNRWSLIAKRVPGRTDNQVKNYWNSHLRKKLGIIDQNKTRIDFCQSSKQVKVCHVDEAATDPSPGHGTTTETTGITVDQSNQQEVIDHRVLNNTTQESMTTESYINTFWIPDHDYELSTLAMIDHFHECSSFHLS

SEQ ID NO: 3467 - protein, 531 aa, Picea abies
MWDLNHIPEATKEPQVVVPMEAACSAEGNLSVGNANFRDENVSGSSSSSSVAIANTAMSVDCEEHSMSRACPSEQAEMNARSSQENGNGLGSEAQVQTGKLFGFSFSNIVKGNCTEASSGVSNGRSGCTNRVTRQFFPHGREFESQVMIPGRPQLPRAHWVGLTFRQAESFRSPTPKEATQPIKKSRRGPRSRSSQYRGVTFYRRTGRWESHIWDCGKQVYLGGFDTAHAAARAYDRAAIKFRGVDADINFNIDDYEDDVKQMSKLTKEEFVHVLRRQSTGFPRGSSKFRGVTLHKCGRWEARMGQFLGKKYVYLGLFDNEVEAARAYDKAAIRCNGKEAVTNFSPELYESELALTEDKGHDPDLDLSLGNSVPKDGSLVSKDNNDGPMRSESDLCTLSEPDWKTSCLIKPTVPNLLDGLNQSAQSLSCEVPSLQRYQQSPGWVWQLPTNRPAAPHPPPMIESAASSGFSPQIYSSTTSPSPEWLQKRGFHFLFQPALMQTKNILHSPTAPALINTYGKKPSDHSLNLSLG

SEQ ID NO: 3468 - protein, 75 aa, Brassica napus
YSEKEDNCLLVVTKVLDHLHLDLHHVSGGQIGEHYSFLLNTKINEGSTIYASAIANKVIEVVDQHYMAALPINNY

SEQ ID NO: 3469 - protein, 215 aa, Glycine max
MRRGRTAAAAAAVVDPTPDQAKETTRFRGVRKRPWGRFAAEIRDPWKKQRVWLGTFDSAEDAARAYDKAARSFRGPKAKTNFPPFPGPAEADHHSQIPLYQAHGLSTKFEPVVQVNRPTSSGMSSTVESFSGPRVPSSSSRAKPLVVVVNPIIPLNDDEDDCHSDCDSSSSVVDDGQDCVLISSFRQPLPFDLNLPPSDADDDNDDDLPATALCL

SEQ ID NO: 3470 - protein, 633 aa, Picea abies
MMTVDTSSIEPVGKIAPRSSEETESVCVEAAAATVTHIQSNNETRRRAPFRSEMTESGTSISSVVNSIACNENINSLEHEASSKAVELDGDVLSSNSTQVPRSNEGNHKIFGFSLKIETQNLTSRGNLLNVKANDEQQKDPACVTRHFFPLHNGQPSEVLMPTECTGGNPFTESHWTTVTSRLPESTEPRKKQAENNKPIKKSRRGPRSRSSQYRGVTFYRRTGRWESHIWDCGKQVYLGGFDTAHAAARAYDRAAIKFRGVDADINFTLTDYQEDLDQTSKLSKEEFVHILRRQSTGFSRGSSKYRGVTLHKCGRWEARMGQFLGKKYIYLGLFDSEEDAARAYDKAAIRCNGKDAVTNFDPSSYENEILEEGRESQTSTGFDQNLDLSLGIGHVTTQLKISPSYKSRVEEDSQLNRIEAVTYSNLSQDSKILSCLTSKGAENAVPEFQSLPRGHAVYWNSQTLQVPDAMKHKQSHTREDNAYEQTAISGSQLYPDHLSNCKRLNMEGLKEQSLGVPSSTVSFWPMKQQSGWTWQLHASGPTTPVFTTNRSPASGFSPQIHTAFVPSTHGCHKMGVHWAAQSTDPCMVQTPSPHLATRLTSGPDSGDHPVGLTLDLPGKKIKRSSVQRDKVD

SEQ ID NO: 3471 - protein, 136 aa, Oryza sativa Japonica Group
MDSSSVEKGSGSIDPDERTASGEPKACTDCHTTKTPLWRGGPSGPKSLCNACGIRYRKKRREALGLDAGEGGAERQEKKKSKRERGEEVTMELRMVGFGKEVVLKQRRRMRRRRRLGEEEKAAILLMALSSGVIYA

SEQ ID NO: 3472 - protein, 155 aa, Brassica oleracea
MKKLEADDTKPPEPPKDYIHVRARRGQPADSHRFAERVRREKISEMLTLLQDLVPDSSRITGKADSLDEIINYVQSLKRQVELLYMKLATINPRMESNRNAALSIKVKENMLYAIACSEQRLPLGYYSLAQNMPRFSDTQFLSNYGFVQTKVISR

SEQ ID NO: 3473 - protein, 443 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAIAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTQSYYFPTPNGSPGPNQSGVATHLPWGSSCAVPCTQVHSPIPMKGRPLFNDRDLEGKGTQKEGSSTGSNAESVDAEYLEIEAQSSPDVVEELVRVRASIPSLFERRANSTKRVKGFVPYKRCLAERGMSSSTLTGEEREEQRTRLCL

SEQ ID NO: 3474 - protein, 333 aa, Ipomoea nil
MDGMFGFHSTPDYGSRALMSPENLMDCGYSYNGLISPSAPDRIPVFASDDPTATGSFPCSVVSEAASVAPDVYRRGGGGGRREDAAGEKEDDDDHGIGLIKAKIASHPSYPKLLEAYIDCQKVGAPPEIASFLDEIRRENDLFKHDSRVSTCFGDDPELDIFMETYCDILVKYKSDLSRPFDEAKTFLNKIETQLSNLCKDDGVVSSDDDEYSGGEAEEQDSAVKGEDRELKSRLLQKYGGHISSLKLEFSKKKKKGKLPKDARQILLEWWKGHYRWPYPTEDDKISLAELTGLDQKQINNWFINQRKRHWKPSEHMQLAVMDNLAGQFFTQD

SEQ ID NO: 3475 - protein, 776 aa, Arabidopsis thaliana
MKREMKAPTTPLESLQGDLKGKQGRTSGPARRSTKGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSNGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDNGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCDLVPSNSDLRQEYSPFGIRQLMISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNVSPSLSLHIIWYQL

SEQ ID NO: 3476 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHISGGNEAEAIKAKILAHPQYPSLLGAYIDCQKIGAPPEVVARLDALTNEYENQQHRTTVSIGMDPELDQFMEAYCEMLTKYHEEL

SEQ ID NO: 3477 - protein, 234 aa, Arabidopsis thaliana
MAKTRPGVASKIKTGRKELDSYTIKGTNKVVRAGDCVLMRPSDAGKPPYVARVEKIEADARNNVKVHCRWYYRPEESLGGRRQFHGAKELFLSDHFDVQSAHTIEGKCIVHTFKNYTRLENVGAEDYYCRFEYKAATGAFTPDRVAVYCKCEMPYNPDDLMVQCEGCKDWYHPACVGMTIEEAKKLDHFVCAECSSDDDVKKSQNGFTSSPADDVKVRLSLFSHLLYRCSITYL

SEQ ID NO: 3478 - protein, 107 aa, Oryza sativa Japonica Group
MESSGGSQLGKNSKTSDGRETKATSSLLLLITAIHFVALCPKGENEDARKEVNSTAQNFVHFTEEEEDIVFRMHRLVGNRWELIAGRIPGRTAEEVEKFWAIKHQAT

SEQ ID NO: 3479 - protein, 163 aa, Vitis vinifera
MDINLLIALKLVNLGKGKKGRNSDKELLDKPDEVIHVRARRGQATDNHSIAERVRREKIKTRLRCLQDLVPGCYKNKGMAVMLDEIINYVHSLQNQVEFLSRELAAASSLHNFNSETEAIKNAQGTNTHEGQEMEKICLTMRKNQKRSSKVGSFHVLIELLKA

SEQ ID NO: 3480 - protein, 446 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3481 - protein, 97 aa, Populus deltoides
LMAHPHYHRLLAAYANCQKVGAPPEVVARLEEACASAASMGPANTDGIGEDPALDQFMEAYCEMLTKYEQELSKPLKEAMVFLQRVECQFRALTLSS

SEQ ID NO: 3482 - protein, 298 aa, Arabidopsis thaliana
FVELLFQGIEQSKPKPKSCSYYDDDDDDDDDGDEDDDDDDDDVDPSSKDIRLEEENECENRAVIRPSLNSVAPNQQRFGDDEVPSSSSSLSKDETAALCPTPHSQTQPQSQTQLQKVTQPQTQMLPKSDSYQCNVCGRELPSYQALGGHKASHRTKPPVENATGEKMRPKKLAPSGKIHKCSICHREFSTGHSLGGHKRLHYEGVLRGHKRSQEEEAVSQGDKLSPSGNGSVVTHVPDPKQSRKGLIVINKVPSPEFNDPGDKDILEGESALLANKLEQDRGITSTRMINGLKFFNFL

SEQ ID NO: 3483 - protein, 443 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSETENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGVSSSTLTGEEREEQRTRLCL

SEQ ID NO: 3484 - protein, 102 aa, Triticum aestivum
PLKTILCVKNHYKRSHCVKNYTCSRCHAKKFSVMADLKTHEKHCGQVRWVCSCGTTFTRKDKLFTHVGLFKGHTLLLPADEPEAHTRWLTQEAIKNQPRVVA

SEQ ID NO: 3485 - protein, 382 aa, Triticum turgidum subsp. durum
MTVDRKDAEAAAAAAPFEIPALQPGRTCGAEESTRSHVLVKPIGSSNLPCNEYALLARQNPKGDAQPVASILRKKRPRRSRDGPNSVSETIRRWKEVNQQLEHDPQGSKRSRKPPAKGSKKGCMQGKGGPENTQCGFRGVRQRTWGKWVAEIREPNRVSRLWLGTFPTAEDAARAYDEAARAMYGALARANFPVHPAQAPAVAVAAAIEGVVRGASASCESTTTSTNHSDVASSLPRQAQALEIYSQPDVLESTESVEHYSHQDSVPDAGSSIARSISEEDVFEPLEPISSLSDGESDGFDIEELLRLMEADPIEVEPVTGGSWNGVEIGQQEPLYLDGLDQGMLEGMLQSDYPYPMWISEDRAMYNPAFHDAEMSEFFEGL

SEQ ID NO: 3486 - protein, 306 aa, Oryza sativa Japonica Group
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARALRRGGAAGSRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKIPVLLLEQQPELRAHQGVEPLRQGEGAPSRATPSASTAPPIYAT

SEQ ID NO: 3487 - protein, 84 aa, Solanum lycopersicum
IKGSPYPRGYYRCSSVRGCPARKHVERATDDPGMLVVTYGGEHRHVQTTISGNVTGAGAGSSGERMMAFELTGQKNGERLGLEI

SEQ ID NO: 3488 - protein, 221 aa, Plantago major
MVRGKTQMRRIENATSRQVTFSKRRNGLLKKAFELSVLCDAEVALIIFSPRGKLYEFASSSLQDTIERYQSHIKELQAENPPLEQNTQQLQYETAGLLRKIEQLEAAKRKLLGEGIGACSLEELQQLETQLERSVTSIRTRKTQLYKQQIEQLKEKTKALAAENASICQKYGLQPQKGGGAKLSEERGNAASAEISEVSDVETDLFIGLPESRANKHSLQK

SEQ ID NO: 3489 - protein, 244 aa, Dendrocalamus latiflorus
MGRGKVQLKRIENKINRQVTFSKRRSGLLKKAHEISVLCDAEVGLIIFSTKGKLYEYATDSCMDKILERYERYSYAEKVLISAESETQGNWCHEYRKLKAKVETIQKCQKHLMGEDLESLNLKELQQLEQQLESSVKHIRSRKSQLMLESISELQKKEKSLQEENKVLQKELVEKQQVHKRLVQWDQTQPQTSSSSSSFMMREALPTTNISIYAAAAGERAEDAAGQPQIHIGLPPWMVSHING

SEQ ID NO: 3490 - protein, 244 aa, Dendrocalamus latiflorus
MGRGKVQLKRIENKINRQVTFSKRRSGLLKKAHEISVLCDAEVGLIIFSTKGKLYEYATDSCMDKILERYERYSYAEKVLISAESETQGNWCHEYRKLKAKVETIQKCQKHLMGEDPESLNLKELQQLEQQLESSVKHIRSRKSQLMLESISELQKKEKSLQEENKVLQKELVEKQQVHKRLVQWDQTQPQTSSSSSSFMMREALPTTNISIYAAAAGERAEDAAGQPQIHIGLPPWMVSHING

SEQ ID NO: 3491 - protein, 348 aa, Lupinus sericeus
STYTSSGPYPYFSSSSSPYHPFAFFNPENSSSNNTFSYDLLSFPYNIQPTHHYHAPTQETLSNFADCAAMFKNDVSGNSNFGFSNFLAKKPASKKDRHSKIHTSQGLRDRRVRLSIEIARKFFDLQDMLGFDKASNTLEWLFNKSKKAMKELARSKNSSSGVVANSFSSSDSEFEVVSMINQDSIDATPEGVVVDSKDRKLKRAKIKESREKARARARERTNKKMLSSMKKKSPAIENPQMFNQLRLPFHHPENSAKSPNNKSILSHHHNPHLVCSETPREDFNLFEESIVIKRKLKQNHVIPKESNFNNNTEHHSFPILSPNLDANNGANGRSNFCAVTNMNLSTGM

SEQ ID NO: 3492 - protein, 622 aa, Saccharomyces cerevisiae
MSFSTINSNVNKTTGDSNNNTTENSSTADLLGMDLLQSGPRLMNAMQPNNSSDMLHINNKTNNVQQPAGNTNISSANAGAKAPANEFVRKLFRILENNEYPDIVTWTENGKSFVVLDTGKFTTHILPNHFKHSNFASFVRQLNKYDFHKVKRSPEERQRCKYGEQSWEFQHPEFRVHYGKGLDNIKRKIPAQRKVLLDESQKALLHFNSEGTNPNNPSGSLLNESTTELLLSNTVSKDAFGNLRRRVDKLQKELDMSKMESYATKVELQKLNSKYNTVIESLITFKTINENLLNNFNTLCSTLANNGIEVPIFGDNGNRNPTGNTNPATTTAIQSNNNTNNASPATSTVSLQLPNLPDQNSLTPNAQNNTVTLRKGFHVLLVEDDAVSIQLCSKFLRKYGCTVQVVSDGLSAISTLEKYRYDLVLMDIVMPNLDGATATSIVRSFDNETPIIAMTGNIMNQDLITYLQHGMNDILAKPFTRDDLHSILIRYLKDRIPLCEQQLPPRNSSPQTHSNTNTANSNPNTINEQSLAMLPQDNPSTTTPVTPGASISSAQHVQQGQQEQQHQIFHAQQQQQHHNAIANARSDVAIPNLEHEINTVPHSSMGSTPQLPQSTLQENQLS

SEQ ID NO: 3493 - protein, 351 aa, Lupinus argenteus
SSYTSSGPYPYFSSSSSPYHPFAFFNPENSSSNNTFSHDLLSFPYNIQPTHHYHAPTQETLSNFADCAASAAMFKTDVSGNSNFGFSNFLAKKPASKKDRHSKIHTSQGLRDRRVRLSIEIARKFFDLQDMLGFDKASNTLEWLFNKSKKAMKELARSKNSSSGVVANSFSSSDSEFEVVSMINQDSIDATPEGVVVDSKDRKLKRAKIKESREKARARARERTNKKMLSSMKKKYPAIENPQMFNQLRLPFHHPENSAKSPNNKSILSHHHNPHLVCSETPRDDFNLFEESIVIKRKLKQNHVIPKESNFNNNTEHHSFPILSPNLDANNGANGRSNFCAVTNMNLSTGM

SEQ ID NO: 3494 - protein, 214 aa, Glycine max
MAPVLPPGFRFHPTDEELVAYYLKRKINGRKIELEIIPEVDLYKCEPWDLPGKSLLPGKDLEWYFFSPRDRKYPNGSRTNRATKSGYWKATGKDRKVNSQARAVGMKKTLVYYRGRAPHGSRTNWVMHEYRLDERECETNSGLQDAYALCRVVKKTAVIPPKVGGHYVNVPNANKITSDQSSSIELYSEGRHEDLDSSNYLMSMDICSPCNMGN

SEQ ID NO: 3495 - protein, 337 aa, Lupinus rivularis
  misc_feature (77)..(77): Xaa can be any naturally occurring amino acid
  misc_feature (151)..(151): Xaa can be any naturally occurring amino acid
SSSPYHPFAFFNPENSSSNNTFSHDLLSFPYNIQPTHHYHAPTQETLSNFADCAASAAMFKNDVSGNSNFGFSNFLXKKPASKKDRHSKIHTSQGLRDRRVRLSIEIARKFFDLQDMLGFDKASNTLEWLFNKSKKAMKELARSKNSSSGXVANSFSSSDSEFEVVSMINQDSIDATPEGVVVDSKDRKMKRAKIKESREKARARARERTNKKMLSSMKKKYPAIENPQMFNQLRLPFHHPENSAKSPNNKSILSHHHNPHLVCNETPRDDFNLFEESIVIKRKLKQNHVIPKESNFNNNTEHHSFPILSPNLDANNGANGRSNFCAVTNMNLSTGM

SEQ ID NO: 3496 - protein, 322 aa, Ipomoea nil
MMDETTYGFPSTSCDYADKALMSPDNNNLMMMDYPYAYNYNYNYHPGGAAADTIPFCGASTEVAAATTTCVDNEDDDVSSVMIKAKIASHPCYPKLLHAYIDCQKVGAPPEIATVLDEIRREDDELRKRGGGGAVSSCLGADPELDEFMETYYDMLVKYKSDLSKPFHEATTFLNTIETQLSNLCKDESGAVSSDEEDSGGETDIQQESITKTEERQLKNTLLRKYGSHLSSLKLEFSKKKKKGKLPKEARQTLLDWWSDHYKWPYPTEADKIALAESTGLDQKQINNWFINQRKRHWKPSESMQLAVMENLTGQFFSSDDS

SEQ ID NO: 3497 - protein, 237 aa, Ipomoea nil
MMDETTYGFPSTSCDYADKALMSPDNNNLMMMDYPYAYNYNYNYHPGGAVSSCLGADPELDEFMETYYDMLVKYKSDLSKPFHEATTFLNTIETQLSNLCKDESGAVSSDEEDSGGETDIQQESITKTEERQLKNTLLRKYGSHLSSLKLEFSKKKKKGKLPKEARQTLLDWWSDHYKWPYPTEADKIALAESTGLDQKQINNWFINQRKRHWKPSESMQLAVMENLTGQFFSSDDS

SEQ ID NO: 3498 - protein, 358 aa, Ipomoea nil
MDELYGIHSVLAPSNAPSNNNNNVFSLGVDDIHHHHNHHHHQSSMMNGGIVISGDEGQLQGQHHHHHHLLVTSSNDNYYNSDENSKGGGGGVEMMSDVVKAQIASHPLYPNLVSAYIQCRKVAAPPEMAALLEELSKVTQPITTAEIGADPELDEFMESYCEVLYKYKEELSKPFDEAKTFLSSIESQLSNLCKDTFPTTSFNSYHSGDEAGGTSEEDLSCGEVEVAESQEHLNNNSEGDQQIKEMLMRKYSGYLSSLRKEFLKKRKKGKLPKDARVALLDWWNSHYRWPYTTEEEKNKLSEATGLDQKQINNWFINQRKRHWRPSEDMRFALMEGVSGDVAGSMFFDAGGGTGNLGI

SEQ ID NO: 3499 - protein, 354 aa, Vitis vinifera
  misc_feature (92)..(92): Xaa can be any naturally occurring amino acid
MAQRSVPAPFLTKTYQLVDDPSTDDVISWSESGNTFVVWKTADFAKDLLPNYFKHNNFSSFVRQLNTYVRHLSSSLCSHTFLYSILVLSFDXPPVWPVRNREGKKKMKKERYPIRSGFRKIVPDKWEFANEYFKRGQRELMSEIRRRKTTTSSTAQVPPGGKSAGGGTSSPTNSGEDLGSTSTSSPDSKNPGSVETTTTAQFADLSDENEKLKKDNESLSTELAQTKRQCEELIAFLTEYVKVAPDQINRIMKQESCGSGHGGLVGEIGGSVDDDDDDEKDEDPNEESLKLFGVWLKGKKKRGREEKMGYGGPHQKEMKTVDFEAPWMTSKWMRLHKKKNVDRLTTERQEGDWA

SEQ ID NO: 3500 - protein, 414 aa, Oryza sativa Japonica Group
MCDYFLQRMEGDQAGGDLTDIVRAGGGAMPGSVVVDLPSTAAEWQLPAEPMLFPPPPSLSSTTDGCGAGGAAGADIFGGGGGDLFSGLVDPFSSDYSSGADFLDAMPDAMAKVGFDTAVVAGMQMSSPRSGGIKRRKNQARKVVCIPAPTAAGGRPSGEVVPSDLWAWRKYGQKPIKGSPYPRGYYRCSSSKGCSARKQVERSRTDPNMLVITYTSEHNHPWPTQRNALAGSTRSHHSKNSGGGGGSGSKGSQNDKSQQQPSVKEEQKDQATTATTTTTSTITTTNSASPVVVKEEEAALAGSSEALELERVMDTTAAGVVDHSELMDHVFSESYKPMIPETGQPDDFFADLAELESDPMSLIFSKEYMEAKPSGGDHAQEKAMAKELDPFDMLDWSTTTNSSAGSSFEQGKRG

SEQ ID NO: 3501 - protein, 338 aa, Glycine max
MSNSISDPTRIIHSQDPNTTADPQVPLRNLSQVRNRMDSLQHFLSQSINTNTPLTVDQIAMVSSQILSSIHQVIVNGAALVSYSQNSIAAGAPDPPPYPKKPKPEPSVADKAKQTLDSKLEPLEGDDSEIVELDAVEILAEHMHFCEICGKGFRRDANLRMHMRAHGEQFKTAEALAKPSEKASWLRATRFSCPFVGCNRNKLHRRFRPLKSVICVKNHFKRSHCPKMYTCERCRKKHFSVLSDLRSHLKHCGGEARWKCTCGTTFSRKDKLFGHIALFEGHAPALACDEEGKGKQMVEDDEDPMLMSESGFELDDCFLDQEFPEGFFDDFGSIDDYC

SEQ ID NO: 3502 - protein, 441 aa, Solanum chilense
RMSVDVGAPSPRSIQMDEQLNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSRNVVEESVRASVPSLFERRANSTKRVKGFVPYKRCLAERGMSSSTLTGEEREEQRTRLCL

SEQ ID NO: 3503 - protein, 488 aa, Retama raetam
MVEPSPTTGSFSKLLQTVHGSMPSAASATFPVTTACFNTNTVEERKSNIFEFKPHNKSNMVPADFKNHVSEQSIQAEGPGKAQSFASSPLIECEIDVPSNELSLSSPVQMVSSGASTPVEVDSDELNHKGNTITVLQASQVEEVKGSGLPVAPERASDDGYNWRKYGQKLVKGSEFPRSYYKCTHPNCEVKKLLECSHDGQITEIVYKGMHDHPKPQPSRRYSVSMQEERSGKASLAGRDAEPNSTPDLSSVATNDDSREGADRTNDEVDDDDPFSKRRKMELGFADITHVVKPIREPRVVVKTLSEVDILDDGYRWRKYGQKVVRGNPNPRSYYKCTNAGCPVRKHVERASHDPKAVITTYEGKHNHDVPAARNSSHDMAGPAGVVGGQTRIKLEESDSISLDRGMGISSAAENRSNGQGKMLLSEFGNSQTQTSNSNFKFVHTTAGPVYFGVNPYGSIENRSDGPSLNHASSYPCSQNIGRILTGP

SEQ ID NO: 3504 - protein, 441 aa, Solanum chilense
RMSVDVGAPSPRSIQMDEQVNPGEEYAPKIRKPYTISKQRERWSEEEHKKFLEALKLHGRAWRRIEEHVATKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPSNQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSRNVVEESVRASVPSLFERRANSTKRVKGFVPYKRCLAERGMSSSTLTGEEREEQRTRLCL

SEQ ID NO: 3505 - protein, 366 aa, Oryza sativa
MEKVQASCEGDQGICKRGAKGGHPIDQNLVGGMTMSTGVPTTVPPTPALAALKNLLIRVVAAAAGKGLSSSAEEARCLWAKLPAPEEEEEAGQQPERPPSSYRRPPTSTLMAPVGLPPGFRFHPTDEELVNYYLKRKIHGLKIELDIIPEVDLYKCEPWELAEKSFLPSRDPEWYFFGPRDRKYPNGFRTNRATRAGYWKSTGKDRRVVHQHGGRAIGMKKTLVYYRGRAPQGVRTDWVMHEYRLDDKDCEDTMPIKDTYALCRVFKKNAICTEVEELQGQCSMALLEGACQQLLASGGGGSQEQYETPSPPDVPVGSTFGGADADAEDDPDKDDSWMQFISDDAWCSSTADGGAEESTSCVALAG

SEQ ID NO: 3506 - protein, 97 aa, Populus trichocarpa
MKSQSAIADIEVTMVESHANLKIRSKRRPKQLLKVVSALHSMRLTVLHLNVSTVDQIVLYSLSVKVEDDCKLSSVDEIATAVYQMLGRIQEESMLNC

SEQ ID NO: 3507 - protein, 268 aa, Medicago truncatula
MYGNSNFDSDLALLDSIRRHLLGESEFIFGAPTNVSGNTRVFSRSSSFSSLYPCLSDNWGELPLKEDDSEDMVLYGVLRDAVNVGWVPSLEVGSPESVSSVFPLEMTVKPEPDVMPVENVLPVASTAEQVVPEGPKAAPVKGKHYRGVRQRPWGKFAAEIRDPAKNGARVWLGTFETAEDAALAYDRAAYRMRGSRALLNFPLRVNSGEPDPVRIASKRSSPERSSSSESNSPAKRKKVMTAQSGLKTGQVGSQVAQQCTRGGQLLVS

SEQ ID NO: 3508 - protein, 454 aa, Oryza sativa Indica Group
MAPKRPAAASGSASEASDGEAGGAGRRRSPSRSRSPSRSASPSRSRSKTPPHNAAVLSSTPASAAVDFVAASDSDAGADADARLASPRRSRERSPRLHSDSDNSAAATAEAAEAAAAAAFDDGDDEGNATPPPRSRRSSRVEATGVKPISSRPMDASRRPAAASSQSQRRSKRPRSSPTQHSPEQHKRPPRVWNPQDEVTILRALISYRAKNGALPGSSQDTGKLHNMIRGQLSVKASTTQLSDKVRRLKHKYNLILTRVTKSGRDPDLPTEHDREVYELSKKVWGTKSGGAGAGSGGGGGGGGGRVYENAEVVQSDEEQWSRDDSDEDMESGWDDRDHRNRRLKAIVVANGNGNAVTGGRSVHGNGSGKGDVADKGKDMYPYLWEAVEELSKEHPSGTAFRKAFGVLDGSRARAMEEKLNRFRLSEIRQQLRRMDLMKETIKMVLDALEGSDL

SEQ ID NO: 3509 - protein, 443 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAIAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSSYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGMSSSTLTGEEREEQRTRLCL

SEQ ID NO: 3510 - protein, 446 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAIAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPSPNGSPGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLGERGMSSSTLTGEEREEQRTRLCL

SEQ ID NO: 3511 - protein, 192 aa, Triticum aestivum
  misc_feature (148)..(148): Xaa can be any naturally occurring amino acid
  misc_feature (170)..(170): Xaa can be any naturally occurring amino acid
  misc_feature (174)..(174): Xaa can be any naturally occurring amino acid
MVKSAQQQPQGGLGGDGGNAVAARQGGGGGGRQQQQQYKGMRMRSWGSWVSEIRAPNQKTRIWLGSYSTAEAAARAYDAALLCLRGSAADLNFPVHLPFHVPAGAMSPKSIQRVAAAAAASASSSPLQPPHTMASSASWPGAAPPCGXGDNASSFGSPEDRSARHSNADXDETXAHGDDGVDYDALADIDAS

SEQ ID NO: 3512 - protein, 278 aa, Oryza sativa Japonica Group
MDAQYNPRTVEEVFRDFKGRRAGLVRALTADVEDFFRQCDPEKENLCLYGFPNEHWEVNLPAEEVPPELPEPALGINFARDGMQEKDWLSMVAVHSDAWLLSVAFYFGARFGFDKNDRKRLFGMINDLPTIFEVVSGKSKAKPPSANNHSNSKSKSSNKTKSSEPRAKQPKPQPQPPVKNEGREEEGGPDDEEGGGGGGGGGREEEHGETLCGACGESYGADEFWICCDICEKWFHGKCVKITPAKAEHIKQYKCPSCSGGNGGGGGVSGNGKRARPS

SEQ ID NO: 3513 - protein, 446 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPQSTFSIVPPRPSYYFPSPNGSPGPNQSGAATHLPWGSSCAVPCTQVHSPIPMKGRPLFNDRDLEGKETQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 3514 - protein, 175 aa, Solanum lycopersicum
  misc_feature (172)..(172): Xaa can be any naturally occurring amino acid
IKGSPYPRGYYRCSSSKGCSAKKQVERCSKDASLFIITYTSSHNHPGPNLPKDSVKQEPVVDQHVSLEDNNDEDDDDDDDNDTQSCKTPLNSTTTSTSIPQGILEENLFTDNFLGTISYDDFLPLSYPQLMKFPKSELSEENDFYDELGELELPPSSSTSFAGIFEEAILVXPSS

SEQ ID NO: 3515 - protein, 272 aa, Plantago major
LKDPQFSRILYLRSNVDLKDKWRNMSVLANGWGNRERARLALRTAHSSHRLRESSRPHSTGSQSDDEIGDGRMHTASGSSSPNDGEKTSVVRLENLILEAINDLREPGGSNKTSIAVYIEDQYWAPPNFKRILSAKLKQMAAMGKLIKMNRKYRISLASALSEGRRNSSIPIPAERQRIYQRTGGHNLGHYMEIQSDLDLAKMSNMTPEEAAAAADEAVAEAEAAVAEAEEAEREAVAAEAEAEAAQKFAEAALKTAKEKRSPPMSARMIPV

SEQ ID NO: 3516 - protein, 55 aa, Solanum lycopersicum
IKGSPHPRGYYKCSSMRGCPARKHVERCLEEPSMLIVTYEGEHNHPRLPSQSANA

SEQ ID NO: 3517 - protein, 229 aa, Triticum aestivum
LRDLLPNCDQKRDKASFLLEVIEYIRLLQEKCQKYESGIPEQNNVDANCTRRDKVYYRSRWRNTQNISQAQGGGLSATTEDMNKEQYSSKGIASAPAASLFNTQSAREISTAPGSSQNIAENSMPTNQLPWLSMSTMNQNCDASNGLLSKHDTQMPQDDSQSLSSAYSQGLLHKLKEALQKSGVDPSQTKISVEINMDRRARANAHIHDSSKATEGKEPVHVAKRLRCD

SEQ ID NO: 3518 - protein, 176 aa, Triticum aestivum
NFQVRRFHGGSARAFYRRCSAAPEPASHPFFLPPSFPAGARMAPTHTQHVQARPRLLRPQAGLPPRAQPMKTAAAAPAAVKLYRGVRQRHGCKWVAEIRLPRNQTRLWLGTFDTAEEAAHAYDQAACRLHGDAARLNFPDKAASSRPPLNAAVDAKLQVISRTIAASKNHTPRPRQ

SEQ ID NO: 3519 - protein, 60 aa, Solanum lycopersicum
IKGSPHPRGYYKCSSVRVCPARKHVERALDDPTMLIVTYEGEHNHSLSVAETSSLILESS

SEQ ID NO: 3520 - protein, 238 aa, Triticum aestivum
MVTVQDEMRKGPWTEQEDLQLVCTVRLFGDRRWDFVAKVSGLNRTGKSCRLRWVNYLHPGLKHGRMSPQEEHLIIELHARWGNRWSRIARRLPGRTDNEIKNYWRTHMRKKAQERKTNMSPSSSSSSFTYQSCLLETAPIIRMDGGSTHNGTTCFSSVLKSNQSVMDGYSMDQIWKEIEAPAMLPIDKKACSNLPCPVLPSPMGDRYCPPEVVWKMDNGDLKMLAPQFGYGNGERSCY

SEQ ID NO: 3521 - protein, 161 aa, Plantago major
SNKSMAGQVSLSGPASAKASADDNGSANLSEKPRIRHQHSQSMDGSTSIKSEMFMSGSEDPSSVESKKAMSAAKLAELALIDPKRAKRVWANRQSAARSKERKMRYIAELERKLQTLQTEATTLSAQMTLLHEAQMLLHRKMVNLNCVCRQWNSKYTCKML

SEQ ID NO: 3522 - protein, 55 aa, Solanum lycopersicum
IKGSPHPRGYYKCSSMRGCPARKHVERCLEDASMLIVTYEGEHNHPRLPSQLANT

SEQ ID NO: 3523 - protein, 283 aa, Arabidopsis thaliana
MGASVGGDGDAAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESEKSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 3524 - protein, 345 aa, Solanum tuberosum
MDDEMYGFHSTRDDYADKALMSPENLMMQTEYNNFHNYTNSSILTSNPMMFGSDDIQLSSEQTNSFSTMTLQNNDNIYQIRSGNCGGGSGSGGSSKDHNDNNNNNEDYDEDGSNVIKAKIVSHPYYPKLLNAYIDCQKVGAPAGIVNLLEEIRQQTDFRKPNATSICIGADPELDEFMETYCDILLKYKSDLSRPFDEATTFLNKIEMQLGNLCKDDGGVSSDEELSCGEADASMRSEDNELKDRLLRKFGSHLSSLKLEFSKKKKKGKLPKEARQMLLAWWDDHFRWPYPTEADKNSLAESTGLDPKQINNWFINQRKRHWKPSENMQLAVMDNLSSQFFSSDD

SEQ ID NO: 3525 - protein, 232 aa, Zea mays
MELELEAAARRFHLWFRGLRSLRRDLASARWSDDPTAQLPAQVGRFVAHLESYCAARAGLDPVWTLSAPWATPAERGAAYWLAGWRPTTLVHLLYTESGRRLEAQLPDLLLGVRSGNLGDLTPAQLAQVDDLQRRTVAEEDALAREMALVQEGHGVVVLPAAPDGSGGLDVAGLVRRARAVLDRADALRLRTVKRAVEILEPAQAAELLVAAADLEIGFREFGLKHGSGRMT

SEQ ID NO: 3526 - protein, 438 aa, Zea mays
MNFLESIAVNGHRDRQHGGVMSRQSMVAVEQLTGPASARPAHTCAAQPHAHQLLSARYDHRGACASQVELPDRISPSNASTFCTSMYSSSSSSAAAADSSKSCRRAGALPFLPHPPKREQQQQQQSSSSPSLLVCTDLGNGGQDEAEAEHPAELKDFLNLSGEASWRGGFHGESSGVAFRFGEQVEFQFLSEQLGIAITDHDESPRLDDIYDRPPQTSSCPVLSCSDQEEGLQRAGSPVKAQPSSSRAASCNNKPRLRWTLELHELFVKAVNKLGGPEKATPKGVLRLMKVEGLTIYHVKSHLQKYRFAKYLPETKEDMKSSSEDKISKSEMPGSNAGRKKILRSLQVAEALRMQMEVQKQLHEQLEVQRQLQVRIEEHAKYLHKILEQQKARNSLSATTSSIETELSESTKEEKPETQADTSSAQLPNKKNSDTDME

SEQ ID NO: 3527 - protein, 351 aa, Lupinus grayi
  misc_feature (4)..(4): Xaa can be any naturally occurring amino acid
  misc_feature (202)..(202): Xaa can be any naturally occurring amino acid
  misc_feature (207)..(207): Xaa can be any naturally occurring amino acid
STYXSSGPYPYFSSSSSPYHPFAFFNPENSSSNNTFSHDLLSFPYNIPTTHHYHAPTQETLSNFADCAASAAMFKTDVSGNSNFGFSNFLAKKPASKKDRHSKIHTSQGLRDRRVRLSIEIARKFFDLQDMLGFDKASNTLEWLFNKSKKAMKELARSKNSCSGVVANSFSSSDSEFEVVSMINPDSIDATPEGVVVDSKDXKLKRXKIKESREKARARARERTNKKMLSSMKKKYPAIENPQMFNQLRLPFHHPENSAKSPNNKSILSHHHNPHLVCSETPRDDFNLFEESIVIKRKLKQNHVIPKESNFNNNTEHHSFPILSPNLDANNGANGRSNFCAVTNMNLSTGM

SEQ ID NO: 3528 - protein, 263 aa, Arabidopsis thaliana
METLHPFSHLPISDHRFVVQEMVSFHSSSSGSWTKEENKMFERALAIYAEDSPDRWFKVASMIPGKTVFDVMKQYSKLEEDVFDIEAGRVPIPGYPAASSPLGFDTDMCRKRPSGARGSDQDRKKGVPWTEEEHRRFLLGLLKYGKGDWRNISRNFVVSKTPTQVASHAQKYYQRQLSGAKDKRRPSIHDITTGNLLNANLNRSFSDHRDILPDLGFIDKDDTEEGVIFMGQNLSSENLFSPSPTSFEAAINFAGENVFSAGA

SEQ ID NO: 3529 - protein, 178 aa, Zea mays
  misc_feature (146)..(146): Xaa can be any naturally occurring amino acid
MAKMGLKPDPVTPNPTHNNAKEIRYRGVRKRPWGRYAAEIRDPGKKTRVWLGTFDTAEEAARAYDKAARDFRGAKAKTNFLELNEKVLSGGGGFARSPSQSSTLDYASPPAVTDGIVPPQLELSLGGGGGACYQIPMARPLYFLDXLMGVGNGGRGQLPVSPGDACLLRRNGLCGAQE

SEQ ID NO: 3530 - protein, 364 aa, Lupinus microcarpus var. densiflorus
STYISSGPYPYFPSSSSSASYHPFAFFNPENSSSNNTFSHDLLSFPYNIPTTHHYHAPIPETVSNFADCAAASAVMFKNDVSGSNFGLSNFLAKKPASKKDRHSKIHTSQGLRDRRVRLSIEIARKFFDLQDMLGFDKASNTLEWLFNKSKKAMKELARSKNSSSGVVANSFSSSDSEFEVVSMINQDSIDATPEGVVVDSKDRKLKRAKIKESREKARARARERTNKKMLSSMKKKYPAIENPQMFNQLRNHPENSAKSPNNKLVSSHHHHHHQPHLVCNETPRDDFNLYEESIVIKRKMKQSLMSSSPPHNQNHLIPKESNFNNNTEHHSFPILSPNLDANNGANGRSNFCAVTNMNLSTGM

SEQ ID NO: 3531 - protein, 344 aa, Oryza sativa Indica Group
MENKPNPNRGFTRGLQPGAGAEDSRRLFQRLWTDEEELLILRGFLDFTARRGTTFASHQYDTGPFYDEIRRRLSFDFTKSQLVEKLRRLKKKYRLCAARMASSPHAAAAGFAFRTPHEGAIYDLARHIWPPALKRDGTASDDDDINPAAAAATAAVMTPVAMEDGFGGSAPTPTPTPRGRGGRRVRRRMAQEQEAAALPSAPALTSTDGAHQEPLVAAMENTLPQIAQLPPVSETEPMPVIANGANEEAVRSVLSRLLKEFITSFAVVGQTGPGMGLNMGFGGAGLNADIAGLGFGIAGLNPGVPGADRWRQQQILELEVYLKRIELVREQVTAALDELRSSEG

SEQ ID NO: 3532 - protein, 248 aa, Physcomitrella patens subsp. patens
MEGASVSTNPRSVDEVFKDYRGRRGGMLKALIADVEEFYRQCDPEKENLCLYGYPDESWEVNLPADEVPPELPEPALGINFARDGMQRKDWLSLVAVHSDAWLLAVAFYYGARFDKNERKRLFNLINELPTVFDVVSGKKPVKEKASVNNNNNSNNNNNNNNNNNNSGGNKIKSAAKVDEDYFEDDEEEHGDTTCGTCGGSYTADEFWIGCDICEKWYHGKCVKITPARAEHIKQYKCPSCSNKRART

SEQ ID NO: 3533 - protein, 599 aa, Physcomitrella patens subsp. patens
MSDTVEFYLITRSIIKVKNFRRTGGPTRRSSKGGWTPEEDETLRRAVQCFNGKNWKKIAEFFTDRTDVQCLHRWQKVLNPDLVKGAWTKEEDDRIMELVNKYGAKKWSVIAQNLPGRIGKQCRERWHNHLNPSIKREAWTQQEDLALIRAHQLYGNKWAEIAKFLPGRTDNSIKNHWNSTMKKKVDPLTANDPISRALAAYQAQQEQSMNSGSGAGQVDSGSIGGRTGPPMSETTTSSDPSRHNSNTRGLGRTSHYVEQDTKSTGSAPPPPYPDIYPNRGKDQQRNASHLQPKKEESDHDLIGQSLGFSGWSSGQLPVYSGGFSGVSLGTSSLSNSVTEQLVPSVQHKRAMSNIELTRIASFSNSFPRIPAPESSSQAYRSSSMSVPLPDLGSLFASSHMPMAAHNDTQPLSSFNGTGVPPGEETLAMMGSKQNYEPLRRCNLPPSQPSEGDAAFEDSGASVRCDSQMAEPMDKAMDQDVSEFPSDNLLRDSSEAVNEYQSQSPMLTEEDLEDKGDSSRVQDRDGLFYEPPRIVDPPFMNYDLVSSLNAYSPLGVRQMIMPAGNCITPPNYLQSPFQGKSPQSKLRSAAKSFSGSPSIL

SEQ ID NO: 3534 - protein, 256 aa, Zea mays
MDSPLYQQLQLSPPSPKPDQSSSFYCYPCSPPFAAADASFHLSYHIGSSATDTHPQTVVNSPEIPVFPLMEQTPAPATEQGAGACGAQGAGVSLDRAYAAPRKDWHSKICTAGAMRDRRMRLSLDVARKFFELQDMLGFDKASKTVQWLINTSKAAIQEIMADDASSECVEDGSSSLSVDGKYNPAELGGGNEKSNGNACSEWKKPAMVRKAATTTKPPRKSGNNAHPVPDKETRAKARERARERTKEKHRMRWVK

SEQ ID NO: 3535 - protein, 364 aa, Lupinus microcarpus var. densiflorus
STYISSGPYPYFPSSSSSASYHPFAFFNPENSSSNNTFSHDLLSFPYNIPTTHHYHAPIPETVSNFADCAAASAVMFKNDVSGSNFGLSNFLAKKPASKKDRHSKIHTSRGLRDRRVRLSIEIARKFFDLQDMLGFDKASNTLEWLFNKSKKAMKELARSKNSSSGVVANSFSSSDSEFEVVSMINQDSIDATPEGVVVDSKDRKLKRAKIKESREKARARARERTNKKMLSSMKKKYPAIENPQMFNQLRNHPENSAKSPNNKLVSSHHHHHHQPHLVCNETPRDDFNLYEESIVIKRKMKQSLMSSSPPHNQNHLIPKESNFNNNTEHHSFPILSPNLDANNGANGRSNFCAVTNMNLSTGM

SEQ ID NO: 3536 - protein, 233 aa, Zea mays
  misc_feature (225)..(225): Xaa can be any naturally occurring amino acid
MSEDWDLFAVVRSCSSSVSTATINTNSRGGDEGRANCKQHDLPPLFQHIHGDISRESSSCNELQDSCKPFLPVTTTWSSPLPPPPVVSSAPNILMKQEQGLIESQDQKPPLGVRVFPPPTTISSSSSVFVFRGQRDHLLQQQPQAPLRSRKRKNQQKRTICHVTQENLSSDMWAWRKYGQKPIKGSPYPRNYYRCSSSKGCLARKQVERSNLDPNIFIVTYTGEXTHPRPTHR

SEQ ID NO: 3537 - protein, 407 aa, Zea mays
MDSTSCLVDDASSGASTGKKPAPAPAAATGKPLQRVGSSGTSAVMDAAEPGAEADSGGAGRAPGGVSGKLPSSKYKGVVPQPNGRWGAQIYERHQRVWLGTFTGEAEAARAYDVAAQRFRGRDAVTNFRPLAESEPEAAVELRFLASRSKAEVVDMLRKHTYGEELAHNRRAFAAASPAASPPPENNRRPPAASSSSSPAAAREHLFDKTVTPSDVGKLNRLVIPKQHAEKHFPLQLPAAAAAGVGSGGECKGVLLNFEDAAGKAWRFRYSYWNSSQSYVLTKGWSRFVKEKGLHAGDAVGFYRSAGGKQQLFIDCKLRPNKTTTTAAAFVNVNAMTTTAAPPLAAVKAVRLFGVDLLTTPRPAAVAPEQEEVTVANKRARDAMATAASTPAPVHMVFKKQCIDFAR

SEQ ID NO: 3538 - protein, 252 aa, Vitis vinifera
MENCLYSGWAQEADCTQCDAAPVLPWLPPPHVSASFQFHGFPSWSLPVEKMATEDRSDERTATASKSHSQAEKRRRDRINAQLATLRKLIPKSEKMDKAALLGSVIDHVKDLKRQAMEVSDVFTVPTEVDEVTVDCEFDQGLVPNNTIKTPENIFIKASVCCEDRPELFSELIRALQGLKLTTIRADMASLSGRTKSILVLCSKDDSNSVCISTLKQSLKVVLSRIVSSSTASNYRITSKRQRFFLPSNFPQ

SEQ ID NO: 3539 - protein, 240 aa, Arabidopsis thaliana
MAREKIQIRKIDNATARQVTFSKRRRGLFKKAEELSVLCDAGVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 3540 - protein, 132 aa, Chlamydomonas reinhardtii
MADFPKTVEEIFDDFQRRRTGLLKALTDDLEELYQQADPEKDNLCLYGTREGTWSVELPAEEVPPELPEPCLGINFARDGMQKRDWVALVAVHSDSWLLAVAFFYAVKLDAAGRLRLFKLINQHQTLFESVS

SEQ ID NO: 3541 - protein, 220 aa, Picea sitchensis
MAREKIELKRIANASARQVTFSKRRKGLFKKAEELSILCAADVALIVFSSTGKLHDYSSSSMKILDNYNLYSSTIQKDGRPNPELESPDMKKRKQQVEDISQTLRNMHGKELEGLSLNDLQQLEEQLNMGLNCVRLQKDEYMVKEINGLQDKIKEGYGLRLENNDADESFFIGLSENKDPQSSASVTSSAFNFRLHKSPNKDYEDSDTSLQLGLSSQSKI

SEQ ID NO: 3542 - protein, 443 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAIAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTQSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGVSSSTLTGEEREEQRTRLCL

SEQ ID NO: 3543 - protein, 176 aa, Triticum aestivum
MSPAEMESDKMVEVEAAADPEERTASGDPKACDDCNTTKTPLWRGGPNGPKSLCNACGIRYRKRRRVAMGLDPEAKRKPKRDDAALSISKAAEAAEATSTKEEEEDKDKAGDQKAGDEKATKKKTTHTVELHMVGFAKDAVLKQQRRRRRRKPSCLGEEERAAILLMSLSSGVIYA

SEQ ID NO: 3544 - protein, 441 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPLHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSRNVVEESVRASVPSLFERRANSTKRVKGFVPYKRCLAERGMSSSTLTGEEREEQRTRLCL

SEQ ID NO: 3545 - protein, 285 aa, Glycine max
  misc_feature (165)..(165): Xaa can be any naturally occurring amino acid
MQEPSLGLMGEVSGDHHRQLKAEITTHPLYEQLLAAHVACLRVATPIDQLPLIDAQLSQSHHLLRSYVSHNTHSLSPHHRQELDNFLAQYLIVLCTFKEQLQQHVRVHAVEAVMACRDIENALQALTGVSLGEGTGATMSDDEDDLQMDISLDQSSAEGHDMMGXGPLLPTESERSLMERVRQEFKIELKQGFKSRIEDVREEILRKRRAGKLPGDTTSVLKAWWQQHAKWPYPTEDDKAKLVEETGLQLKQINNWFINQRKRNWHSNSQSVNSLKSKRKREYAH

SEQ ID NO: 3546 - protein, 533 aa, Pisum sativum
MWDLNGSPSKRKDQESEGCSSPKTSLDGDEDKAKRVGVGGSVSNSSSSAIVIEEDSEEDNNNNNNRSMVKKKNSKIFGFSVTQEQEQEQEEEESLDSENFPVTRNFFPMDQEAENMVVASSGGNGTSSCSSTFPRAHWVGVKFCQSETLGSGKSMEVSSSSQPMKKSRRGPRSRSSQYRGVTFYRRTGRWESHIWDCGKQVYLGGFDTAHAAARAYDRAAIKFRGVEADINFNIEDYEEDLKQMSNLTKEEFVHVLRRQSTGFPRGSSKYRGVTLHKCGRWEARMGQFLGKKYVYLGLFDTEVEAARAYDKAAIKCNGKEAVTNFEPSIYDSELNTAEPASSGSDHNLDLSLGNSSSKHMNNTQSFGNNTSNVANHDQSNWQNGGNINKPKLVNILPKPYNRPNNMEPYGRDLHGENEALRMLSQTHLQSSSPNGIHRYGSLSRSTTNVHSFAHTNHQPPNFHFPSSSYGGRVGSDLSLSTNNHQQQQQQWQPGSHYLSSAAAASSGFPPQIRTPSSQTWLHKNGFHTLMRPS

SEQ ID NO: 3547 - protein, 340 aa, Solanum tuberosum
MSNKEDEQYHQYDVGEVKKSSDLGGGIGKLYGWPTSRIVRVSRASGGKDRHSKVLTSKGLRDRRVRLSVNTAIQFYDLQDRLGCDQPNKVVEWLLKAAAPSIAELPPLEAFQDTLQLSDEKRSSEPRFASVDVEMDDDLNYNQQQQQQQPCCSNSETSKGSGLSLSRSDSRVKARERARERATEKVNTVANHHQNMHPSSSFTELLTGGMNDNNNKSSVNDDQNTPRQWSTNPLEYFTDNQIYLGNPLRPVSSPMFSITGDHRPEMQHFPFGGDLVPVVTSTNNEYNLNFSISSSSDFNRGTLQSNSSSTLPQYQRYGSYLGSTTEYDNRHSDQKGKGKK

SEQ ID NO: 3548 - protein, 443 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSMKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGVSSSTLTGEEREEQRTRLCL

SEQ ID NO: 3549 - protein, 292 aa, Triticum aestivum
  misc_feature (270)..(270): Xaa can be any naturally occurring amino acid
NGALLSGDRQQGDTESSHGVDASSKELSKPECSGGAGQDEGPSVSCPKKRKRPSQDRGVKHVQEGSQQLATLAAKQEKDDDDKDEPKRPVGTSRKSNGKQTEDKSDAPKEDYIHIRARSGQATNSHSLAERVRREKISERMKFLQDLVPGCSKVIGKAVMLDEIINYVQSLQRQVEFLSMKLSAVNPALDFNIERILSKDLFQSQGTASSTFGFLPDIGHQFLHPPKHSQAALHSIVNPADAFGRVTNAPVGCTFKEATHQVSNNFDGEXHNVIGMPFTLFNDQGIHMGNLE

SEQ ID NO: 3550 - protein, 454 aa, Zea mays
  misc_feature (22)..(22): Xaa can be any naturally occurring amino acid
MTNAGAATGAALGARTARSCDXCMRRRARWHCPADNAFLCQSCDVSVHSANPLARRHHRVRLPSASCSSPPRDPDAPTWLHGLKRRPRTPRSKPGGSNKHEAAPSSIAAAASAAVPDLEAEAEAEAEESGSGILGDNDDDHGFQDDDENLLYCVPVFDPMLAEFYNPVADEGEQKPACLMLPLVETSPEFASGGLAEADGLSGFDVPDMDLASFAADMESLLMGVDDGFDDLGFLDEQKPQVNADVDLEAMAAPEPEREDKKRKRDGFDYLGFLDEEKPQVNADVDLEAMVAPEPEREDKKRKRTDVILKLNYEGVIASWVRDGGSPWYHGERPHLDDPYELWLEFPATGSRGLFGGTMTAVTGGEREARVSRYREKRRRRLFAKKIRYEVRKLNAEKRPRMKGRFVKRTTLPPLPRPPPPSQQQQKKKQLPRALPHVGMVLAPPPGADGRFRF

SEQ ID NO: 3551 - protein, 76 aa, Triticum aestivum
MSSESLGKNSKIMGGRERKEVNSTAKHFVDFTEAEEDLVFRMHRLVGNRWELIAGRIPGRTAEEVEMFWAKRHQDQ

SEQ ID NO: 3552 - protein, 303 aa, Arabidopsis thaliana
MEKMIEPRDNTRESEDEDALKLPGFRFHPTDEELVGYYLSKKVLLKKTSKIDEIVSQIDIYKFDPWDLPRSRNTEKESYFFCKRGRKYRNSIRPNRVTGSGFWKATGIDKPVYSDGSNKAVIGLKKTLVYYLGSAGKGNKTDWMMHEFRLPTANDTIPGGPTHSNPTPTSLLHAEVWTLCRIFKRTVSSRKYTPDWRELANGKRVKQQQSNYQEAYINFGDNESSSSTNVMNVREGKGNYERSVFQLQQTPYQHQNQPILMDTTHVDSFQHFSNDNIHHETYETWPDELRSVVEFAFPPSFLS

SEQ ID NO: 3553 - protein, 227 aa, Hordeum vulgare
MSKTPGKSPRTPRRTLESYTIKGSDGVIRPGDSVLMKAPDSSKPPYVAKIEEIEAAGPRGANVKVKVRWYYRPEESIGGRRPFHCEKEVFLSDHQDVQSADTIECKCNVYSFRDYTKLAAVNPEDYFCRFEYQSITGSFVPDRIAVFCKCEMPYNPDDLMIQCEECSDWFHPACIGKTIKEAKKLENFTCEGCVAENGNANGVKNENSHESTGESDEKQVQSKRRRR

SEQ ID NO: 3554 - protein, 115 aa, Chlamydomonas reinhardtii
MDGEQWGGGDDIKKGAWTPEEDALLTKLIATYGTKNWSVVAAGIKGRSGKSCRLRWHNQLNPDVKKEPFSEWEDAVIILAHEVHGNKWAAIAKLLSGRTDNSVKNHWNATLKRKV

SEQ ID NO: 3555 - protein, 357 aa, Glycine max
MDGREGMAFPGGSVPYYMQHRGGGVSGSGPGTGTQSGGFQPPSGFRALSNVSPGSAFKVESHSYSHSQSQPQHASFSHGINIGSSPDGGGGGPSSGEPVKKKRGRPRKYGPDGSVSLMLSPMSATASSTPGSGTSSEKRPRGRPPGSGRKQQLATLREWMNSSAGLAFSPHVITVGVDEDIVAKLLSLSQQRSRALCIMSGTGTVSSVTLRQPASTNASVTFEGRSQILCLSGSYLVAEDGGPSNRTGGISVSLSSHDGHVIGGGVAVLIAGGPVQVMLCSFVYGGSKTKSKLGTTIKDESSEPPPQHNDKLASPASAPAPPGQNYLPLSATNLWPGSRPAELKSTHMHTGIDLTRG

SEQ ID NO: 3556 - protein, 237 aa, Phalaenopsis hybrid cultivar
KINRQVTFSKRRSGLLKKAHEISVLCDAEVALVIFSAKGKLYEYSTDSCMDRILDRYERYCYAEKALQITEPESQGDICNEYGKLKNKIEALQKSRSHLMGEQLDSLSIKELQHLEQQLETALNHIRTQRIQLLLNCITEFQRKEKSLLEHNSLLEAKLCSFQLDPQITETATQNPNRKQQKQDQVNSSPSPFLPPNHLPTLNLGTYPASDGEEAEDPTLLQMNSISLPPWMLRSST

SEQ ID NO: 3557 - protein, 407 aa, Lolium perenne
MLLCDLSSYQEATGSNSHGGDVAVSNHVLLSPLFPPAATTTTLLPRPPPLLLEEPARAKRKRSQPGNPDPGSEVIALSPRTLVATNRFVCEICNKGFQRDQNLQPHRRGHNLPWKLRQRSLAPLPSRPGDAPRKRVYVCPEPTCVHHDPARALGDLTGIKKHFSRKHGEKRWKCERCGKCYAVHSDWKAHVKNCGTREYRCDCGILFSRKDSLLTHRAFCDALAEESARLLAAANNSITISTTTCNNNSGSSDNSNNNNLITTSNSSPLFLPFSSPPPPQSPNPLMFLSQEPQHHQLFPPFQPLTYLDELPMNSAITDSVSTIAADTVTYRLSQEGSMTTHAGGRRLTRDFLGIDDSGDQVDELQLPLCATAYQGRSIATAACCSTDMTRQYFGRLPPVNETWSHNF

SEQ ID NO: 3558 - protein, 482 aa, Triticum aestivum
  misc_feature (265)..(265): Xaa can be any naturally occurring amino acid
METLRDMALPPGFGFHPKDTELVAHYLKKKILGQKIEYDIIPEVDIYKHEPWDLPAKCNVPTQDNKWHFFAARDRKYPNGARSNRATVAGYWKSTGKDRAIKVDKRTIGTKKTLVFHEGRPPTGKRTEWIMHEYYIDENECQACPDMKDAFVLCKVTKRIDWTSENGNEVGNNNPQPQQANVAAILAVSVEQPDTAASSIIGDELPSDAATVAIPAHTTPDGNDDLKEWLEELLDTSFDPSANTAVDSVSAQLSPDEQNAESSNXGAMAPEGGNWDYASPNQTGVDDTDFLLPDDIHSMLYPGSDDFTSWQQTYFTAADPFSLSNNFMDEFQMKELQLPLENNGPNLYEPADTGIVVRTRHGGTSAASVPPYKARLQQSLGRMVTSSSESINQTIKFVDNNGHLDLMTNVKHQKKHVRDITSARQSDAEKCGSHNNQGFLRGVQRAFRGCSATGLNILVALCMVGVAAAILHHGRHRGGISL

SEQ ID NO: 3559 - protein, 475 aa, Kluyveromyces lactis NRRL Y-1140
MDDLGEQLSEGHKDDYDNGIGSVPGGSGSNGKGKSQRTSFNDFVRKLFLILESEEYTSIISWSPDGKNFIVLDTNKFTTDILPKHFKHSNFASFVRQLNKYDFHKVKRKKNEVSEGIQNAWEFNHQYFRRHDEAGLDNIRRKPSSQKKILVDENSVIVRKLGGAPGDDGAFIAGDEEGMTAKMLLKNTVNKTKFNQLKRKVEDMENQVQYLTNENHNMKLDLQKIQSKYNMALESLLSTESFNSQLISNFQILVDALSQQGLKVPVGLSFEKGNSRADNKSHQQRQISDSTGSTPNANIPGLSVNTTLQKQEPIELLPMDQHPVLRPGFHVLLVEDDSVCIQLCSKFLRKYGCSVEVVTDGLSAISTLEKQRFDLVLMDIVMPNLDGATATSIVRSFDNETPIIAMTGNIDDQDLVTYLQHGMNDILAKPFTKDDLHSMLIRYLKDRIPLSEQRQNSNNDPKAYVEEPMLKKPHI

SEQ ID NO: 3560 - protein, 316 aa, Zea luxurians
LGVPSVKHMFPFCDSSSPMDLPLYQQLQLSPSSPKTDQSSSFYCYPCSPPFAAADTSFPLSYQIGSAADATPPQAVISSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDHKPKGNCRGEGKKPAKASKAAATPKPPRKSANNAHQVPDKETRAKARERARERTKEKHRMRWVKLASAIDVEAAAAASVPSDRPSSNNLSHHSSLSMNMPCAAA

SEQ ID NO: 3561 - protein, 347 aa, Lupinus arboreus
SSGPYPYFSSSSSPYHPFAFFNPENSSSNNTFSHDLLSFPYNIQPTHHYHAPTQETLSNFADCAASAAMFKNDVSGNFNFGFSNFLAKKPASKKDRHSKIHTSQGLRDRRVRLSIEIARKFFDLQDMLGFDKASNTLEWLFNKSKKAMKELARSKNSSSGAVANSFSSSDSEFEVVSMINQDSIDATPEGVVVDSKDRKMKRAKIKESREKARARARERTNKKMLSSMKKKYPAIENPQMFNQLRLPFHHPENSAKSPNNKSILSHHHNPHLVCSETPRDDFNLFEESIVIKRKLKQNHVIPKESNFNNNTEHHSFPILSPNLDANNGANGRSNFCAVTNMNLSTGM

SEQ ID NO: 3562 - protein, 260 aa, Avicennia marina
MGRKCSHCGKIGHNSRTCNTATKGSIGGGVIIRLFGVQLDISSSSNSSSIPIKKSFSLDCLSSTPTLSSSSLSSSRAPTNNQHPDKTSVGYLSDGLEGRAPDRKKGVPWSEEEHRTFLIGLEKLGRGDWRGISRNFVTTRTPTQVASHAQKYFLRQASLNKRKRRPSLFDLHCGGGSETVSTNTRQGFRIDLNSRGEDEKSRDQECGEIFPDKNLIWAYESSTSKNRSPNAAASHPELELTLSAQGRMGQREPSLLIGAH

SEQ ID NO: 3563 - protein, 2059 aa, Chlamydomonas reinhardtii
MDITSPRDMAVASASGRQASEAPGTGPPPFSHSRLRSYASKVEGLLDPKMVLSSSVALAGSGLADPFPSASSSSASQQLLTPKSARFAGTGGGSNGIAAARPGGHNQPSAAALGSNGQHSHQQGSQPQQPQQQPASAEELAAALNQIQTLKAEIAGVETVLGYLKGNEAATTTMGRKAHKLPSQQQLRQRADALAGALDEALPPGSITAKYGTGAGAAVTGGLEPAFWSGGEARRDFDMLDMVQREVARQCEAARQVAASCSERGRIIDKLADRHAELYGAVAAAARSATEAQRGLSERLAGVTTRASEQATEIARLRSELAARGAEAEDLRQQLAETRTQHEHYVWDCEQELETLQGQSDILAAEVEHLHVRLAEAVADKDAALSRGLARLEADLEAVTDERDDLSQRIRFLERQLHKLRTEMNTAVVTAVAEVQTDPVNWAAEEPEDVPDDVSDTPSLAEIRARYAAHGYGALSPEERLRLGLPAHMDGEGGGKSGKGKKRKRALGHFQWTVNAIATMYYDKMKADARSDLEGNPRQRLADFAVDWHMTRFGLRNLAELNLLDLIASVRQHYKTAVRVRWFGQFTGLVEVGDQVDTTPHVSFYLHLLACLAAPNSLVSLFPDTAASGGAASEEAGGGTPPVAVKAAVLPEAIKAIYRYLNEPESATAFLARACDPLTDPDSQTVPLDPLVALLMAEYQKRWERNAAHLRALFRAGDYDGDGLIGYDEFVAIVRQLLPDSGDRAFTKMYGEAMRKLPAGQNLLDVETFLGVARAFGCDRWRIDAGPTASAYGGGPYGIVTSPSGAAAGGGGLNGPSRSGSVLGSAPSMGALRARATSAASNLRRTESVVGLSEPDRALLRVLDGAVEGLEPPLEEQLTSLLDKLRTSAAATAQRAEALTAATAALPGFELGGGPNAKELATAAAEDNAMVSVAWGGISKLEAQYSHFKTTYEDRTDPAAAWLAFRMLLASLAAAAAGARVKPNPSNARSRPGSAKSQAGGDRHWAGAKALARLTVPAVPFRAGSSAAASRPGTNGSLAASGPSGLPGSPNELITSLEKVIWHSRRILKSGNFQEHHVAHTKLEHANLTQASDLTSWARAATAWLGAAMRLQAGDAAAATQQGGGIFGGVAARVSHARDSHRRRRRHLSSSENVFSTREDDGAEQLTLLVPVMRRLLLAQLLKAWLRDMRQQLPAEPQAAQALAVLIRKLFEVHVGSVVQRAALEYFHISKAGGTSWTVAAKSNKCPRPAARGCRVKEFDDSCRWLNRTALLDVGVPQGRHHKAPWGRYGHVDRSTEYATCAQRYEYVRRRGFVYTTNEYTLHRDLAPERSLDERAEVLSAEQVVERLQSPEGQDAWHSAHLCPQFVNILTVREPRQRLLSNINFMLPFLQSQLFPIRKRNDTQSAAQVADFQAIFCNAPSETWETVVPPVADNYNVRTLLGELGFHLPLWSVGPEHVAAAESQLLRFDMVMDLNAGSGAADLVQKQGLGWHVTLAEVHALDSSQRQDRVPCGLGNLTKLLERQGPDQQWYSFARVEPPCHLDLSKLIQAGTKSFFNNPLLSDIVLVCPDGRALHCHSVILAAASRRLAAALKQGNWTPGQQMPVKGVDSDALETLVYAFYTAECPLELARVPALYDAAIKLEVPSLAPALEQYTASALQPHNCCAVLELCLGAGVGPLAELVLEWIRSRVADVVPGPEFRACRLETAALICKDLAGRSQLVGLQVAVAWLTASSARGSLVGVFAEATGLAVDAIQAVANSGGALGPIGGLGAAGDLSSALMDGPLRLGGGGPGRDLDLPSLSMGGKGMCHVQGCNRSLAGLRDYYQRYKICEHHLKVSQVLKDGVPHRFCQQCGRFHPLTEFDGDRRSCRTMLQRHCHRRAKQKQELAEVLAQRYEEKQVAASMTAVMAAMARGTPAGVPALPPMLQLQYLAGLPAAAAAAAGRDDGGAKDEDMDGRGGGGRSLPAGLHSPPSRAALTEAVQQRARKQQATVLSQSGLLGLAGSGEGLPEGQLAAAMAAAAAGLTLGLDNLPAVGQLPGSGGVAERKFGDQELLTGGG

SEQ ID NO: 3564 - protein, 407 aa, Lolium multiflorum
MLLCDLSSYQEATGSNSHGGDVAVSNHVLLSPLFPPAATTTLLPRPPPPLLLEEPARAKRKRSQPGNPDPGSEVIALSPRTLVATNRFVCEICNKGFQRDQNLQLHRRGHNLPWKLRQRSLAPLPSRPGDAPRKRVYVCPEPTCVHHDPARALGDLTGIKKHFSRKHGEKRWKCERCGKCYAVHSDWKAHVKNCGTREYRCDCGILFSRKDSLLTHRAFCDALAEESARLLAAANNSITISTTTCNNNSGSSDNSNNNNLITTSNSSPLFLPFSSPPPPQSPNPLMFPSQEPQHHQLFPPFQPLSYLDELPINSAITDSVSTIAADTVTYRLSQEGSMTMHASGRRLTRDFLGIDDSGDQVDELQLPLCATAYQGRSIATAACCSTDMTRQYFGRLPPVNETWSHNF

SEQ ID NO: 3565 - protein, 316 aa, Zea luxurians
LGVPSVKHMFPFCDSSSPMDLPLYQQLQLSPSSPKTDQSSSFYCYPCSPPFAAADTSFPLSYQIGSAADATPPQAVISSPDLPVQALMDHAPAPATELGACASGAEGSGASLDRAAAAARKGRHSKICTAGGMRDRRMRLSLDVARKFFALQDMLGFDKASKTVQWLLNTSKSAIQEIMADDASSECVEDGSSSLSVDGKHNPAEQLGGGGDHKPKGNCRGEGKKPAKASKAAATPKPPRKSANNAHQVPDKETRAKARERARERTKEKHRMRWVKLASAIDVEAAAAASVPSDRPSSNNLSHHSSLSMNMPCAAA

SEQ ID NO: 3566 - protein, 349 aa, Lupinus polyphyllus
  misc_feature (291)..(291): Xaa can be any naturally occurring amino acid
YTSSGPYPYFSSSSSPYHPFAFFNPENSSSNNTFSHDLLSFPYNIQPTHHNHVPTQETLSNFADCAASAAMFKTDLSGNSNFGFSNFLAKKPASKKDRHSKIHTSQGLRDRRVRLSIEIARKFFDLQDMLGFDKASNTLEWLFNKSKKAMKELARSKNSSSGVVANSFSSSDSEFEVVSMINQDSIDATPEGVVVDSKDRKLKRAKIKESREKARARARERTNKKMLSSMKKKYPAIENPQMFNQLRLPFHHPENLAKSPNNKSILSHHHNPHLVCSETPRDDFNLFEESXVIKRKLKQNHVIPKESNFNNNTEHHSFPILSPNLDANNGANGRSNFCAVTNMNLSTGM

SEQ ID NO: 3567 - protein, 202 aa, Betula pendula
MDVFSQYSSESESGAMHLSDEEIRLASRNPKKRAGRKKFKETRHPVYRGVRRRNSGKWVCEVREPNKQSRIWLGTFPTAEMAARAHDVAAIALRGNSACLNFADSAWRLPVPASGTAKDIQRTAAEAAEEFRPAESKAVEDRQPSESLFFMDEEAVFGMPGLMINMAEGMLLPPPYCVGDDDGYGGDVMEAHAEVSLWSYSI

SEQ ID NO: 3568 - protein, 151 aa, Physcomitrella patens subsp. patens
IPVGFRFHPTDEELVGYYLHGKVGRAQRDQFIQELDLYKIEPWDLHEVCRIGDDAPENQSDWYFFSHKDKKYPTGNRANRATTAGFWKATGRDKPIHTQRHVIGMRKTLVFYRGRAPHGQKTDWIMHEFRLDEGPGVVPNYVSPSLSLSLS

SEQ ID NO: 3569 - protein, 316 aa, Zea luxurians
LGVPSVKHMFPFCDSSSPMDLPLYQQLQLSPSSPKTDQSSSFYCYPCSPPFAAADTSFPLSYQIGSAADATPPQAVISSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDHKPKDNCRGGGKKPAKASKAAATPKPPRKSANNAHQVPDKETRAKARERARERTKEKHRMRWVKLASAIDVEAAAAASVPSDRPSSNNLSHHSSLSMNMPCAAA

SEQ ID NO: 3570 - protein, 202 aa, Betula pendula
MDVFSQYSWESESGAMHLSDEEIQLASRNPKKRAGRTKFKETRHPVYRGVRRRNSGKWVCEVREPNKQSRIWLGTFPTAEMAARAHDVAAIALRGNSACLNFADSAWRLPLPASGTAKDIQRTAVEAAEAFRPTETKAVEERQPSEGVFFMDEEAVFGMPGLLVNMAEGMLLPPPYCVGDDDVYGGDDVEAHADVSLWSYSI

SEQ ID NO: 3571 - protein, 82 aa, Physcomitrella patens subsp. patens
KFRGVRMRQWGKWVSEIREPNKRSRIWLGSFPTAEMAARAYDAAVVCLRGPGATLNFPDSPPQLLPECNSPKDIQVAAAAAA

SEQ ID NO: 3572 - protein, 86 aa, Physcomitrella patens subsp. patens
MEQGQKMKGPKRPREPRYEFKTRSEVDVIDDGYKWRKYGQKPVKSSPHPRNYYRCTTANCPVRKRVERSIEDPGLIVTSYEGTHTH

SEQ ID NO: 3573 - protein, 327 aa, Brassica oleracea
MTRRCSHCNHNGHNSRTCPSRGVMLFGVRLTGGSIRKSASMGNLLSHGHGSGSPGAVPDHVAGDGYTSEGFVAGSSSSRERKKGAIWTEEEHRMYLLGLEKLGKGDWRGISRKYVRTRTPTQVASHAQKHFMRLSDVSRRKRRSSLFDMIPHEGGDTPLDLQAPKAENTRVETKMQRGDSVHQKFARNSIHATPIFKIEESESMDSTNSTIKEPTPPTTQLRSQPQPQRPGSYPVLYPGYFSPYYPFPFPVWSAGYVLEPAKKEETHEILRPTAVHSKAPFNVNGLLGMTTKLSLGEPKENGESDQSLSLKLGGGSETRQSPLHPNA

SEQ ID NO: 3574 - protein, 207 aa, Betula pendula
GAGTSARRAVDNYDEEVLLASSMPKRRAGRKKFKETRHPVYRGVRRRNKNKWVCEMRKPNEKTRIWLGTYPSAEMAARAHDVAALALRGSSACLNFADSAWSLPVPASTDAGEIQRAAAAAAEGFQPSEFGEDCEEVLERCTERVDDHQEAEVRGVEESGVLYMDEEAVFDMPGLLANMAEGLLLSPPQWDDMESIISEVSLWSFSI

SEQ ID NO: 3575 - protein, 233 aa, Triticum aestivum
  misc_feature (172)..(172): Xaa can be any naturally occurring amino acid
MAGKRERIAIRRIENLAARQVTFSKRRRGLFKKAGELSILCDAEVGLAVFSATGKLFQFASSSMNQIIDRYNSHSKILKKADEPSQLDLHEDSNCARLRDELAEASLWLQQMRGEELQSLNVQQLQALEKSLESGLGSVLKTKSQKIMDQISELERKRVQLIEENARLKEQXSKMEMQVAADSPAVYEEGQSSESVTNTSYPRPPLDTEDSSDTSLRLGLPLLNLKLMGREIT

SEQ ID NO: 3576 - protein, 254 aa, Brassica napus
MTEGEEYCLARMSVDPFMAMKKSNYNKNNQRRFSDEQIKSLEMMFESETKLEPRKKVQLARELGLQPRQVAIWFQNKRARWKSKQLETEFNILKQNYNDLASQFESLKKEKQALVSELHRLNEEVQKTHEEKRLCCGDQAAVVALSSTDHESENEENTRREQEEEVRPEMEVCEKGDDGVLCGHHNDDYDDGGYNNDIKREYFGGFEEEADHLMNIVEPADSCLTSSDDWGGFKSNANLLDQSSSNFPWWDFWS

SEQ ID NO: 3577 - protein, 296 aa, Brassica oleracea
MANPSEASALRFIEKHLLDELSPVATDRWMIHESAATESSSDTSPTIFGSPAAPIEFSEFENKPEIIDLSTPRFVDLISSPFEFDSEVSLSDFDLKPSYQTGNQFEPEIKTQSNRKPPLKISVPTKTEWIQFDPQPEVTKPKQAIAEEKKHYRGVRQRPWGKFAAEIRDPNKRGSRIWLGTFDTAIEAARAYDQAAFRLRGSKAILNFPLEVGKWKTRYNADGEKKRKRDDELEDVTVVEKVLKTEQNVNGKETFPLVKSDLTELYDWDLTGFLNFPLLSPLSPRPSFNYSELTVV

SEQ ID NO: 3578 - protein, 671 aa, Magnaporthe grisea 70-15
MPPAQESDLGSQGGNNNSSDFNDRFTKEILPQHFKHSNFASFVRQLNKYDFHKVRNTDDNAQYGPNAWEFRHTEFARGQSHNFDIIKRKAPTTRKPAPAEAAFDTNQHVGLMNESLHAVIQQMHELQTANHNLAMANRILTDEVSGHQKSLKLFTQYFHEIMNHLDNQDERRRKTTQANGASGSAQGFTAGGMSLLPGSDDEPAPELRRAREVLESITSNIDASRNSNALERLAQQQHNNVASPPDSTTSSAALLSQQQAFNMTFSGVDIFADQKPMVYPVGQTTGIDPFHADHINNIPYSQPPALGAIDAPAQATPPPAAGVAAAVWETKPCILLVEDDKVCQRIGSKFLTHFGCDVETAMNGFDAVSKFSSNPNRYSLIFMDIIMPEMDGVSATSSIRQRGAVIPIIAMTSNIRQEDITTYFEFGMNDVLAKPFTKEGMVRIVKKHLSHMLKFPAHSHEEDSAFAGEMAGQAPSAVSSAPFTPAGPQMMMPQSVQMPPQMATPPAHGMQQHMAAQQQSHHQIKFEGTSGGAIPATPIKFESTHSPASVGTVGWGSPMMSHSGAAMDGSTGFLGAGNGGGTMNLGTSGTQQRSPAPFNGMMTMPGQAGMQGGAAMAVPGGSHAALGPNSMHRLPEHMAPNNMQMRRMMDHQDDQANKRQRVHAGASTGYH

SEQ ID NO: 3579 - protein, 693 aa, Cucumis melo
MMMMFNEMGFCDDMDFLSASIVEGDAVAPPTDPEVLVEDDYSDEEIDMDELERRMWRDKMRLKRLKEQSKVKEGIDIVKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPSGAEEWWPQLGLPKDQGPPPYKKPHDLKKAWKVGVLTAVIKHMSPDIAKIRKLVRQSKCLQDKMTAKESATWLAIINQEEILARELYPDSCPPLSSGGGSGSLVINDCSEYDVEGAEEEPSFDVQDRKPDNHSSFNLGMDRMRDRVSLRQPPYAMKGEVTTNLDFMRKGKPTSDLNMMMDQKIYTCEFLQCPYSELRLGFNDRTSRDNHQLTCPYRTSSEFSGSSFHVNEVKPVIFPQSFAPPKSMHPPSAQFRHFRLSTLGVPEDGQKLTSELMSIYDTNIQGNKNNLNTVNSATTENQNLPQLKIQPQQDDYFRNQGLMMEGNFFDGSNVSSSHQMFTRDEGQFDRFKPMNSPFENNHHHHNNNNNFHLMFSSPFDLSTFDYKEEVPSVQPSTHCRNSRIFHYGIIKPALTPMLYRRILSVKSISSNISCSSEIHSSSFYSLSISLSLSWGLPFAFTRNQSKLPFGVCLTWCYVI

SEQ ID NO: 3580 - protein, 223 aa, Vitis vinifera
MWKEYLGIKALDEEDLQNKLHELLLVEGSAKKGTQSAITATELLSASSVAVSDATSMVAQIQGGGSGDEVSSAIRTQIATHPLYPKLLHAYIECQKVGAPPEVAYLLEEIRRGSELCRRNTVSTCLGADPELDEFMETYCNVLMKYKSDLARPFDEATAFLNNIETQLNTLCNGASRSYVSDEVARSLEEGLEEVEGGKLKTWRSTRSVAFTNEILSKKRCLN

SEQ ID NO: 3581 - protein, 350 aa, Nicotiana tabacum
MAVELMTSGYSRRDSFSTKMEENAVQEAATAGLQSVEKLIRLLSQSHQNQQQQQQKLDQNPSVSADYTAVADVAVNKFKKFISLLDKNRTGHARFRKGPISTPLPPPPKPQQQRLNQNSIKNQNLQIEETEKPQINTPKIYCPTPIQRLPPLPHNHLQLVKNGSIERKESSTTINFASASPANSFMSSLTGETESLQQSLSSGFQITNLSTVSSAGRPPLSTSSFKRKCSSMDDTALKCNSAGGSSGRCHCPKKRKSRVKRVVRVPAISMKMADIPPDDYSWRKYGQKPIKGSPHPRGYYKCSSVRGCPARKHVERALDDPTMLIVTYEGEHNHSHSITESPAAHVLESS

SEQ ID NO: 3582 - protein, 446 aa, Solanum chilense
RMSVDVGAPSPRSIQMDEQVNPGEEYAPKIRKPYTISKQRERWSEEEHKKFLEALKLHGRAWRRIEEHVATKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFVKEGSDEASSTQCLKLFGKTVLVTDAHMPPTDETLIRSSFPAKYLPWDSECPQSTFSIVPPTPSYYFPSPNGSPGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3583 - protein, 164 aa, Oryza sativa Japonica Group
MGFPLVCYCMAIPKPLIALAKLLAAIREALQLMLFVVGICHHPERSGRPAAVDAPLPDEVKDRLPPLEFAQLLAASEHGCHGCDDDEAVAGCIVCLERLEADDVVRRLGNCAHAFHRGCIDRWIDLGRLTCPLCRSTLLPRARPAAGPRGRLGRLATRLTGVVW

SEQ ID NO: 3584 - protein, 615 aa, Cucumis melo
MNTMGIFEDISFCRNLEYFSAPPGEQETAQEHEAEAVLEEDYSDEELDVDELERRMWRDRMLLRRLKEQSKEKEGADSSKQRQSQEQARRKKMSRAQDGILKYMLKMMEVCKAQGFVYGIIPEKGKPVSGASDNLRAWWKEKVRFDRNGPAAIAKYEADHAIPGNNDECNTVASTPHTLQELQDTTLGSLLSALMQHCDPPQRRFPLEKGVSPPWWPTGNEEWWPELGLPKDQGPPPYKKPHDLKKAWKVSVLTAVIKHMSPDIAKIRKLVRQSKCLQDKMTAKESATWLAIVNQEEALARKLYPDKCPPVSICGSGSLLISDTSDYDVEGVEDEPNVEAEESKPHDLNFFNMGAPGSRERLMMPPVCPQIKEEFMENNSDFNQKRKQMTDESNTIMNPKMYTCEYSQCPYNSARLGFLDRNSRNNHQLNCPFRSDSSHIFSMPSFQSNEDKSASPIPPSFNHPKAPARLMNLTPPFRVSGLGLPEDGQKMISDLLSFYDSNLQQDKHLNSGNLDMQDDHNQQQQLPKFQLQVDDNLYCQATMVGNTMPIQQHPDFSSNKHPFDEYKAAFDSPFGMYPNDNISDFRFGSPFNLASIDYAAADTQLPKQDTPLWYL

SEQ ID NO: 3585 - protein, 1758 aa, Chlamydomonas reinhardtii
VAGHRREARLPAVDPLRRVPVAGLRWLPGTMTILKSKWMKAMSETEQLQQAGSPDFSAAAAKCFHVVKDCPAADLSQGKAYYRRFRICEKHLKTLSLCIEGKPSRFCQQCGRFHVVEEFEGTKRSCRRALLTRFYKRRNLPVPANALPAPQDPSPAAAKPPGAAAAEPRDTGAKSKSKVRSSSSALSGGGPDAADGDTSQQQQQRRKRGRPRAPPMDVRDLAPADEAAAGEVMDAGVRGVRAGVGVASNLDPTMDLRAAAAAVTGGIAGIAGAAGVAGGSPDAAASGAGLASGTAAADMGVGLWSSGSSGRGGIAGGDSSTSVAEQAILLELLQHQRQQQQQQDASILRQAGFGGGLGSGAFARGSVGTGPAGVQPERNGAANPLQRQQQLMTAAGADPALSQHLFSQQLQQSSSAFPTMDEGGGATRRLLLSASSSHAASASAGGSDGSGGLRAALLPGGDSSLSRLQRHIMLLHQHPSDAAKSAAAAGAASGAAANSGSYSRPLLGRSSLQLNMDQDFRHVPGGGAGPRALGLPHHHKQQLQQLQQQGGSGSRRPDILSTSADGGGGRLIVTIPPGALAAAGAAAGDLNFQLGSRYLLQSGRGAAADALSAVPAGSSTAGGTALGYRQGAMGGTNALLQHINPLQQMQQVLAAGGSGSSGNWQLQQAAAAAVGLAGGGGGKGSGSLRDAAQSLLGQGGARAAYSPPAGMLERLSIKLHNCRPDQLPPDLAERLVQLLASTDASVQQGFVRPGCTNLIIDLLYGDWERLLAGLLLYSCQSQAQESEPAGAASGGPSAAPSSLEAHAALEGRIHVQLGNQLLVIDGSHVQLRRRAVMVPAAVPPWVDGCGSGEGSSTASCPADGSRFVDRQRRRPAATTSSGPRWARSSSSDTAVSSAAGGGGRCTAWSGPELAGVAPMAVVAGQPFTLELAGRGLQLPGSCVHVRFRGGHLDALPETGTNENAGDTTSCCSLTGAMGDNGGLPMTLLMSSSAATSAAGQQQPQHAPHSQLDSRLQLQPLLMGCRQPHDAAAAGGGGGGRSVAAAAEASCTFRPRQGPSAAAAAPPAAVASEGIPAAAPSAVPASAASAAGAVSPHAVESPVGGVVIGAAAVAVSLPPAILPTATGYGSAAATVRAAALPEGPALMSKGGGSSCVRMAAGARQQQVVGEGKVASAHRALPIDAVAHDVAMGGAGTIATAGCVSYNEVDGETFSRPSNSGDGWLSLQHRGGRLGAAGELSRSGGGSQRSSSGAEAASLQGSASAPPPLCGGKATAALLPSKHSSLGLISRGRSSSARELMRTATTGGGSMAALGVDDTMNDILQTTAFAHAVALRRNTCDAAGGAGDRATAAQLPAEQPPRQHPLTSYQQWLLEQQAAAGGAVVLPETAANGDGSTAAAGVISRTLVFARAAGSRSTLPSSKSAIRPHQEQQQLECLTLLQQQQTIEPASGQQQAAQRLLQPPAVSAQPSTSTTGALLGGWPAGGCGGSERFEHSSSLPTSVLLGDLTATEAAAFMGFTAASTELKGVAGAISGGWPPAALLGYPHCAGLVLAYLLRRDGVNPQLADAVAGFASPLVPRDWRGVAAAGTAEPAAAAAAEPTSPPSSAEQSTASSLAQCAAVAGPGAKEQLRSRGERQEAQEGKEVDVLSGAFARLCARLRLRAGGVGLLHHAASEQQQEYQHAGSGHTQQASPQQRGTQPSAADEEQPEQQQQTHSLQQVPADAHMQSQQRQEQRSRMRPSGGGRWHKAAAVVVCMLKY

SEQ ID NO: 3586 - protein, 381 aa, Manihot esculenta
MCGGAIISDFIPATAAGRSSRRLTADFLWPDLKKPIGKIVGDLDDDFEADFQEFKDESDVDEEDDVLFDVKPFSFSATASPPPRNRSPSRGSTAVKSVEFNGLAEKSAKRKRKNQYRGIRQRPWGKWAAEIRDPRKGVRVWLGTFNTAEEAARAYDAEARRIRGKKAKVNFPDEAPRASPKRTMKANPQKPLPKRNATESMSYLNNPDQDYFNTLGSVDEKPLVSQFDLMDSFPANGDATVKSIPPCDNVPTFFNSDQGSNSFECSDFGWGEQASKTPEISSVLSATPEIDESLFMDDANPKKKMKSDSENAVPIEESNGKSLSEELLAFDNQMNFQMPYLEGSWEASLDGFLNGDVTQDGGNPMDLWSFDDLPNMVGGVY

SEQ ID NO: 3587 - protein, 446 aa, Solanum chilense
RMSVDVGAPSPRSIQMDEQLNPGEEYAPKIRKPYTISKQRERWSEEEHKKFLEALKLHGRAWRRIEEHVATKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAEISGDLVLSEPFDFVVEESRSSPARAYATSNPANQACVKLELFPEDNDFVKEGSDEASSTQCLKLFGKTVLVTDAHMPPTDETLTRSSFPAKYLPWDSECPQSTFSIVPPTPSYYFPSPNASPGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3588 - protein, 543 aa, Candida glabrata CBS 138
MSTDFDRIFMNQSKFGGRFRIADSGLGWKVSTSGGSASAQNKAPFLLPATELSTVQWSRGCRGFELKINTKNQGVIQLEGFSEDDFNIIKGDFHRRFSIQVEHKEHSLRGWNWGQTDLARNEMVFALNGKPVFEIPYARINNTNLTAKNEVAVEFNIQDDTYQPAGDEMVEMRFYLPGSVVVDEDQPAPKKEGEEEGEEAAETETKSLAEAFYEELKNKADIGEIAGDAIVSFQDVFFTTPRGRYDIDIYENSIRLRGKTYEYKLQHNQIQRIVSLPKADDINHLVVLAMDPPLRQGQTTYPFLVLQFQKDEETEVQLNLSDQEYEEKYKDKLKKQYDSKTHIVISHVLKGLTGRRVVVPGEYKSKYEQCAVSCSYKANEGYLYPLDNAFFFLTKPTLYIPFNDVSSVVISRAGQTSTSSRTFDLEVILRSNRGSTIFGNISKEEQQLLENFLKSKNLRVKNEEKDAQVRLQSALGSDSDDEDVNMGSAGEDDESVDEDFHVSSGDDDDEVAEEFDSEAASEGEDEDEDMDGSDRPTKKPKTE

SEQ ID NO: 3589 - protein, 121 aa, Oryza sativa
MEVGNGKCGGGGAGCELCGGVAAVHCAADSAFLCLVCDDKVHGANFLASRHRRRRLGVEVVDEEDDARSTASSSCVSTADSASSTPPPATARRIFRPPEIESTKNAKLVGNDSMYASSLIN

SEQ ID NO: 3590 - protein, 298 aa, Zea mays
MEDLYSIHPGISRHGAAATSEASGVAGGPGSPPPPPPPAADLTELVKAQIAGHPRYPSLLSAYIDCRKVGAPSEVATLLEEIGRERCAAASAGGEVVGMDPELDEFMETYCRLLERYKEELSRPFDEAASFLSSVRTQLSSLCGGAASLSDEMVESSEDEPCSGDTDATTDPGQEHSSRLADRELKEMLLKKYSGCLSRLRSEFLKKRKKGKLPKDARSALMDWWNTHYRWPYPTEEDKVRLAAMTGLDPKQINNWFINQRKRHWKPSEDMRFALMEGGVSGSSSGTTLYFDTGTIGP

SEQ ID NO: 3591 - protein, 446 aa, Solanum chilense
RMSVDVGAPSPRSIQMDEQVNPGEEYAPKIRKPYTISKQRERWSEEEHKKFLEALKLHGRAWRRIEEHVGAKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSDVAENSGDLVLSEPFDFVVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPSPNGSPGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 3592 - protein, 196 aa, Chlamydomonas reinhardtii
MTKHKRRELPSAVHDGEEYKPGDCVLINPDASAPAYIARIRKLIQIGAEPEQVELEVTWFYRPEEAIGGRKAFHGEAEVFDSDHQDKAPLAAILGRCNVHNVSRYESLERRDENDFFCRFTYKPRTKQFEPDRVPVYCVCELPYNPDRPMINCDNCDEWYHPQCLGLGQHVLQQDHFVCPTCTTPQQPAKKSRPGA

SEQ ID NO: 3593 - protein, 443 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFERRANSTKRVKGFVPYKRCLAERGMSSSTLTGEEREEQRTRLCL

SEQ ID NO: 3594 - protein, 194 aa, Ostreococcus tauri
MGGPKVSVDVPDGEIARVVIGDDVFEVNDAVLVKAPGVRERYVGRIVSVTVDKGAVKARICWYYRPQEAAGGRKRFHGVKELFASDHFDWVSVNTLDAKCEVHALKDYVKLDAVTEYDFYSRFMYKSSEGKFKPEKVPVFCACAEPYNPDRFMVHCEKCHDWFHPQCVGETHASVSKVKEWTCSMCRAGKSPMM

SEQ ID NO: 3595 - protein, 641 aa, Chlamydomonas reinhardtii
MMHLDAKAKHSLLALDAASLGLALPGTSPPAAPLPVPGVKPPGAAGVAALPPGSLPFGAATQFGQVPFFAGLPFPLPGGVPPPLPGLPPLSSAAAHAAAAMTIAQAAAAAEAAPGKGRIGAIAASAAAATDPNIAVPTPPIAASPPTEPSDGSSPATSHGSKDGAAGDAVKTEPGANTAAPGGALSSLGAIAAAAQAATAGMAVPPSLWLGQPGSAGSAFQALAMPMPPFPPNLARTSVGGDGSVQPGTSAPAHSDAPSAPAPSGRPPLAPGMPGNLPSSLADHPAAGICSTSYRSSGSHLGMPGGALGASPPSLGTSPAAIKLPGRRRTSSTNLLSSSLGAKASSSVPSLSVKPDKSGACKYRGVRQRPWGKYAAEIRDPHKGCRLWLGTYDTAEEAALAYDKAAREIRGPRAVVNFPNVNHANLPAPQPHGDDESGAWDPLGTTSLGTSPVSSGFIPGSSPLMGGSAPVRHGMHPHHHLHGGAFSHHPGVAPSSGLGLRSTFGGYPVRREPTEPIAEGESDVDMDDGEEGEDGDGDDMDEGVGPRSGRARMKVNVVTGVGGRTRPSRPAAAAAVAAAAAAAAGGGVDLEDSDGAPPPPQPSMAGGASRGGGGKRNQVSMDVEDELAELADALLLLHESA

SEQ ID NO: 3596 - protein, 309 aa, Arabidopsis thaliana
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRTASGGGGVVVVTALSPTGSDVSEQSQSSGSVLPVSSSCHVFKPTARAGGVVIESSSSEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 3597 - protein, 394 aa, Morus alba
REPQGGRDAGGALCHGNLCCSHWGFCGTTAIYCDVDQGCQSQCWSSPPPPSPPPPPPSPPPPSPPPPSPPPPSPPPPSPPPPSPPPPSPPPPSPPPPGGPERPDHRCGRALGNPPCNPGRCCSIHNWCGSTAAYCRGSSCQYQCWNSLLSALISNGNNAISKIISKSVFDEMFKHMKDCPSKGFYSYDAFIIATTSFPHFGTTGDITTRKRELAAFFAQTSLATTGQRFDSQDPYVWGYCHINETTNGNDNDYCTSAHWPCPSGKKYNSRGAVQLTHNYNYGLAGEALGLDLINNPDLVATDPVISFKTAIWFWMAQHDNKLSCHDILINANSGYVIGNIIKNSGYQNGLITNTISTMRGIGYYKRYCDMLGVSYGDNLDSWYDQTHFSEVARM

SEQ ID NO: 3598 - protein, 443 aa, Solanum chilense
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHIPIPMKGRPLFNDRDLEGKGTQKEGSSTGSNAESVDAEYLEIEAQSSPNVVEELVRVRASIPSLFERRANSTKRVKGFVPYKRCLAERGMSSSTLTGEEREEQRTRLCL

SEQ ID NO: 3599 - protein, 464 aa, Oryza sativa Japonica Group
MIVGAGYFEDSHDQSLMAGSLIHDSNQAPASSENTSIDLQKFKVHPYSTEALSNTANLAEAARAINHLQHQLEIDLEQEVPPVETANWDPAICTIPDHIINHQFSEDPQNILVEQQIQQYDSALYPNGVYTPAPDLLNLMQCTMAPAFPATTSVFGDTTLNGTNYLDLNGELTGVAAVPDSGSGLMFASDSALQLGYHGTQSHLIKDICHSLPQNYGLFPSEDERDVIIGVGSGDLFQEIDDRQFDSVLECRRGKGEFGKGKGKANFATERERREQLNVKFRTLRMLFPNPTKNDRASIVGDAIEYIDELNRTVKELKILVEQKRHGNNRRKVLKLDQEAAADGESSSMRPVRDDQDNQLHGAIRSSWVQRRSKECHVDVRIVDDEVNIKLTEKKKANSLLHAAKVLDEFQLELIHVVGGIIGDHHIFMFNTKVSEGSAVYACAVAKKLLQAVDVQHQALDIFN

SEQ ID NO: 3600 - protein, 280 aa, Glycine max
MANRWWTGSVGLENSGHSMKKPDLGFSMNESTVTGNHIGEEDEDRENSDEPREGAIDVATTRRPRGRPPGSRNKPKPPIFVTRDSPNALRSHVMEIAVGADIADCVAQFARRRQRGVSILSGSGTVVNVNLRQPTAPGAVMALHGRFDILSLTGSFLPGPSPPGATGLTIYLAGGQGQIVGGGVVGPLVAAGPVLVMAATFSNATYERLPLEDDDQEQHGGGGGGGSPQEKTGGPGEASSSISVYNNNVPPSLGLPNGQHLNHEAYSSPWGHSPHARPPF

SEQ ID NO: 3601 - protein, 954 aa, Prunus persica
MIMGSVEEKIKAGGLLSGAQSSILDEMKLLKELQDHSGSRKAINSELWHACAGPLVCLPQVGSLSYYFPQGHSEQVAVSTKRTATSQIPNYPNLPSQLLCQVQNVTLHADKETDEIYAQMSLKPVNSEKDVFPVPDFGLKPSKHPSEFFCKTLTASDTSTHGGFSVPRRAAEKLFPPLDFTMQPPSQELVVRDLHDNSWTFRHIYRGQPKRHLLTTGWSLFVGAKRLRAGDSVLFIRDEKSQLMIGVRRANRQQTTLPSSVLSADSMHIGVLAAAAHAAANRSPFTIFYNPRACPSEFVIPLATYQKAIYGTQLSVGMRFGMMFETEESGKRRYMGTIVSTSDLDPLRWPGSKWRNLQVEWDEPGCCDKQNRVSSWEIETPENIFIFPSLTSSLKRPSHTGFLGAETEWGNLIKRPFIRVPEIGNGNSFPYSISNLCSEQLVNMLLKPQLVNHAGTLAALQQQSPANGDLIADMKAMQAKLIQKNPGVFSEGTSLQSQNPPQSSLDQSATIDVNTTSHAILPGKLNNLTKFGSQAPVGNSTDKTKLETDFSADQLSQLNSTGLGIEDKLAAGFVSPYNLVNQLTFANQNQSAAQLQTSPRPMQPPLESLLYHSQQTDMPNSDFNSTNGSLPFLDNDECIFYQSYQPFAGTLRSQGPLSVFGLQDSSAVLTEANNSSLTSIGQEMWDNSLNNCRLLPQVDQLTSSHQGPGSLNCISNSSSLRDLSDESNNQSGIYGCPNVDVGSGVSAVIDPSVSSTILDEFSTLKNADFHNPSDCLLGNLSSSQDLQSQITSASLGDSQAFSRQDLADNSGGTSSSNIDLDESSLLQNNGSWHQVVPPVRTYTKVQKTGSVGRSIDVTSFKNYEELCSAIECMFGLEGLLNDPRGSGWKLVYVDYENDVLLVGDDPWEEFVGCVRCIRILSPTEVQQMSEEGIKLLNSAAMQGINGTMSEGGRT

SEQ ID NO: 3602 - protein, 260 aa, Vitis vinifera
MPAKKKRGRPRKYGPDGTVTMALSPKPISSSAPGPPVIDFSVEKRGKIRPVGSASKSKMELENLGEWVACSVGANFTPHIITVNSGEDVTMKIISFSQQGPRAICILSANGVISSVTLRQPDSSGGTLTYEGRFEILSLSGSFMPSDSGGTRSRSGGMSVSLASPDGRVVGGGVAGLLVAASPVQVVVGSFLTGNQHEQKPKKQKIEPISAARPTAAVPISTTPKPNLSSSTSFRGDNWSPLPSDSRNKATDINVSLPGG

SEQ ID NO: 3603 - protein, 375 aa, Oryza sativa Japonica Group
MEEEKRLERIIKEIDSPISPGGGAALLAEDDDLVFPGFRFHPTDQELVGFYLTRKVEKKPFSIDIIKEIDIYKHDPWDLPKVSHGAVALQGSSSSSSLSTAAAAEKECGYFFCLRGRKYRNSIRPNRVTGSGFWKATGIDKPIYSSSLAAAAAAAGAGDCIGLKKSLVYYRGSAGKGTKTDWMMHEFRLPSSISDSDHLQDASETWTICRIFKRSMTYTKGRAAAAAASMNKRISHELQHIHHHQQQQFYYHEVVHDGHGHHHRRHLQHYAGSASMAAAAANIVDVIDHSSDAETTTRSHSHSQSHLVADIRHRQSPFMLDFHAGTASSSSSTAAGWSEVMSFSRDGGSSSGSSWDELGRIMDISTNSANNNYYL

SEQ ID NO: 3604 - protein, 188 aa, Brassica napus
MTKKRDPLENPPAASSSGDDDEVDSSAGEEEEREDDDDASSSEEELPVKSHSSSAAVTIAVPGKTAAQQASDLDSGSETETDSDSDTEQPPNQRSGKAILAAAKSKMEKSPPPATKSGTKRPSEGTSNETNSKRAKKTGEDSKKPPAFQRLWTEEDEIAVLQGMIDYKNDTGNSPYEDTNANYDNINK

SEQ ID NO: 3605 - protein, 153 aa, Brassica napus
  misc_feature (105)..(105): Xaa can be any naturally occurring amino acid
IPGWTTPVRIEGKDGHSQCWVQSSSIEENLVSESKTPCWTAAGKADNKPLVKFLKPSEGQPDPNTVNKTGRTAFLFGAGLGSDKCVRFWSKVGADLDNRTIKGGXTGLNMGAGSLQPNAVAALVDFEPIAKVEDKRGLTPLNLPREILKTTPK

SEQ ID NO: 3606 - protein, 584 aa, Arabidopsis thaliana
MMMFNEMGMYGNMDFFSSSTSLDVCPLPQAEQEPVVEDVDYTDDEMDVDELEKRMWRDKMRLKRLKEQQSKCKEGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 3607 - protein, 171 aa, Zea mays
MLTEASGTSFAMEGQNKSCEAENYHVKLRIKSFNIPELFIKVPENATIGSLKSVMDVVNSIMEGDLRVGVLLQGKDIQDDNKTLCQAGICHDKKLNNIDFTLECEREREPPSGVIIQEQMDFLTTDMVEPLARMKCEEPFPEADVGDDSQQPRAPYRSRSLSDLYLGRDHA

SEQ ID NO: 3608 - protein, 349 aa, Zea diploperennis
PSVKHMFPFCDSSSPMDLPLYQQLQLSPSSPKTDQSSSFYCYPCSPPFAAADASFPLSYQIGSAADATPPQAVISSPDLPVQALMDHAPAPATELGACASGAEGAGASLDRAAAAARKDRHSKICTAGGMRDRRMRLSLDVARKFFALQDMLGFDKASKTVQWLLNASKAAIQEIMADDASSECVEDGSSSLSVDGKHNPAEQLGGGGDQKSKGNCRGEGKKPAKATKAAATPKPPRKSANNAHQVPDKETRAKARERARERTKEKHRMRWVKLASAIDVEAAAASVPSDRPSSNNLSHHSSLSMNMPCAAAELEERERCSSALSNRSAGRMQEITGASDVVLGFGNGG

SEQ ID NO: 3609 - protein, 317 aa, Zea mays subsp. mexicana
LGVPSVKHMFPFCDSSSPMDLPLYQQLQLSPSSPKTDQSSSFYCYPCSPPFAAADASFPLSYQIGSAAAADATPPQAVINSPDMPVQALMDHAPAPATELGACASGAEGSGASLDRAAAAARKDRHSKICTAGGMRDRRMRLSLDVARKFFALQDMLDFDKASKTVQWLLNTSKSAIQEIMADDASSECVEDGSSSLSVDGKHNPAEQLGGGGDQKPKGNCRGDGKKPAKASKAAATPKPPRKSANNAHQVPDKETRAKARERARERTKEKHRMRWVKLASAIDVEAAAASVPSDRPSSNNLSHHSSLSMNMPCAAA

SEQ ID NO: 3610 - protein, 334 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKDFANTISAL

SEQ ID NO: 3611 - protein, 317 aa, Zea mays subsp. mexicana
LGVPSVKHMFPFCDSSSPMDLPLYQQLQLSPSSPKTDQSSSFYCYPCSPPFAAADASFPLSYQIGSAAAADATPPQAVISSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAASGPSDRPSSNNLSHHSSLSMNMPCAAA

SEQ ID NO: 3612 - protein, 394 aa, Physcomitrella patens subsp. patens
MGTRELNTMEQLLVQCATALEVSDITYAQQTIFVINNIAAADGDPNQRLLAHFLRALILRASKFTPHLLPGNDNPHTKSRKLKTVLELTNYIDVMPWYRFGFIAANGAILEAFEGKEKVHILDLNISHCMQWPTLIESLAERNEGPPQLRLTVCVSKAPIPPLLDVPYDELIIRLAKFARSKNVPFEYQLLFEDIEKLDVSKIGIREGEVLAVNCLFRLHYVTDECTELSTLSPREEVLYFIRKLNPAIVTLTEDDASLTSPKLVTRLKAAFNYFWIPFDALHTLLPKECQQRLHCEDEVANKIENLIACEGKHRIERVEAKDRWVQRMKRARFHMVSFSEDVVTENKLMLGEHSGCWGLRKDEDEDVLFLTWKGHNVSFSTAWLPANPLLPLR

SEQ ID NO: 3613 - protein, 358 aa, Andropogon gerardii
PSVKHMFPFCDSSSPMDLPLYQQLQLSPLSPKPDQSSSFNCYPCSPLFAAAAADASFHLTYQIGSAAATTPPQAVIDSPELPVQPLMEQAPAPATEQGACNSGAQGAGVSVSLERAAAAARKDRHSKICTAGGMRDRRMRLSLDVARKFFALQDMLGFDKASKTVQWLLHTSKAAIQEIMADDVDASSECVEDGSSSLSVDGKHNPAEQLGGGDQKPKGNGRSEGKKPTKSRKAATTPKPPRKSSNNAHPVPDKETRAKARERARERTKEKHRMRWVKLASAIDVEAAAASVASDRPSSNHLNHHHHHSSSSSMNMPRAAAAESEERERCSSALNNRGRMQEITGASDVVLGCFGNGG

SEQ ID NO: 3614 - protein, 306 aa, Vitis vinifera
MGGDCNSFPSIWTNASDPLPGPDSVFSGPNSNSNSDLSAELSVPYEDIVQLEWLSNFVEDSFSGGSIGLNKEDGSIVKDSPHHQFQTSSPVSVLESSSSCSGGGGKTIPLSPNHRGAQRARSKRPRPATFNPRPAIQLISPTSSVTESPQPVLVPKASSDSENYAESSPLKKMPKPAAAEHKKKKKMKLSLPLGPVEMNQNPPAQAVRKCMHCEITKTPQWRAGPMGPKTLCNACGVRYKSGRLFPEYRPAASPTFVPALHSNSHKKVIEMRNKACENTAMTASPPTGTTSPPELIPNSSVSLDYM

SEQ ID NO: 3615 - protein, 297 aa, Oryza sativa Japonica Group
MATTVDWCGRGSNLPAAMYDMVVDSKELMGALAPSMVSFSYPCSEQSASSLLAGANYLTPAQVLHVQAQLQRLRRPGAASGCLAAAPPLPMKRHGAVAVAAAAAARAPVKLYRGVRQRHWGKWVAEIRLPRNRTRLWLGTFDTAEEAALAYDSAAFRLRGESARLNFPELRRGGAHLGPPLHAAVDAKLHAICHGMDLPQPQPQTQSNATTTTMSTTATNTPSPFFSSESPVVKSEPVCSASESSSSADGDVSSTGSSDVVPEMQLLDFSEAPWDESESFLLHKYPSLEIDWDAILS

SEQ ID NO: 3616 - protein, 327 aa, Glycine max
MSKDIANMKDSWFFDNNFNGLSDEIFDDVINFFDFPLEDVDANGVEEDWDAQLKCLEDPRFDVYSASSAGLCAETQNEKPQLGMKLSASSNGISPIKQLAKAPGPAYGKTIPHQNVTSNGKDLHQFQTYTYSPVSVFESSSSSSVENSNFDRPVIPVKRARSKRQRPSNFSPLFSIPLILNSPAMRKDQRTAASDSDFGTNVAGNLSNKVKKQKKKDSSLLSDDVEMMRSSSPESGSPRKCMHCEVTKTPQWREGPVGPKTLCNACGVRYRSGRLFPEYRPAASPTFVASLHSNCHKKVVEMRSRVIQEPVRCSMLASSNLHGNSVG

SEQ ID NO: 3617 - protein, 307 aa, Brassica oleracea
MANPSEVSSALWFIEKHLLDVVSPVAKDRWMIHESAAKDSSFDSSPMIFGSSSSSSAPIDCSESEIKPEVIDLSTPRFMDLISTPSEFNTGVSVSVSDFDFKPTFQTVNQFEPEFKTQIPCASDDSHSNRKPPLKISVPTKTEWIQFNPQPEVTKPVQPDAEEQRHYRGVRQRPWGKFASEIRDPNKRGSRIWLGTFDTAIEAARAYDEAAFRLRGSKAILNFPLEVGKWKSRKEADGEKKRKRDEIEDDHVAVVEKVLKTEQSVNGKEAFNLTEFCDWDVMGLLNFPLLSPLSPHPSFGYSQLTVV

SEQ ID NO: 3618 - protein, 300 aa, Brassica napus
  misc_feature (191)..(191): Xaa can be any naturally occurring amino acid
  misc_feature (255)..(255): Xaa can be any naturally occurring amino acid
MGVREKDPLAQLSLPPGFRFYPTDEELLVQYLCRKVAGYHFSLQIIGDIDLYKFDPWDLPSKALFGEKEWYFFSPRDRKYPNGSRPNRVAGSGYWKATGTDKIIMSDGHRVGIKKALVFYAGKAPKGTKTNWIMHEYRLIEHSRSHGSSKLDDWVLCRIYKKTSGSQRQAVASPVQACLEDQSTNMSSSPXSSSQLDDVLDSFPEMKDRSFDLPRMNSLRTILNGNFEWASLAGLNPMPELAPMTYGLSNYGGYXAFQSAESGCRSSQVDQEQNSTELTQSLGYSSSGFGLSGQMYEFRQ

SEQ ID NO: 3619 - protein, 486 aa, Oryza sativa Indica Group
MASSGEEGRVVVDLRSAAESAGGGGDEEAHAAPLHEIESLCMRCGDNGTTRLLMTMIPHFREVVLMAFECPHCGERNNEVQFAGQLQPKGCCYRLEVPRGQNEILNRQVVKSDSATIKIPELDFEIPPEAQRGSLSTVEGIIMRAVDELQALQDERKKVDPQKAEAIDKFLAKLRSLGLGEAAFTFVLDDPAGNSFIENQNAPSSDPLLSVKFYERTREQQAALGFLVEPSTEEPGDQPVNHASTVEGNSEVLQEPHGSVGAVAGRRAIAQGNPDEVAAALCRYSAPEECLVFDLWLEIPYFREVIVMATTCDMCGYRNSELKPGGEIPAKGKKITLRVQNGKDLTRDVIKSDSAGVKVPELELELASGTLGGIVTTVEGLIVKICEALQRVHGFHLGDSTLEWKKKKWEDFNDRLSKLLSLQEPWTLIIDDGLAASFVAPATDSLEDDNQLTIEEYVRSWEQNEELGLNDMDTSSADAAYNTTNP

SEQ ID NO: 3620 - protein, 527 aa, Solanum lycopersicum
MEPNSYGSGKAAVGDGVGAPMLQTAPAPAPIPSANAPPPFLVKTYDMVDDPSTDKIVSWSPTNNSFVVWDPPEFAKDLLPKYFKHNNFSSFVRQLNTYGFRKVDPDRWEFANEGFLRGQKHLLKSISRRKPAHGHAQQQQQPHGNAQQQMQPPGHSASVGACVEVGKFGLEEEVERLKRDKNVLMQELVRLRQQQQATDNQLQGMVQRLQGMELRQQQMMSFLAKAVNRPGFLAQFVQQQNESNKRIAEGSKKRRIKQDIESQDPSVTPADGQIVKYQPGINEAAKAMLRELSKLDSSPRLDNFSNSPESFLIGDGSPQSNASSGRVSGVTLQEVPPTSGKPLLNTASAIAGQSLLPATSEMQSSHLGTCSEIINNQLSNIIPLVGGEDLHPGSLSASDMIMPELSQLQGILPENNTDVIGCDSFMDTSAVEGKVGLDIIGSCLSPGADIDWQSGLLDEIEEFPSVGDPFWEKFLQSPCSPDAAMDDDISNTSETKPQINGWDKTQNMEHLTEQMGATNIKQQKHMI

SEQ ID NO: 3621 - protein, 577 aa, Triticum aestivum
  misc_feature (353)..(353): Xaa can be any naturally occurring amino acid
  misc_feature (385)..(385): Xaa can be any naturally occurring amino acid
MMGGGVAMMDRRMAFPAADGDVEKGFGFFGAGCFVGAGDLVDPVTAPAPEQRDRFADEEESEEEDDDDDVDGIEELERRMWRDRMRLKRLKELQQRQSQRPDGGAAASKGRPRRPASQQDQQARRKKMSRAQDGILKYMLKMMEACSAQGFVYGIVPENGKPVGGASDNLRAWWKEKVRFDRNAPAAIAKHRSDNAAPLCGGEDGAAAAAGPRSLHELQDTTLGSLLSSLMQHCDPPQRRFPLEKGVPPPWWPQGPSEAWWPEAGVPDDLGPPPYKKPHDLKKAWKVAVLTAVIKHMSPDVDKVRRLVRQSKCLQDKMTAREIVTWLAVLKAEEELSHKLHPGRLPPTAALRXALSFDASSGEYDVDFFGEEAANQIKARSEGSXFVDLPVDASSSNEFMIMPPALMKEETTDADFTHAQKRSAPPAAADAEPDLMLNGNGRVYTCENVQCPHASHALGFLDRNARSAHQYSCRYNNPAVAAAQSKPPSSFFPGPPYSPQSQALGGFDFGLPVADQRCLAGLMSMYETGVAAHRGATSDATTPGMQIGAGSLLAPRSLSGTNNLMQQQQSAAFFIGD

SEQ ID NO: 3622 - protein, 517 aa, Physcomitrella patens
MAMDMARIDESTAVEVNSLSLVHCVLDGLPDSPCLKSSPTSFEEAVAEGRSVFGDEEDIINNSNDQDNSSSCGAVVTTHEDFAECLNFVTEAECGDVGVRCFEDFDKLPDCGDEGETSKAEEEGCVRIGGGGEQGELLESVSLDCSRNSENLELRDLGELWEGSERPDSVPGNEVGEEEALLLAEAAKATGDVVSASDSGECSSVDRKDNQASPKSSKNAAPGKKKAKVDWTPELHRRFVHAVEQLGVEKAYPSRILELMGVQCLTRHNIASHLQKYRSHRRHLAAREAEAASWTHRRTYTQAPWPRSSRRDGLPYLVPIHTPHIQPRPSMAMAMQPQLQTPHHPISTPLKVWGYPTVDHSNVHMWQQPAVATPSYWQAADGSYWQHPATGYDAFSARACYSHPMQRVPVTTTHAGLPIVAPGFPDESCYYGDDMLAGSMYLCNQSYDSEIGRAAGVAACSKPIETHLSKEVLDAAIGEALANPWTPPPLGLKPPSMEGVIAELQRQGINTVPPSTC

SEQ ID NO: 3623 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEVRMITSLEADSSHFSGGNEAEAIKAKILAHPQYPSLLGAYIDCQKIGAPPEVVARLDALTHEYENQQHRTTVSIGMDPELDQFMEAYCEMLTKYHEEL

SEQ ID NO: 3624 - protein, 365 aa, Populus tremula x Populus tremuloides
MSPPLLGVVEEEGQSNVTLLASPASAESACLNGLELKERNYMGLSDCSSVDSSAVSAASDERKASLNLKATELRLGLPGSQSPERNHELSLLSSALLDEKPFFPLHPSNDGHYSTQKNVVSGNKRVFSDAMDEFSESKFLSNSEVNAMLSPRPSPNMGLKPGMLENLGVQQAKVKEIVAPKAGQERPHAANETRPLRNSSANNSSAPAPKAQVVGWPPIKSFRKNSLATTSKNTEEVDGKAGPGALFIKVSMDGAPYLRKVDLRNYSAYQELSSALEKMFSCFTIGQYGSHGAPGREMLSESKLKDLLHGSEYVLTYEDKDGDWMLVGDVPWEMFIETCKRLRIMKSSDAIGLAPRAMEKCKNRN

SEQ ID NO: 3625 - protein, 345 aa, Oryza sativa
MDFSGDIDDLISLQLLHDQLLGVEADACLPVAVHHDGVAAFAEHQQGFHPAAFLPQQPMTMTPAGYVDMANDQYLGAHAAAGEAEAVYRAAAAEPVMIRFGGEVSPVSDPRRPPLTISLPPTSHAWAAAEAVHPAALLQAQAAAAAADPNDFRKYRGVRQRPWGKFAAEIRDPKKRGSRVWLGTYDTAIEAARAYDRAAFRMRGAKAILNFPNEVGSRGADFLAPPPPPPPPTTSTHGKRKRHETAAADPDVEVIGESSKSVKTETYTSPASSSLASTTTSTVTSSSTSPSPSSEAAACGGGGGSELFVPPMPSSWSWDQLEGFFGILSPLSPHPQMGFPEVAVN

SEQ ID NO: 3626 - protein, 245 aa, Zea mays
MAPRVADKSPLPLATGLKLGVGGGVGGMGLGPHYRGVRKRPWGRYAAEIRDPAKKSRVWLGTYDTAEEAAKAYDVAAREFRGAKAKTNFPFPLAVAVAVAGGAGSPSSDSTTLESSCGGSGCGVEAPVQAAMPLTPALDLDLFHRAAAVSAVTTGGMPFPFKAFPVVRPTPHQYFLYNQAAAAAAAGYRMVKVASAPVTVAAVAQSDSDSSTSSVVDRTCSPPAVTAKKEVSFELDLNWPPPAEN

SEQ ID NO: 3627 - protein, 244 aa, Hordeum vulgare subsp. vulgare
MGRRKVQLKRIENKINRQVTFSKRRSGLLKKAHEISVLYDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRARKNQLMHESISELQKKERSLQEENKVLQKELVEKQKAQAAQQDQTQPQTSSSSSSFMMRDAPPVADTSNHPAAAGERAEDVAVQPQVPLRTALPLWMVSHING

SEQ ID NO: 3628 - protein, 214 aa, Zea mays
MGAAGDAAAAGTRCELCGGAAAVHCAADSAFLCPRCDAKVHGANFLASRHVRRRLPRGGADSGVSASASSGSCLSTADSVQSRAAPPPGRGRRAPARRRPSAEAVLEGWARRKGVAAGPACRRRVPIRVAMAAARWSEVSAGGGAEAAMLRRLEAAAHVPARLVLAVAAWMTRAARARPPAAGAPDLEEGWAECSPEFVVRQGPHPSATTCGRR

SEQ ID NO: 3629 - protein, 319 aa, Zea mays subsp. parviglumis
LGVPSVKHMFPFCDSSSPMDLPLYQQLQLSPSSPKTDQSSSFYCYPCSPPFAAADASFPLSYQIGSAAAADATPPQAVINSPDLPVQALMDHAPAPATATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAASGPSDRPSSNNLSHHSSLSMNMPCAAA

SEQ ID NO: 3630 - protein, 312 aa, Glycine max
MGTAIGMYSNNNIVPDFLDPYSEELMKALMPFMKSDYFSASSSSSSRESHPSPLIPSNSLPSSNQIRLNQLTQDQILQIQAQIHIQQQHVAQGQAHLGPKRVPMKHAGTAAKAAKLYRGVRQRHWGKWVAEIRLPKNRTRLWLGTFDTAEEAALAYDNAAFKLRGEFARLNFPHLRHHGAFVFGEFGDYRPLPSSVDSKLQAICESLAKQEEKPCCSVEDVKPVIHAAELAEVESDVAKLNAEYVYPEFEDFKVENENPMLSSSVSGESSSPESGVTFLDFSDFSDSNNQWDEMENFGLEKFPSVEIDWAAI

SEQ ID NO: 3631 - protein, 317 aa, Zea mays subsp. parviglumis
LGVPSVKHMFPFCDSSSPMDLPLYQQLQLSPSSPKTDQSSSFYCYPCSPPFAAADASFPLSYQIGSAAAADATPPQAVINSPDLPVQALMDHAPATATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKSNCRGEGKKPAKASKAAATPKPPRKSANNAHQVPDKETRAKARERARERTKEKHRMRWVKLASAIDVEAAAASGPSDRPSSNNLSHHSSLSMNMPCAAA

SEQ ID NO: 3632 - protein, 352 aa, Chrysopogon fulvus
PSVKHMFPFCDSSSPMDLPLYQQLQLSPPSPMPDQSSSFYCYPCSPPFAAAAVDASCFHLSYQIGSVATDIHPQAVINSPELPVQPLMELALATELGACGAGGEQGAGVSLDRAAAAARKDRHSKICTAGGMRDRRMRLSLHVARKFFALQDMLGFDKASKTVQWLLNTSKAAIQETMADDASSECVEDGSSSLSVDGKQHNPAELLGGGGGGDEKPKGNGRSEGKKPAKARKATTTPKPPRKSGNNAHPLPDKETRAKARERARERTKEKHRMRWVNLASAIDVEAAAASVASDRLSSNNLNHHHHSSSSMNMPRAAAELEERCSSTLNSRGRMQEITGASDVVLALGNGG

SEQ ID NO: 3633 - protein, 316 aa, Zea luxurians
LGVPSVKHMFPFCDSSSPMDLPLYQQLQLSPSSPKTDQSSSFYCYPCSPPFAAADTSFPLSYQIGSAADATPPQAVISSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDHKPKGNCRGEGKKPAKASKAAATPKPPRKSANNAHPVPDKETRAKARERARERTKEKHRMRWVKLASAIDVEAAAAASVPSDRPSSNNLSHHSSLSMNMPCAAA

SEQ ID NO: 3634 - protein, 522 aa, Malus x domestica
MSIITGSAATGSFSSGNTGGEEVQQQQQELLNHHANFHGSNSLLPTTPNINSNGISTTQVQKQPPPAKKKRNLPGTPDPTAEVIALSPKTLMATNRFVCEICKKGFQRDQNLQLHRRGHNLPWKLKQRTSTEIIKRVYICPESSCVHHDPSRALGDLTGIKKHFFRKHGEKTWKCDKCSKKYAVQSDWKAHLKTCGTREYKCDCGTIFSRRDSFITHRAFCDAIAEENNRNQGVVPMSNNIMGAPNQGQLSNSELIIPASPPMNNKITDNPSSARSDTTTSDQFHHNFDAKNAPLTLEPQQPFPMPTKPVNMLPRTLSNNTSSSTSPSSLLFGLNHGGHDQSLIPNSSGHLSATQLLQKAAQMGATMSGGPNPNPSGTTITSMAPSTYGTATGGYNMNPFMQQRDPNNILQLETSPQFFGANYAQMGMFSGMLFDHAQNNGLLKNMEHENNGTSNKIGFRGASNVGNGDTLTVDFLGLGGSGNNNRPENFHDLQKQQHGQQDQLGFGGIDDHDDHLRMQRFG

SEQ ID NO: 3635 - protein, 315 aa, Zea luxurians
LGVPSVKHMFPFCDSSSPMDLPLYQQLQLSPSSPKTDQSSSFYCYPCSPPFAAADTSFPLSYQIGSAADATPPQAVISSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAASGPSDRPSSNNLSRHSSLSMNMPCAAA

SEQ ID NO: 3636 - protein, 313 aa, Ceratopteris richardii
MAMPCSDIDLLDSDNDNVDDQHISLELRQVHEDTDDGSHDEPRELSLLNHESNLCKIVNSKGKGAEAGNSLLPSTGTSRGKIQIRRIENTTSRQVTFSKRRNGLLKKAHELSVLCDAEIALIIFSSTGKLFEYSSSRGIKKILERYKRCSGILQDVGGTVIRDVEYWKQEAERLKERLTYMEEIQRNMLGESLGSLQIKDLQNLEAKLDSGLYKIRGAKTQLMARQVQELQKKEQILLQQNEALRAKLAELSCLQAPVSGLTTATTSQDVQESSSGRGSRQRETSLSAAETTLQLASHNEQTFLLRAVPHMRL

SEQ ID NO: 3637 - protein, 335 aa, Solanum lycopersicum
MMDELSKLHSAIVCSHSRRQQEVEVEAEAGPTIINNTTTSFAAVHHHYCQLEAAVAADHNHHQNNTKSTTNMSDLIKAQIANHPLYPNLLSAYLQCRKVGAPQEMTSILDEISKENNLISSSRHSSEIGADPELDEFMESYCAVLVKYKEEFSKPFDEATSFLSNIESQLSSLCKDNLITSTSFNNYISDEAGGSSDEDLGCEEMEAADSQESPANCEGDNELKEMLMRKYSGYLSSLRKEFLKKRKKGKLPKEARIVLLDWWKNHYRWPYPTEEEKNRLSEMTGLDQKQINNWFINQRKRHWRPSEDMKFALMEGVSAGSMYFDGSGGTGNIGT

SEQ ID NO: 3638 - protein, 110 aa, Brassica napus
IRGKLGEKETAEEQGERIPRLRYLDQRLRQQRALHQQLGMVRPTWRPQRGLPENSVSILRAWLFEHFLHPYPKESEKIMLAKQTGLSKNQVANWFINARVRLWKPMIEEM

SEQ ID NO: 3639 - protein, 157 aa, Solanum demissum
IMERLLERYERYSYAERQLNATDIETPGSWTLEHAKLKARLEVLQRNQKHYAGEELDTLSMKELQNLEHQLDSALKHIRSRKNQLMHESISAAAKGSKALQEQNNNLSKQVKEREKEMAQQTPWEQQSHDHLNSSSFVLPHPFNNLHMGSIPNCRRQ

SEQ ID NO: 3640 - protein, 355 aa, Coix lacryma-jobi
PSVKHMFPFCDSSSPMDLPLYQQLQLSPPSPKPDQSSSFYCYPCSPSFAAADASFHLSYQIGSAAASTPPQAVINSPELPVQQPLMEEAPVTATELGACASGGAQSAGVSLDRAAAAARKDRHSKICTAGGMRDRRMRLSLDVARKFFALQDMLGFDKASKTVQWLLNTSKAAIQEIMADDVDASSECVEDGSSSLSVDGKHNDPAEQLGGGDQKPAKGNGRSEGKKPAKARQAATTAKPPRKSGNNAHPVPDKETRAKARERARERTKEKHRMRWVKLASAIDVEAAAASVASDDRRPSSNHLNHYSSSSVNMPRAAAAELEERERCSSALNNRGRMQEITGASDVVLGFGNGA

SEQ ID NO: 3641 - protein, 210 aa, Oryza sativa Japonica Group
MSISVNGQSVVPPGFRFHPTEEELLTYYLKKKVASERIDLDVIRDVDLNKLEPWDIQERCRIGSGPQNDWYFFSHKDKKYPTGTRTNRATAAGFWKATGRDKAIYSSSNRIGMRKTLVFYKGRAPHGQKSDWIMHEYRLDDPSSASASVSVNLPSYYSSSSSSSSPMHGVAGDQGAQEEGWVICRVFKKKNLVHHGGHGGQPEQLLDGDR

SEQ ID NO: 3642 - protein, 238 aa, Populus trichocarpa
MEMTSSPRTVEEIFKDFSARRAAVVRALTYDVDGFYGLCDPDKENLCLYGHPNETWEVTLPAEEVPPELPEPALGINFARDGMNRKDWLSLVAVHSDSWLLSVAFYLGARLNRNERKRLFSLINDLPTVFEVVTERKPVKEKPSVDSGSKSRGSIKRSSDGLTKSNPKLTEDSFEEEEDEHTQTLCGSCGGNYNSDEFWIGCDVCERWYHGKCVKITPAKAESIKQYKCPSCMKRSRP

SEQ ID NO: 3643 - protein, 131 aa, Brassica napus
MESISTTRSSGYDQSRRKRKKKPASPPPPPPPSSVQKWRSEKQQQIYSTNIIQSLRELRISDPSAKPAPPRGGGRAVRDAAYRSLAVTARGRTLWSRAILSKAVKVKLKFRKQNRSRNSNQTMVSVTGNNR

SEQ ID NO: 3644 - protein, 128 aa, Physcomitrella patens subsp. patens
MVRWSILESPKYVVTDVPRPSGGNLEKLDQAGKVGDGSSHQQESSEAGPLVTQQVLAPPPKKRRYRGVRQRPWGKWAAEIRDPQKAARVWLGTFDTAEQAAMAYDTAAIRFRGLRAKLNFPDGLISPA

SEQ ID NO: 3645 - protein, 124 aa, Glycine max
MCKGAEGEKQHGFCSSYLHKECATRSATCCELCGLQASLYCQADDAYLCRKCDKRVHEANFLALRHIRCFLCNTCQNLTRRYLIGASIEVVLPANINWTIGNLPSNRGIHRKCSRMHNNLSLLL

SEQ ID NO: 3646 - protein, 124 aa, Brassica napus
MGAMTAVNSLNTISLRGRGGSNPGLLKINSGGIQWKKQGGGKVVEVAKSAIGALSWLKVPRTNQFGVKTKDGCAFKFIGFRDQDVASLTSFFQRAFGKTPEKKQLFVRGRNWGEVDLNGNNLTF

SEQ ID NO: 3647 - protein, 185 aa, Arabidopsis thaliana
MPNITMGLKPDPVAPTNPTHHESNAAKEIRYRGVRKRPWGRYAAEIRDPVKKTRVWLGTFDTAQQAARAYDAAARDFRGVKAKTNFGVIVGSSPTQSSTVVDSPTAARFITPPHLELSLGGGGACRRKIPLVHPVYYYNMATYPKMTTCGVQSESETSSVVDFEGGAGKISPPLDLDLNLAPPAE

SEQ ID NO: 3648 - protein, 359 aa, Arabidopsis thaliana
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSEGSSFHSQELQNSSQSGVFANVQGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCYSISRT

SEQ ID NO: 3649 - protein, 290 aa, Oryza sativa Japonica Group
MAMAGAGDWPFAADEAYADSSAIFAELGWANGLAVVDAVGELLPPLDPPGELATPPPPPLDLPETPAGSSADGAASSCSTDDADGGKPAAASTEAASKSLTPGKKRARQPRFAFMTKSEIDHLEDGYRWRKYGQKAVKNSPFPRSYYRCTNSKCTVKKRVERSSDDPSVVITTYEGQHSHHTVTFPRAAATAAGFSHIHAMAALAAAPFSAHQQLYSNLQPPPPTMPLAATTPASSSSLLQLPLHCNHELQVVASCGGYPSSSSSPPASVLPVDKGLLDDMVPRAMRHDG

SEQ ID NO: 3650 - protein, 189 aa, Lupinus villosus
SSGPYPYFPSSSSSYYPFAFFNPENASSNNTFSHDPLSFPYNMPTTHHYHAPIPETLSNFADCAASAAMFKNDVSGSNFGFNNFLTKKPAPKKDRHSKIYTSQGLRDRRVRLSIEIARKFFDLQDMLGFDKASNTLDWLFNKSKKAMKELARSKNSSSGVVANSFSSSDSECEVVSMINQDSIDATPEG

SEQ ID NO: 3651 - protein, 157 aa, Gossypium barbadense
NKGSWTAEEDRRLAKYIEIHGAKRWKTIAIKSGLNRCGKSCWLRWLNYLRPNIKRGNISDEEEDLIIRFHKLLGNRWSLIAGRLLGRTDNEIKNYWNSHLSKKIINHDVRTEQTSSSEQIVPHKAWETVQMEEEEVVKGSDEIENSEFSIDVDEFFD

SEQ ID NO: 3652 - protein, 593 aa, Oryza sativa Japonica Group
MPAVKVEEEEEERNPVASSPSVSEGSAHAAALASPTAADSIFGRRRKSGPVRRAKGGWTPEEDEKLRKAVDIYNGKNWKKIAESFSDRTEVQCLHRWQKVLDPELIKGPWTQEEDDVIINMVKKHGPKKWSVIARSLNGRIGKQCRERWHNHLDPQIRKEAWTVEEERVLARAHCMYGNKWAEIAKLLPGRTDNSIKNHWNSSLRKKIDDYNTRDILPVHPPVVGDGLKQLPKRPPADNHFDLNKEPIICSRDRLGVVHSDPTSHQRASNLKDFKGCADYLSLGQPVTSCEASAADDSAFDLATQGMRMDSVHDKGTGNNFVCGKVQGINFLGDKGLKINQISDKMGCSRQAKREGEAAINGGGSSLQSEAHSVGSLCYQIPKMEDIAPAQSPVFTANYVPEHSRNVMHSPNGYTTPPTHGKGSDQLSVESILRSAAEKFHGTPSILRRRKRDKPTPAEDNDLKIGRLSSDDFHTPIGKCTTDSPQSFKTAALLSLGPMDEQGSLDVSPPYRLRSKRLAVLKTVQNHLDFSSDEMSICDTTMKSACGNSDCANASSGVSSIQGKKLDEHMIGLETLTMNFAHTTKLDATQPNL

SEQ ID NO: 3653 - protein, 276 aa, Hordeum vulgare subsp. vulgare
MGRGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAASRQQQLQQQQQQQQMQWEHQAQTQTHTHTQNQPQAQTSSSSSSFMMRDQQAHAPQQNICSYPPVTMGGEATAAAAAPEQQAQLRICLPPWMLSHLNA

SEQ ID NO: 3654 - protein, 188 aa, Lupinus villosus
SSGPYPYFPSSSSSYYPFAFFNPENASSNNTFSHDPLSFPYNMPTTHHYHAPIPETLSNFADCAASAAMFKNDVSGSNFGFNNFLTKKPAPKKDRHSKIYTSQGLRDRRVRLSIEIARKFFDLQDMLGFDKASNTLDWLFNKSKKAMKELARSKNSSSGVVANSFSSSDSECEVVSMINQDSIGGRFK

SEQ ID NO: 3655 - protein, 322 aa, Ostreococcus tauri
GEAPSSNDTGDEATVTTNDATSDPTTTEGKAVKTRKPYTITKKRERWSDEEHALFVESLKKYGRAWKRIEEYIGTKSAVQIRSHAQKFFAKLQKEQIVASGSEGSGSTRKRGADRSTSQSKRSKSSYATDINLEIPPARPKKKPAHPYPRKATSQQPSGGSGERDNSGGTGKSSGTAQKWPTEASQEFIASTSSSAAIAAVLSVACDKMQNNLHQELRQGYFGIPTGMQPQQGMFAQPGMFPMNAMMSPFVAMNTVSGAPTPPPMTNPQQFLNYANFFSNYWPQFANAANANAVNVMFQQQQQQQQQQQQQQHKQRAGGETK

SEQ ID NO: 3656 - protein, 204 aa, Populus tremula x Populus tremuloides
MEFERDLNLDATELRLGLPGTATRQSEKQTPNSNLAKSNKRSLPDMNEDPAGSSRENSSTVSSNEEKSHDQETAPPPIKAQVVGWPPIRSYRKNCLQAKKQEAEAAGLYVKVSMDGAPYLRKIDLKVYKGYPELLKALEEMFKSKVGEYSEREGYNGSEHVPTYEDKDGDWMLVGDVPWDMFINSCKRLRIMKESEARGLGCAV

SEQ ID NO: 3657 - protein, 515 aa, Oryza sativa
  misc_feature (94)..(94): Xaa can be any naturally occurring amino acid
MALSTLLLPSSSSSSSKTATATDTSDRRRHHHHHNHTKRKKKPPPPPLSPTPRTPPPAGSGSHRAMAASSKKSTKQVVVAAKTTTGHRPKKAAXAAPTTPSRGAPSASAAPVSSSWEQLKSLLSCRSATAAARVHDPAAPSSALSRLRSHGAGACGASLCAIRDVVDAASSASAASTAAASLDRDTTPLTRSSRRAHRAATSSSGGGGGHHASLRGLSGCYECRAINVEPMSRRYPRPRELCACSQCGEVFNKADSLEHHQAIRHAVKIGWQKYIKRYLCLAIFCMLAVASASPFVEVSELGPEDSGRNIVEIIFKSSWQKRDRPICQIDRILKVHNAARTVARFEAYRDAVRTRCRATAARAAADGNELLRFHPAALACPLGLNGATSLCDDDDACGVCAAIRHGFAPWAGAHPLGVRTTASSGRAHDCGAAAAAAQQAGGCRAMLVCRVIAGRVRRNDRPTGRADGRTDGTRSTSVAGDEAASSVYGNLEELFVANPRAILPCFVVIYRVVPE

SEQ ID NO: 3658 - protein, 259 aa, Glycine max
MENYYDSGWHMGTSNWAQCSDHSSSSSFAVPTQQILPHHVTDAASLQFGEFHSWSLPIEGAAEERAISASKSHRQAEKRRRDRINAQLATLRKLIPKSDKMDKAALLGSVIDQVKDLKRKAMDVSRAFTVPTEIDEVSIHHDHVLQDESCTEKVNKLKDNIVIKASVCCDDRPELFPELIQVLKGLRLTAVKADIASVGGRIKSILVLCSKDSESVCLATLKQSLKSAVTKIASSSSMASSCPARSKRQRFFLPSHCLQ

SEQ ID NO: 3659 - protein, 431 aa, Arabidopsis thaliana
MDRRLLWVTDSGNVDALYALIHKDPYILQNIDVLPFVHTPLHEASSTGKTDLAMELMVLKPTFAKKLNSDGVSPLHLAVENHQVQLALELVKINPDLVLVAGRKGMTPLHLVVKKGDANLLTEFLLACPESIKDTNVNGETALHIAVMNDRYEELKVLTGWIHRLHKSDAASTEIHVLNKRDRDGNTILHLAAYKNNHKAFKELLKCISLNRDIQNKGGMTALDILRTNGSHMNIKTEKIIRHSGGKSGVSLSKVKTASVFLRSPITFVEYCSTTMTRYKNRMSDGTRNALLVITALIITATYQTAVQPQDKDEIYYTGNIMINVLFVWGFNTIAFCLAIALTFILLPVGKAYNWWYIFISVPLVCSYALSMFLKYIQFPILCMPLYLMMAFILGFLIYVFVLYVGWKRAKQEKVPEPKSELTFEGFTSMT

SEQ ID NO: 3660 - protein, 240 aa, Medicago truncatula
MGRGRVQLKRIENKINRQVTFSKRRAGLLKKAHEISVLCDAEVALIVFSHKGKLFEYATDSCMEKILERYERYSYAERQLVANDSESQGNWTIEYTRLKAKIDLLQRNYRHYMGEDLGSMSLKELQSLEQQLDTALKLIATRRNQVMYESISELQKKEKVIQEQNNMLAKKIKEKEKIAAQQQAQWEHPNHHGVNPNYLLQQQLPTLNMGGNYREEAPEMGRNELDLTLEPLYTCHLGCF

SEQ ID NO: 3661 - protein, 316 aa, Zea luxurians
LGVPSVKHMFPFCDSSSPMDLPLYQQLQLSPSSPKTDQSSSFYCYPCSPPFAAADTSFPLSYQIGSAADATPPQAVISSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDHKPKDNCRGGGKKPAKASKAAATPKPPRKSANNAHPVPDKETRAKARERARERTKEKHRMRWVKLASAIDVEAAAAASVPSDRPSSNNLSHHSSLSMNMPCAAA

SEQ ID NO: 3662 - protein, 272 aa, Zea mays
MGRAPCCEKEGLRRGAWSAEEDQRLVAYVRQNGHPNWRALPRQAGLLRCGKSCRLRWINYLRPDIKRGNFTPDEEALIVRLHRELGNRWSAIAAQLPGRTDNEIKNVWHTHIKKRLEDGHGEEKKARKGKPAAKKAADAVGRSSEHGPFLTASPGLSSSGVTFSAAADSAAAVSSSADNAATTSHHPQQVGASKAESSTELDSGLSSAEFPPLDDSFWSSADVVDMGLGATDEELGLACPPPLSSSSTRDEDMEFWLNMLLEAGDMRDLSVL

SEQ ID NO: 3663 - protein, 346 aa, Elionurus tripsacoides
PSVKHMFPFCDSSSPMDLPLYQQLQLSPPSPKPDRSSGFYCYPCSPPFAAADASFHLSYQIGSAAAATTPQAGNNSPDLPVVQMEQAPAPATELGACASGAQEGAGVSVGLDRAAAAARKDRHSKICTAGGMRDRRMRLSLDVARKFFALQDMLGFDMPSKTVQWLLNASKPAIQEFMTDDASSECVEDDSSSLSVDGKHNPAEQLEGGDQKPNGNGRSEGKKPAKPRKAATTPKPPRKSGNNAHPVPDKETRAKARERARERTKEKHRMRWVKLASAIDVEAAAASVASDRPRSNNLSHHSSSSMNMPHAELEERERCSSSLNNRGRMQEITGPSDVVLGFGSGG

SEQ ID NO: 3664 - protein, 218 aa, Triticum aestivum
  misc_feature (179)..(179): Xaa can be any naturally occurring amino acid
MAPKNALPVAVAAAADAGMEPRFRGVRKRPWGRYAAEIRDPARKARVWLGTFDTAEAAARAYDAAALHYRGPKAKTNFPVGTVAAFAHVPLPPPKALAVSPSSSTVESSSRDTPAAAPAAPAAAAPAPPPALDLSLAMPAMVAAQPFLFLDPRVAVTVAVAAPAPAPCRSAAISGMNKXASREEEQSDTGSSSSGGGTPPRPGAGGSTLNLPPPGEMA

SEQ ID NO: 3665 - protein, 357 aa, Heteropogon contortus
PSVKHMFPFCDSSSPMDLPLYQQLQLSPPSPKPDQSSGFYCYPCSPPFAADASLHLTYQIGSAAAATRPQAVIDSPDLPVQPLMEQAPAPATELGTCASGAQGAGVSISLDKAAAAARKDRHSKICTAGGMRDRRMRLSLDVARKFFALQDMLGFDKASKTVQWLLHTSKAAIQEIMADDVDASSECVEDGSSGLSVDGKQHNPAEQLGGGDQKPKGNGRSEGKKPAKSRKAATTPKPPRKSGNNAHPVPDKETRAMARERARERTKEKHRMRWVKLASAIDVEAAAASVASDRPSSNHLNHHHSSSSSSMSTMNMPRAAAAELEDRERCPSAVNSRGRMQEITGASDVVLGFGSGG

SEQ ID NO: 3666 - protein, 316 aa, Zea luxurians
LGVPSVKHMFPFCDSSSPMDLPLYQQLQLSPSSPKTDQSSSFYCYPCSPPFAAADTSFPLSYQIGSAADATPPQAVISSPDLPVQALMDHAPAPATELGACASGAEGSGASLDRAAAAARKDRHSKICTAGGMRDRRMRLSLDVARKFFALQDMLDFDKASKTVQWLLNTSKSAIQEIMADDASSECVEDGSSSLSVDGKHNPAEQLGGGGDHKPKGNCRGEGKKPAKASKAAATPKPPRKSANNAHQVPDKETRAKARERARERTKEKHRMRWVKLASAIDVEAAAAASVPSDRPSSNNLSHHSSLSMNMPCAAA

SEQ ID NO: 3667 - protein, 317 aa, Zea mays subsp. mexicana
LGVPSVKHMFPFCDSSSPMDLPLYQQLQLSPSSPKTDQSSSFYCYPCSPPFAAADTSFPLSYQIGSAAAADATPPQAVINSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAASVPSDRPSSNNLSHHSSLSMNMPCAAA

SEQ ID NO: 3668 - protein, 374 aa, Zea mays
  misc_feature (21)..(21): Xaa can be any naturally occurring amino acid
CAVAAPCARPHQGLGLVKPMXEMLMAANAGAANPSQSSNPNPPAPAPSLAPGGLLGGGAPAPLAGAGSTERRARPQKEKALNCPRCNSTNTKFCYYNNYSLQQPRYFCKTCRRYWTEGGSLRNVPVGGGSRKNKRSSSSASASASTSGSVTSSSMASTAGAGSKNPKLAHEGAHDLNLAFPHHGGLHAPEFAAFPSLESSNVCNPGGGMTSNGRGGGAGPAVGALSAMELLRSSGCYMPLQMPMPMAMPGDYTAAGFALGEYRTPPPPPSQSVLGFSLDAHGPGSGATAAGYGSSAGLQGVPENAGRLLFPFEDLKPPVGSEGGGGATGGASDGNSSHTQFDHNNKEQGGGGTGAGHDTPGFWSGMIGGSGASW

SEQ ID NO: 3669 - protein, 287 aa, Triticum aestivum
  misc_feature (211)..(211): Xaa can be any naturally occurring amino acid
  misc_feature (217)..(217): Xaa can be any naturally occurring amino acid
  misc_feature (247)..(247): Xaa can be any naturally occurring amino acid
AYLGDSIEQVCTKKQAGTGPEFPGYRRPTRPGGGFAPGLGAGGWEREKAAIEAHPLYERLLEAHVACLRVATPVDQLPRIDAQVAARAPPPVPPAAAPAGGEELDLFMTHYVLLLCSFKEQLQQHVRVHAMEAVMACWELEQTLQSLTGASPGEGTGATMSDDQDNPVDSESNMFDGTDVSDGMGFGMLTEGERSLVDRVRQELNHELKQXFREKLXVDIREGRFWRKRRARKAPRGTRRPTPESWXQPPAQWPVTQLGEELGPRFVKENGVSPSKRNSTTGCYPTQ

SEQ ID NO: 3670 - protein, 228 aa, Zea mays
MVTVREEMRKGPWTEQEDIQLVCTVRLFGDHRWDFIAQVSGLNRTGKSCRLRWVNYLHPGLKHGRMSPQEERIIIELHARWGNRWSRIARRLPGRTDNEIKNYWRTHMRKKAQERKMGMPSPSSSSSSLTYQTCLLDTIPVIGMGSGDTHNGSCVTSTLENTQSVMDGYPMDQIWKEIEAPHAPNLLSIAEGKEKTCSSIPCHLPSPVMWDYKCPEIFWKMGDQEIMM

SEQ ID NO: 3671 - protein, 354 aa, Phacelurus digitatus
PSVKHMFPFCDSSSPMDLPLYQQLQLSPPSPKPDQSSSFYCYPCSPPFAAAAAYASFHLSYQIGSAAASTPPQAVISSPELPLQALMEQAPAPAPATELGACASGAQSASVSVSLDRAAAAARKDRHSKICTAGGVRDRRMRLSLDVARKFFALQDMLGFDKASKTVQWLLNTSKTAIQEIMADDASSECVEDGSSSLSVDGKHNPAEQLGGGDQKPKGNGRSEGKKPAKARKAATTPKPPRKSGNNAHPVPDKETRAKARERARERTKEKHRMRWVKLASAIDVEAAAASVASDRRPSSNHLNYHSLSSMNMPRAAAAELEERERCSSALNNRGRMQEITGASDVVLGFGNGG

SEQ ID NO: 3672 - protein, 241 aa, Populus trichocarpa
MGRGRVQLKRIENKINRQVTFSKRRTGLLKKAHEISVLCDAEVALIVFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKEKAIKEQNNMLVKQIKEKEKALAQPALWDQQDHGPNASSFLLPQPPLPCLNISYQEEDPEARRNYELDLTLEPIYSCHLGCFGT

SEQ ID NO: 3673 - protein, 347 aa, Arabidopsis thaliana
MEALIHHFTLLSDQALVDKTFDPSRIEDLMRLFEVDSYKAWAALESEQQQELEEAEESLREAELELDRDMEWGMEEYRRTLEEMERMEAAELKELEEKAETARRTGNLMEKAATVAAKRHIAAAMGSAAASMRSAWKTAAGNKCFNMGGKKTKIEIKKIINKPAKTVAFTKRREGLFRKASQLCLLSPATQIAILAAPMTSKSHASFYSFGHSSVDNVVSSLLYDHPPLTANQDNRSGLGFWWEDKRFDVSENVEELKEAVDAVSRMLNNVRCRLNDAVKSTQRDGGLEILHHQEEEVLQTRNDETKTNQTHEFEGGETSGSASWLENEDDILHFDDDFYTGIDPLF

SEQ ID NO: 3674 - protein, 238 aa, Picea glauca
MEHLNTAAAQASSSLYEVGMAEYGDAGVSSMMALITQHEPHDSESIMSTRMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 3675 - protein, 162 aa, Populus trichocarpa
MGRGRVQLKRIENKINRQVTFSKRRTGLLKKAHEISVLCDAEVALIFFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKLYPIG

SEQ ID NO: 3676 - protein, 455 aa, Glycine max
MAGGGGGDRPPWKEAEPPRPTITLPPRSGSMESLFNGGFSPGPMTLLSSFWGDGDDGKSFSQLLAGAMSSPVAGAVAPGVMDSPGLFSSSQVSFGMTHQQALAQVSAQASQANSNMHIQAEHSLTQAPAAASNTTQQLMPPLTSDSWAAMTESIDHSHSEQRLQSSLLNVDKPADDGYNWRKYGQKQVKGSEFPRSYYKCTNPNCPVKKKVERSLEGHVTAIIYKGEHNHQCPHPNKCSKDTMTSNENSNMQGNVDSTYQGTSTNSMSKMDPESSQATADRLSGTSDSEEVADHETEVDEKNVEPEPKRRKAEVSQSDPPSSHRTVTEPRIIVQTTSEVDLLDDGYRWRKYGQKVVKGNPYPRSYYKCTTQGCNVRKHVERASTDPKAVITTYEGKHNHDVPAAKTNSHTMASNTASQLKSHNTNPEKHNFGSRGMGGNEQQPVARLQLKEEQIT

SEQ ID NO: 3677 - protein, 82 aa, Physcomitrella patens subsp. patens
RYKGVRKRQWGKWVSEIREPRKRSRIWLGSFPTAEMAARAYDAAVVCLRGPSAALNFPDSPPLSLPECHTPREIQVVAAAAA

SEQ ID NO: 3678 - protein, 604 aa, Zea mays
VVTSSDQDFMVRKRLGYSSRGHRIPTMPRVPNSARGKRSTRRKKDENDDMCAMDLLATVAGKLLADQDNSSSVPNTSAAKAKKRKSVKEEHFDEIPPLKNVAMEKDVGSGSVSAFPRQAKNCLAENSSTRNGADTVLESLTVKSNMLAKIPECGSYGIHHAGSSSSAEPEQVHQAEPKVSRRQADGHPVAYGIFNSVDVDGKPPALVSSDSSSCVPLSSHDKEHQTSSLYRGVVQYTADREDDENSSGCTHPSTIENKGCKPQYLGNHRIRKLLASKVRKAARNKICGGIPSKKICGGLSKKGSKLNLCGKKMSTTHQKVQRMIFKKKKLAHRTSFAKEMLTEASGTSFAMEGQNKSCEAENYHVKLRIKSFNIPELFIKVPENATIGSLKRAVMDVVNSIMEGDLRVGVLLQGKDIQDDNKTLCQAGICHDKKLNNIDFTLECEREREPPSGVIIQEQMDFLTTDMVEPLARMKCEEPFPEADVGDDSQQPRAPYRSRSLSDLYSVHCPVQMASQDTSVSSQAIVPVSPAPSDVGALAIVPLCKSKGSEVGQRRMRRPFTVGEVEALVGAVEQLGTGRSVSGESVSVDAQVYFGSRVGLMCSS

SEQ ID NO: 3679 - protein, 457 aa, Triticum aestivum
LSCSRWQEMACTQENAMATDESTADHRGSRPSSHDMDLSGDDHVPKARKPYTITKQREKWTEEEHKRFLEALQLHGRAWRRIQEHIGTKTAVQIRSHAQKFFSKVTRESSGSCSGSGAAAATATAAIQIPPPRPKRKPTHPYPRKADDGAAAGGKHAPGLTHLERPPVRMGEQEEGSPTSVLTASRVEASGGRFSYNSSGSRSPVPSAAGSLYGSSVDRGDGCLSPNTTKASEFTANGDVKEGSCTGSATSVLKLFGKKVVVNDSFQKPNTSTGNPQNGGDVGTEASDDTTTQGSRNLPSGGATEGSSWNPWPSSMQQFVYFVPQPDGFATQSAVPWFGTLPGAMFYQQAMAPNQHQRHRSETADHKFMQREGSWTGSNTGPGSAAHNSDAADSRGRGNSSESDKTPVPRLTKCESSVSVSLQRGFMPYKRCAAESESLRSEAPREETDGELTRLCL

SEQ ID NO: 3680 - protein, 244 aa, Impatiens hawkeri
  misc_feature (198)..(198): Xaa can be any naturally occurring amino acid
MGRGRVELKRIENKINRQVTFAKRRNGLLKKAYELSVLCDAEVALIIFSNRGKLYEFCSSPSMLKTLERYQKCNYGAPEANISSRGALELSGQQEYLKLKQRYETLQRTQRNLLGEDLGPLDGKELDTIERQLDTSLKHIRSTRTQHMVDQLEDLQRKEQILNEANRALKQRLLESSFNWMQNGQHVDYSGPAVQPNXDELFHPLECEPTLQMAMGYQTHHDPTSVEAAGAGPSMNNYFPGWLS

SEQ ID NO: 3681 - protein, 157 aa, Gossypium barbadense
NKGSWTAEEDRRLAKYIEIHGAKRWKTIAIKSGLNRCGKSCRLRWLNYLRPNIKRGNISDEEEDLIIRFHKLLGNRWSLIAGRLPGRTDNEIKNYWNSHLSKKMINHDVRTEQTSSSEQIVPHKAWETVQMEEEEVVKGSDEIENSEFSIDVDEFFD

SEQ ID NO: 3682 - protein, 346 aa, Zea mays
MQQPGPADLPGWAFPPRAGPAPAAARGAHHRRARSEVAFRLPDDLGLGGGAGPDGDAFDEIGSEDDLFSTFMDIEKISTSGPSDRAAENSSPPRPKHRHSSSVDGSGFFFSPGAGGGAGKDAAASLAEVLEAKKSMTPEQLAELAAIDPKRAKRILANRQSAARSKERKARYMTDLERKVQTLQTEAPTLSAQLTLFQRDTTGLSTENAELKIRLQAMEQQAQLRDALNDALKQELERLKHATGEMTNSSEAYNMRFQHVPYNSSFFPLSQQNASPHLGSTQLPLPFHPPHPNVPNHQMVSHRNTLPDIMQQESLGRLQGLDIGKGPLVVKLESSSISASESSSTF

SEQ ID NO: 3683 - protein, 342 aa, Triticum aestivum
MCGGAILAELIPGAPARRAASGHGHVWPGKGAKQTKAAAADDFEAAFREFNEDSDEEDVVMVVERQEEVAESKPFVFAASPKKKQQQQQEEEEEQAAPARRRKPAQYRGVRRRPWGKWAAEIRDPVKGVRVWLGTFPSADAAALAYDEAARAIRGPRAKLNFPSSSAVAAAAPGARKRGRAGADAAPAAKPAQVITLVDEEEEHASSLFVKHEADASEGSESSGALPDFSWQGVSAFDEAPAYPAPEPETEQLAKRARTTEAEDADEGMSAHQASDCDSDALFDALLFADQFAYFNGGAYESLDSLFSADAVQSGATAADEAALGLWTFDDDCLVDECSLSF

SEQ ID NO: 3684 - protein, 621 aa, Ustilago maydis 521
MAGKRNRWTRNEDEILKKAVLSSAKPRPSWAMIAKHIPGRSSKDCRKRWEHGLNQNLSRGPWSGSEDARLKAAVAEHGLHWALVATKVGKRTSDQCAKRWCDVLDPSLKKSEWTADEDSALLGLYQQLGTAWAKLATHIPGRSALSCRNRACKILVQRGEPRPGSVEAEELRLTMLAQQQPNSNPSSPLLSCSSPMSASGLSAAAITSPPQLNSQPQFIQMSDKDLNSVLPWHRSPSESVGHIYSEPGGWLPGSPGDAVLDSLLVSTPGACDDFSLGIGMAQGGSLLQTLFEPAATTSASELQFDLAPLFESASVSRDQATPVPGYIEPVDGRSDLDMIDLTSYAAPSMSSWTANESLTSSSSSTSPCTRWSTPAEDSGRLTSAKEWLSSGEAKPSPDNETSYTSRLNHMHPPLQASRATQVSARRMSLPALGQIMTMAGDPARVLQMLATEFDADRVCCRTRSTSTNADVSSKTCSGSDDACLTSRNVDSSSSSSATTWQRSYTASEASTLPVWMHTLLDTASHSTNTLETDQVISAHACQTMQHPLQLSSKPDIAMLRLPNFSGDQVWLDNSHNQHGSSRHVVELSGLVRNMADLMANMATLARAISSGGTASATNTVV

SEQ ID NO: 3685 - protein, 388 aa, Zea mays
MDGRESTVASGPNFSSFFAQHRGIGAPGVPGHSQGLHAPPPGGYRQHLDAVSAGYAFQTPHVGGPSIGQGYEASPHAAQHSAGGGSGSGGCGGMDIGMGAAVSADVKGDQGSGPGQDEQVKKKRGRPRKYKPDGAVTLGLSPSSSLTPHSASLGMGTMVNAPGSGFGSGGSGASGLGAPSEKRGRGRPPGSGKMQQLASLGKWFLGSVGTGFTPHVIIIQPGEDVAARIMAFSQQGPRAVCIISATGAISTATLHQDSDSGGVVTYEGRFEILCLSGSYLVVEDGGTRTRSGGLCIALCGPDHRVIGGSVGGVLTAAGTVQVIVGSFMYGGSKKNKVKAEVDMEPEEVAPAEHSGMVPPAMSGGGWEAGMMRQMDSRTPAIDINSIRG

SEQ ID NO: 3686 - protein, 101 aa, Chlamydomonas reinhardtii
MTNPANQPPPFLIKTYDLVDDPSTDNIVSWGADGHSFIVWKPPEFARDLLPKHFKHNNFSSFVRQLNTYGFRKVDPDRWEFANEHFVRGKKEQLRDIHRRK

SEQ ID NO: 3687 - protein, 249 aa, Beta vulgaris
MEFPTQTMEGSPSSQRKMGRGKIEIKRIENTTNRQVTFCKRRNGLLKKAYELSVLCDAEVALIVFSSRGRLYEYANHSCSVKGTIDRYKKACSDQSGAGSVAEANAQYYQQEAAKLRNQIRTATENNRLLSRHMMGEGLSSLSMKELKNLETKLERGISRIRSKKNELLFAEIEFMQKREIELHNNNQFLRARISENERAQQSMSLMPGGSDYDLVPSQSFDSRNYFQVNALQPSSQYARQDQTPLQLV

SEQ ID NO: 3688 - protein, 316 aa, Zea mays subsp. mexicana
LGVPSVKHMFPFCDSSSPMDLPLYQQLQLSPSSPKTDQSSSFYCYPCSPPFAAADTSFPLSYQIGSAADATPPQAVISSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAAATVPSDRPSSNNLSHHSSLSMNMPCAAA

SEQ ID NO: 3689 - protein, 127 aa, Triticum aestivum
  misc_feature (39)..(39): Xaa can be any naturally occurring amino acid
RPVKRDSDEKSTRLDAEDKTCGVEVKEESGSDSDEDPQXGEELPAHAERRRRANKQHIASITLVDIAPYFHLPIREASRALKIGVSILKQKCRQYGIPRWPHRKIKSLHSLISDLEFVMDDTNGDVV

SEQ ID NO: 3690 - protein, 255 aa, Oryza sativa Japonica Group
NVDLKDKWRNLSVTAGGYGSRERARVALKGGKRGPKALAEPMDADEKNPDIDDNAIIDAQPLAVVVEPMQLESTPEKEKSVARLDDLILEAIKKLKEPSGSNRTTISSYIEEQYWPPEDFQRLLSTKLKALVATGKLIKVNQKYRIAPSSNSSGGKSIKVYSTGEMNMENNNVRQLSKPQVDAELDKMKSMSKEEAAAFAARAVAEAEAAIAEAEEAARAAEAAEAEADAAKAFLDAVVTTMQNRNHASAMLQAC

SEQ ID NO: 3691 - protein, 319 aa, Zea mays subsp. parviglumis
LGVPSVKHMFPFCDSSSPMDLPLYQQLQLSPSSPKTDQSSSFYCYPCSPPFAAADASFPLSYQIGSAAAADATPPQAVINSPDLPVQALMDHAPAPATATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGEDQKPKGNCRGEGKKPAKASKAAATPKPPRKSANNAHQVPDKETRAKARERARERTKEKHRMRWVKLASAIDVEAAAASVPSDRPSSNNLSHHSSLSMNMPCAAA

SEQ ID NO: 3692 - protein, 357 aa, Saccharum officinarum
PSVKHMFPFCDSSSPMDLPLYQQLQLSPPSPKPDQSSSFYCYPCSPPFAADAADASFPLSYQIGSAAAATPPQAVINSPDPPVQMLMEQAPAPATELGTCASGGAQGAGVSASLDRAAAAAAARKDRHSKICTAGGMRDRRMRLSLDVARKFFALQDMLGFDKASKTVQWLLNTSKAAILEIMADDVDASSECVEDGSSSHSVDGKHNPAEQLGGDQKPKGNGRSEGKKPAKSRKAATTPKPPGKSGNNAHPVPDKETRAKARERARERTKEKYRMRWVKLASAIDVEAAAASVASESDRPSSNHLNHHSSSSMNMPRAAAVELEERERCSSALNNRGRMQESTGPSGVVLSFGNGG

SEQ ID NO: 3693 - protein, 277 aa, Triticum aestivum
MLPRACAGPDQSSDTMEEHRSRSPASSNVAEAPRRRYRGVRQRPWGKWAAEIRDPHKAARVWLGTFETAEAAARAYDDAALRFRGSRAKLNFPEDARLHPATVTPAAAPARAPIAAQSASTPAMYAGSTQASDYLRYQMLLQGRGAAAANQGNLLSFYGGGGGGGGAMSSSYGGGVMSSSYGGGGGGGGTMSGFLGSYYSFPSSSVSVATVPSSSSASSAPGHHYSSPHDPQQHQQQQGDAAAEWSWESALAPDPGTTTAASWSDSSQQPYHPPHTQ

SEQ ID NO: 3694 - protein, 319 aa, Zea mays subsp. parviglumis
LGVPSVKHMFPFCDSSSPMDLPLYQQLQLSPSSPKTDQSSSFYCYPCSPPFAAADASFPLSYQIGSAAAADATPPQAVINSPDLPVQALMDHAPAPATATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIGVEAAAASGPSDRPSSNNLSHHSSLSVNMPCAAA

SEQ ID NO: 3695 - protein, 219 aa, Zea mays
MNSKEMCQEPCDELSEISSQEASNSSGLVSLDLTLTVAAAAAAESSTTDNSNSGGTPADAAAVAREPSRVFTCNYCQRKFFSSQALGGHQNAHRRERTLARRTLRLDAAGPYGYYADVASLPLYGSGLYPIGIQAHASMAAHPEQQQRHEDAAELRPARGLLSPMPFLVADEAEMSFGWPGSFRPATAVAPAPAGSAVLNSAGGVAVHAREEPDLTLRL

SEQ ID NO: 3696 - protein, 467 aa, Picea sitchensis
MESYSIDRVEEGETHFSIDEPFSKVRKPYTITKQRERWTEDEHKKFLDALKLYGRSWRHIEEHIGTKSAVQIRSHAQKFFTKLEKGASTGTSSTMTYQYLEIPPPRPKRKPGHPYPKKTGVIDRGGDFSILEEDSRTRGCEVSERECSKLTELAQHNSKSMSLDKPKMTQGTSQPSRMSTSLKLFGQTLVVQNSFTDDFLFTSVENEAICSEIYPENKDAPCEDEILDCRRIRKDTFSPEESETDTFQSVNNSTGKTTIHKSSVFSNTNRSPALLNSCHSSSSENENIQCSYPQVLRDGGLEDGLQQKPEVPDIKCEYTHQSQQEDETQRNKDKIGLEAQPGNIVLQSNPKPTPLMEGCSFKMASASQSDYVDPLKEEYSMTFHHSETSVDSILDFQILHEMSSIGFCRHIQIEKDVLPFSRSQGSMLCSEIRGENRTYSGAGFVPYKGCQKDGQYPGESDAEECNL

SEQ ID NO: 3697 - protein, 378 aa, Zea mays
MGIESMSPTAAAPEDSSSAASTATTESAAAAQPPPAAAPPGGGAVGGGDAVAVSPAADEQAVTSQPSAVPQGSSRFKGVVPQPNGRWGAQIYERHARVWLGTFADEEAAARAYDVAALRYRGREAATNFPGAGASAPELAFLAAHSKAEIVDMLRKHTYADELRQGLRRGRSRAQPTPAWARVLLFDKAVTPSDVGKLNRLVVPKQHAEKHFPLKRAPPSVEAQAPTTAKGVLLNFEDGEGKVWRFRYSYWNSSQSYVLTKGWSRFVREKGLRAGDTIVFSHSTYGSEKQLFIDCKKTKTTTPATDGVPVPSPAPAEKPSEARVVRLFGVDIAGAGCHHQKRARPVEISFDHGPQAESFKKQCVAHHHRSPALGAFLL

SEQ ID NO: 3698 - protein, 759 aa, Oryza sativa Japonica Group
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAEQRVGFAKPNSLWWCLSSQSKLKAHSRSNGGRKPSRGSEKNPPNPCMTFSASLDRTNEFEDATLHVDVILLKVHLVYTLGVSSVAASPRVTEDVALSCVFLHYSLTWELIPSAQPSFVRYVQPSSECKLTD

SEQ ID NO: 3699 - protein, 205 aa, Helianthus annuus
MEKLQNANAVLRRLPPGFRLHPTDEELVVQYLKRRVHSSPLPASIIPEVDVCKSDPWDLPGDSDQQEERFFFSTREIKYPNGNRSNRATQSGYWKATGLSRQIMGANQVGLVGIKKTLVFYKGKPPTGSRTDWIMHEYRLATTQPTQGLEKWVLCKIFLKKRGNYKDEKKNVPVFYDFLATPKVKTSSSSSSGSSGITEESSTNC

SEQ ID NO: 3700 - protein, 163 aa, Physcomitrella patens subsp. patens
MNQLAARVPVGFRFHPMDEELVGYYLPKKVGDRKIDLDLIQDVDLYKLEPWDLHEFCKIKNDPNEKQTDYYFFSRKDKKYPTGNRSNRATLKGFWKATGRDKPIYTKLGQTLIGMRKTLVFYQGRAPHGIKTDWIMHEFRLDNGPDQPAHVTPCPAFNYVFIF

SEQ ID NO: 3701 - protein, 164 aa, Oryza sativa Indica Group
MEDLYSIHPGISRGGGGGGGGAASEASGVAGGGSSPPHPPPPATTAAAADLTELMKAQIAGHPSYPSLLSAYIECRKVGAPPEVTTLLEEIGREGRGGGGGATAGGEIGLDPELDEFMETYCRVLERYKEELTRPFDEAASFLTGIHTQLASLCGGAPPPTDNS

SEQ ID NO: 3702 - protein, 156 aa, Brassica oleracea var. acephala
AQTNWSMEYSRLKAKIELLERNQRHYLGKDLESISIKELQNLEQQLDTSLKHIRSRKNQLMHESLNHLQRKEKEILEENSMLAKQIKERESILRTHQNQSEQQNRSHHVAPQPQPQLNPYMASSPFLNMGGMYQGEYPTAVRRNRLDLTLEPIYNC

SEQ ID NO: 3703 - protein, 258 aa, Glycine max
PPVRRVGVILHLKPVRDDSKTLLQTGISHDNHLDALGFALEPNCSQNRSSACATTDSLCVPGADMHQPLIGYPSSRAVIHQRIQGFSNMLAEHQATSLGNLVESDHDSAPSPINTSGEKNLTDSKELITVPEMGMEALAVLPVHQKSKRTEIAPRRIRRPFSVAEVEALVQAVEKLGTGRWRDVKLHAFDNAKHRTYVDLKDKWKTLVHTARISPQQRRGEPVPQELLDRVLTAHAYWSQQQTKQQLKHHSTKPCLLL

SEQ ID NO: 3704 - protein, 156 aa, Brassica oleracea var. acephala
AQTNWSMEYSRLKAKIELWERNQRHYLGEDLESISIKELQNLEQQLDTSLKHIRSRKNQLMHESLNHLQRKEKEILEENSMLAKQIKERESILRTHQNQSEQQNRSHHVAPQPQPQLNPYMASSPFLNMGGMYQGEYPTAVRRNRLDLTLEPIYNC

SEQ ID NO: 3705 - protein, 161 aa, Zea mays
  misc_feature (132)..(132): Xaa can be any naturally occurring amino acid
MQSQIVCHGCRSVLLYPRGAPSVCCAVCHAVTSAPPPGMEMAQLICVGCRTLLMYTRNATTVRCSCCDTVNLARPAPPVNSIAHVNCGQCQTVLMYPYGASSVKCAICNFITNIGMNTVRPLPPTMHAPNGXSYSVPSTSAPSAQSQNVTVVVENPMTVDD

SEQ ID NO: 3706 - protein, 450 aa, Zea mays
MESGSSVRFGHQDVTAAGGVHAGNAGAASSHQQVIPGTGMTMPAGMASLLVGRLGMQAPPGMVLPGGALAAASAGYGGIMSSALRAAWSGAQQQLPPHAGGGIGGHRAQHHKGPWTEAEDVVLREMVMKHGDRKWAVIAQSLPGRVGKQCRERWTNHLRPDLKKSVWTEEDDMALIKAHKRCGNHWSTIATFLPGRSENAVKNHWNATKRSLKAKRRLKKKSNAQQVPAGQWSVLEEYIRSLYPDLADGAGADQTPPAAEDSPPSSYNLGSYSYGEVISSPASAAAPPGSFDQMTAMGLYLGASSSSPAPAELQGGMSSDIVAPFLHLDLNAYYGGAPAATMRLMAPMGGMAAPVPQMMEHDHYQHQQASYATANQLLTYPFIDNSVMWQQAPYAAHGSAAYGGGADAAGAGPSNVVAVPADDVDVVQMASREFLTPSEDEVTLDLARFR

SEQ ID NO: 3707 - protein, 249 aa, Taihangia rupestris
MGRGRVELKRIENKINRQVTFSKRRTGLLKKAHEISVLCDAQVGLIVFSNKGKLFEYASDSCMENMLERYERYSYAERRLMEPDFESQGDWTFEYARLKVKVELLQRNLSHYLGDDLDSLSVKEIQSLEQQLDTALKQIRSRKNQLMNESISELQRKEKAMQVQNNLLTKKIQEKEKDVAATQEVHIWEPQQYQHQQNNGFHRLPQPLLPCLNMGGTHQNDQFFQMRGNQLDLTLEPSLYSFNLGCFTS

SEQ ID NO: 3708 - protein, 301 aa, Oryza sativa Japonica Group
MEDLYSIHPGISRVGGAASEASGVGVVVGGGGGSSSSDLTELMKAQIAGHPRYPTLLSAYIECRKVGAPPEVASLLKEIGRERRAGGGGGGAGQIGVDPELDEFMEAYCRVLVRYKEELSRPFDEAASFLSSIQTQLSNLCSGATSPPATTATHSDEMVGSSDEDQCSGETDMLDIGQEQSSRLADHELKEMLLKKYSGCLSRLRSEFLKKRKKGKLPKDARSALLEWWNTHYRWPYPTEEDKLRLAARTGLDPKQINNWFINQRKRHWKPSDGMRFALMEGVAGGSSGTTLYFDTGTIGP

SEQ ID NO: 3709 - protein, 353 aa, Sorghum nitidum
PSVKHMFPFCDSSSPMDLPLYQQLQLSPPSPKPDQSNSFYCYPCSPPFAAAAADASFHLSYQIGSAAAATPPQAVINSPEDLPVQPLMEQAPAPATELGACASGGAQGAGVSVSLDRAAARKDWHSKICTAGGMRDRRMRLSLDVARKFFALQDMLGFDKASKTVQWLLNTSKAAIQEIMADDVDASSECVEDGSSSLSVDGKHNPAEQLGDQKPKGNGRSEGKKPAKSRKAATTPKPPRKSGNNAHPVPNKETRAKARERARERTKEKHRMRWVKLASAIDVEAAAASVASDRPSSNHLNHHHHSSSSMNMPRAAEAELEERERCSSTLNNRGRMQEITGASDVVLGFGNGG

SEQ ID NO: 3710 - protein, 217 aa, Pimpinella brachycarpa
MVRGKTQMRRIENATSRQVTFSKRRNGLLKKAFELSVLCDAEVALIIFSPRGKLHEFASSSMHETIERYRKHTKDVQSNNTPVVQNMQHLKHETASLAKKIELLEVSKRKLLGEGLGTCSINELQQIEQQLEKSVCTVRARKMQVFKEQIEQLKEKEKTLAADNAILLAKYDVQPRQESPEDGGNLTSTTENSENSDVETELFIGPPEKRFKRIMEK

SEQ ID NO: 3711 - protein, 258 aa, Taihangia rupestris
MGRGKVQLKRIENKISRQVTFSKRRTGLLKKAHEISVLCDAEVALIVFSTKGKLFEYSTNSSMEAILERYEQYSYAERQSMGITDPESQGSWSMEYPKLAARIEILQRKIRNYTGEDLDPLSLRELQSLEQQIDTALKRVRVRKNQVMHDSISEIQKKHRALQEQNNQMSKKLKENEKQSQAVPNNQQSNSTTIVLMAPPPPQAPPPPAPLPALTIGGAFLDRRNAMDEDSDDQQGRAQTRPVSNTGMPLWMVRGLNQ

SEQ ID NO: 3712 - protein, 313 aa, Aspergillus oryzae
MSGTPPTSGDSGGATDSPNTGIITALFLAIIITGAVRAHRHPERYGPRYTAGRPRQSRTKGMARAMLDTIPIVKFGNQQDPKLDAVKGDVEMGSDDETGRQPDATPETTTVQETNPQATAALPATNNTTTESNTEQEAKPTESTDHPNFSCPICTDDFVKGQDLRVLPCNHQFHPECIDPWLVNVSGTCPLCRIDLNPAQPEGENENQEGENNTETQQEGTAEPATEESHHRHRRLTSFMHGTLNARRMREATVEERLAALRSVREENRNSIENEEDRQRRGRLTSRLRDRFRIRTRRHGDDGEQQPPASTAT

SEQ ID NO: 3713 - protein, 362 aa, Cymbopogon distans
PSVKHMFPFCDSSSPMDLPLYQQLQLSPPSPKPDQSSSFYCYPCSPPFAAAAADASFHVSYQIGSAAAATPPQADIDSRELPVQPLMEQAPAPAPATELGARGAQGAGGSVSLDRAAAAARKDRHSKIRTAGGMRDRRMRLSLDIARKFFALQDMLRFDKPSNTIQWLLNVAKPAIQELMADDVDASSECVEDGSSSLSIDGKHNNPAEQLGRGDQKPKGNGRSEGKKPAKSRKAATTPKPPRKSGNNAHPVPDKETRAKARERARERTKEKHRMRWVKLASAIDVEAAAASVASDRLPPSSNHLNHHHHHHHSSSSMNMPRAAPAELEERERCSSALNNRGRMQEITGASDDVVLGFGNGG

SEQ ID NO: 3714 - protein, 231 aa, Oryza sativa Japonica Group
MLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHAGDVVGFYRSAASAGDDGKLFIDCKLVRSTGAALASPADQPAPSPVKAVRLFGVDLLTAPAPVEQMAGCKRARDLAATTPPQAAAFKKQCIELALV

SEQ ID NO: 3715 - protein, 241 aa, Oryza sativa Japonica Group
MGGEAERCALCGAAAAVHCEADAAFLCAACDAKVHGANFLASRHHRRRVAAGAVVVVEVEEEEGYESGASAASSTSCVSTADSDVAASAAARRGRRRRPRAAARPRAEVVLEGWGKRMGLAAGAARRRAAAAGRALRACGGDVAAARVPLRVAMAAALWWEVAAHRVSGVSGAGHADALRRLEACAHVPARLLTAVASSMARARARRRAAADNEEGWDECSCSEAPNALGGPHVSDTARQK

SEQ ID NO: 3716 - protein, 320 aa, Oryza sativa Japonica Group
MGEQQQQVERQPDLPPGFRFHPTDEEIITFYLAPKVVDSRGFCVAAIGEVDLNKCEPWDLPGKAKMNGEKEWYFYCQKDRKYPTGMRTNRATEAGYWKATGKDKEIFRDHHMLIGMKKTLVFYKGRAPKGDKTNWVMHEYRLADASPPPPPSSAEPPRQDDWAVCRIFHKSSGIKKPVPVAPHQVPAAANYQQQQQMAMASAGIIQVPMQMQMPSMSDQLQMLDDFSTTASLSLMAPPSYSTLPAGFPLQINSGAHPQQFVGNPSMYYHQQQQMDMAGGGFVVSEPSSLVVSPQDAADQNNNAADISSMACNMDAAIWKY

SEQ ID NO: 3717 - protein, 205 aa, Oryza sativa
MASTSGSAAAVEERGNSERKRKRGATGESEGSEAQPSKWRTRRVHEIYSSKLLDAIRLVRSGSPSSSAAAPPRSRAVREAADRALAVSARGRTRWSRAILASHRRRIQAARRARLREAISPPSRHPSSSSGKGPKAPALARKAKVLGRLVPGCRKLPFPALLAEASDYIAALEMQVRAMTALAEVLSTVSGSGSASSSGGSSSPA

SEQ ID NO: 3718 - protein, 327 aa, Triticum aestivum
APRRSTPSGASTATTESGAAGRLPTTLGLPVAIPDEAVTSRSASASAQSASSRFKGVVPQPNGRWGAQIYDRHARVWIGTFPDEDAAARAYNVAALRYRGLDAATNFPRTAGSTELAFLAAHSKAEIVDMLRKHTYSDELRRGLRRGRGIGGRAEPTPSWAREPLFEKVLTPSDVGKLNRIVLPKQHAEKHIPLKRAPETTTTADKAVLLNFEDGQGKVWRFRYSYWNSSQSYVLTKGWSRFVREKGLVAGDVVVFSCSEYGHEKQFYIDYKKTTTVNSGASASPPPPVVETGKGEQARVVRLFGVDLAGEMRGLAAPAELELFKRQ

SEQ ID NO: 3719 - protein, 301 aa, Oryza sativa Japonica Group
MGMEAECDRIKGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRKLATATDGGEIDRPCKRVSPGPGSPTGSERSELSHGGCGSGSGGGQVFRPVPRPGGFDAISAADVVRPPRRRDDNDDDGDDDPLTSLSLSLSLPGFHHDSARSHFQELPSPSRSPSPPPSPPAASPSAYPFNADLVSAMQEMIRTEVRNYMAGVGLRAGCGPGAVAESFMPQLVDGVMRAAAERVGVVTRQ

SEQ ID NO: 3720 - protein, 376 aa, Catharanthus roseus
MALLDQASNLSPMPFDFTRKRKSRRRDGTKNVAETLAKWKEYNEKLDALDGGKPARKVPAKGSKKGCMKGKGGPENSHCKYRGVRQRTWGKWVAEIREPNRGSRLWLGTFRNAIEAALAYDEAARAMYGPCARLNLPNYRASEESSSLPTTSGSDTTTASGISEVSVYEDKKFTPVVSGLKQDDKGESLESADSKPQLLVDAGTPMSAVKEEPKEYQVMDSQSEGQFGDEEPPSKLVCKEVDFGQDQAVVPAVKNAEEMGGEMGGDILKGCSLSEMFDVDELLSVLDSTPLHASDFQHGMGNGNVKAEAAYNYAPSWDSAFQLQNQDPKLGSQQHMAQTPPEINSGLDFLQPGRQEDSYFTLGDLDFLDLGAELGL

SEQ ID NO: 3721 - protein, 312 aa, Petunia x hybrida
MIKGVSGNQQLELPAGFRFHPTDEELVQHYLCQKCAGQPICVSIIAEIDLYKFDPWQLPEKALYGEKEWYFFSPRDRKYPNGSRPNRAAGTGYWKATGADKPVGKPRTLGIKKALVFYAGKAPRGIKTNWIMHEYRLANVDRSAGKSNNLRLDDWVLCRIYNKKGTLEKHYNVDNKEDVRFEEVEEDQKPNILTFSQRNEMLTQLAPAPMPPRPQSMPASDYFHFETSDSVTRMHTTNSSSNCSEHVLSSCDKEVQSAPTWEDLESALNYQLNYLDGFQDEPFGPQMQQQNCNIIDQFNPFHDMFMYMQKPY

SEQ ID NO: 3722 - protein, 210 aa, Catharanthus roseus
MYQSNAHNSDHLTFLPPLVDYQFLNNDFDFSEIFTDFNYANYNYNTSTSDNFSGFQFNENCEEIISPNYASEDLSDIILTDIFKDQDNYEDEVVAGEQEEELITTPTSRGGGGGGCEQRSNEEWIRYRGVRRRPWGKFAAEIRDPKRKGSRIWLGTYETAEDAALAFDQAAFQLRGSRARLNFPNLIGSANAPVRVSPRRRSSSCHLRPQ

SEQ ID NO: 3723 - protein, 241 aa, Arabidopsis thaliana
MKIWCAVCDKEEASVFCCADEAALCNGCDRHVHFANKLAGKHLRFSLTSPTFKDAPLCDICGRRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 3724 - protein, 215 aa, Petunia x hybrida
MEEKKEGAKTGTVGNLNLPIGFRFHPTDEELFVHYLSKKIFSMPLPALIIPEHHDVFHTFPCDLPAGDLREKRYFFSKTNGQINSKGCSILISGRDYSGYWNAIGQGQLIVVPFPHQQQGLVLGMKKAFRFYQTNQIKSLRTRWVMHQYSLVSTSQNVNNMMQVGDWSIFSIYQRKLKSKNVIRAKANALAEQCNKTNTRKRPLSAMLLQEKEFH

SEQ ID NO: 3725 - protein, 291 aa, Vitis vinifera
MQEPGLGMMGGGGIGGLSDGDQQQRQLKGEIVTHPLYEQLLAAHVACLRVATPIDQLPLIDAQLTQSHHLLRSYASQQHHHGNSLSPHERQELDNFLSQYLLVLCTFKEQLQQHVRVHAVEAVMACREIEQTLQALTGVSLGEGSGATMSDDEEEMQMDFSLDQGGGDGHDMMGFGPLLPTESERTLMERVRQELKIELKQGFKSRIEDVREEILRKRRAGKLPGDTTSVLKNWWQQHSKWPYPTEDDKAKLVEETGLQLKQINNWFINQRKRNWHSNSQSVTALKSKRKR

SEQ ID NO: 3726 - protein, 167 aa, Oryza sativa Japonica Group
MDPVWTLSAPWASPVERGAAYWLAGWRPTTLVHLLYTESGRRFEAQLPDLLLGVSSGNLGDLSPSQLAQIDDLQRRTVAEEDGLSREMALVQEGHGAVAVGGGIDVDGIVGRVRGVLGRADALRLRTVKRAVEILEPAQAAELLVAAADMEIGFREFGLKYSSARSD

SEQ ID NO: 3727 - protein, 258 aa, Arabidopsis thaliana
MPKQKAPRKQLKSYKLKHINKSIQEGDAVLMRSSEPGKPSYVARVEAIETDARGSHAKVRVRWYYRPEESIGGRRQFHGAKEVFLSDHFDFQSADTIEGKCKVHSFSSYTKLDSVGNDDFFCRFEYNSTTGAFDPDRVTVFCKCEMPYNPDDLMVQCEECSEWFHPSCIGTTIEEAKKPDNFYCEECSPQQQNLHNSNSTSNNRDAKVFLYFSFQKISLVFEGWSNPLQIGLNKFKVFKLTVRSTYKASLANNCKLLD

SEQ ID NO: 3728 - protein, 156 aa, Brassica oleracea var. acephala
AQTNWSVEYSRLKAKIELLERNQRHYLGEDLESISIKELQNLEQQLDTSLKHIRSRKNQLMHESLNHLQRKEKEILEENSMLAKQIKERESILRTHQNQSEQQNRSHHVAPQPQPQLNPYMASSPFLNMGGMYQGEYPTAVRRNRLDLTLEPIYNC

SEQ ID NO: 3729 - protein, 341 aa, Petroselinum crispum
MALDLMNNNSYKFRSKMEETAVQEAAAAGLQSVENLIKAISQSNHQTAYLSSSSSSETGDTDYRAVTDVAVNKFKKFISLLDKNRTGHARFRRGPVQEKTGVEMLVNPIQNQIQNHGSDGFQVYRPTAVHPVQPVQPVQIQPVQLVQPVQRLPPVPKKENISTTINFAAPAVAVAAPATSFMSSLTGDTDGSGFQITNMSGFSSGSRPVSSLKRKCSSMNDVSAKCSGSSSGRCHCPKKKKLRVKKVVRMPAISMKTSDIPPDDFSWRKYGQKPIKGSPHPRGYYKCSSVRGCPARKHVERAVDDPTMLIVTYEGEHNHSQSSNENTNTSHILESDGLKQS

SEQ ID NO: 3730 - protein, 296 aa, Petroselinum crispum
ERALDGQIKEIVYKGTHDHPKPQPSRRFTAGALISIQEEKAVNASSLTGQGDTTYSQTLSADQNGTPLSSPRGVNADNVDGASPLLNSVTDDIDNDDQFMKRRRTDVGSIDISPVVKPIREPRVVVQTLSEVDILDDGYRWRKYGQKVVRGNPNPRSYYKCTNAGCPVRKHVERASHDPKAVITTYEGKHNHDVPAAKTNSHDVSGSAPISGMSRVRPEDCSPISLDLGVGMNYGVENNGYEQQTTLGSEHVRSQVQASTAPTCYGVANGGIILYGSRDNHVENHNFESPPLGQFS

SEQ ID NO: 3731 - protein, 212 aa, Oryza sativa Japonica Group
MGFPVGYSELLLPRLLLQVLLLLGHLHRFLLWAFHAVGLGDLIDNPPGLAATEQDLMLQGRGGGMAEGWASSSALQHRRPEFRAIPPMAIEEALPVVRFDELVASAPAAVCGGGDCAVCLSGICGRDEVRRLSNCRHVFHRGCLDRWMAHEQRTCPLCRAPLIPDELLPAASGLPDPSDYDLSYYPSPLPLAPTPTLLRPHELLLNGLGGFQ

SEQ ID NO: 3732 - protein, 166 aa, Oryza sativa Indica Group
MDGEEDSEWMMMDVGGKGGKGGGGGGAADRKKRFSEEQIKSLESMFATQTKLEPRQKLQLARELGLQPRQVAIWFQNKRARWKSKQLEREYSALRDDYDALLCSYESLKKEKLALIKQARTSSSSSILDRFLSCLPFASILTRDRCVLAAGEAGGDAAGATGEVRR

SEQ ID NO: 3733 - protein, 621 aa, Cucumis melo
MMFNEMGMCGDMDFLSASIVEGDAVAPPTDPEVVVEDDYSDEEIDMDELERRMWRDKMRLKRLKEQSKVKEGIDIVKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPSGAEEWWPQLGLPKDQGPPPYKKPHDLKKAWKVGVLTAVIKHMSPDIAKIRKLVRQSKCLQDKMTAKESATWLAIINQEEILARELYPDSCPPLSSGGGSGSLVINDCSEYDVEAVRSDDNHIDVQDRKPANHSSFNLGMDRMRDRVSLRQPPYAMKGEVTTNLDFMRKRKPTSDLNMMMDQKIYTCEFLQCPYSELRLGFNDRTSRDNHQLTCPYRTSSEFSGSSFHVNEVKPVIFPQSFAPPKSNAPPGQLSSVIFPTLFHLSPEDGQKLISELIYDTNIQGNKNNLNTGNSATTENQKSPSIKRSNLNKMIDFRDQGLMMEGNFFDGSNVSSSHQMFTRDEGQSDRFKPMNSPFENNHHHHNNNNNNFHLMFSSPFDLSTFDYKEEVPGVAAIDTLSKQQDVSM

SEQ ID NO: 3734 - protein, 346 aa, Arundinella hirta
PSVKHMFPFCDSSSPMDLPLYHQLQLSPPSPKPDQSSSFFSYPCSPPFAAADASFHLSYQLGSAAATAPPQAMINSPEQPLMQEQDPPPATELGACPSAPGAGGVSHDRSPAAARKDRHSKICTAGGMRDRRMRLSLDTARQFFALQDTLGFDKPSKTVQWLLNAAKTAIQEKMADDASSECVEDVDGSSSLSVDGKHNAAAELAGGDQKPKDNGRSEGKKPAKARKAATTPKPPRKSGNNAHPVPDKETRAKARERARERTKEKHRMRWVKLASAIDVEAGAASVASDRPSSNSLNHHSSSSMNMPRAAGELEERCSSTLNNRGSSRMQEITGASDVSLAFANGG

SEQ ID NO: 3735 - protein, 505 aa, Arabidopsis thaliana
MSSTFNPAASSPDEEETGEVKIEDQCVENKQSTPASCSSVSEGSAGSSHKSPTIASPATVSPTHRYLGRTSGPIRRAKGGWTPEEDETLRQAVDTFKGKSWKNIAKSFPDRTEVQCLHRWQKVLNPDLIKGPWTHEEDEKIVELVEKYGPAKWSIIAQSLPGRIGKQCRERWHNHLNPDINKDAWTTEEEVALMNAHRSHGNKWAEIAKVLPGRTDNAIKNHWNSSLKKKSEFYLLTGRLPPPTTTRNGVPDSVTKRSSSAQKRVFGSVAQTSSVTTDVNNLAEDGNGQINSSVPVEEVVAASRMTSLNEYARSPQLPNPEPLPENGGAANNGYHLYYTPQIDYYRASEVDTQRMYGNECGCSPSASPVSFFTPPPCRNVHSNGSTPRSPESYLREAGRTYPNTPSIFRKRRPRVVVQDNNNAKKTDEAKEVDQKVNDGKDSSEIQNNGSNAYNLSPPYRIRSKRTAVFKSRQLEFISREEEKADDETKSSEKDMLIDGDSQLLG

SEQ ID NO: 3736 - protein, 209 aa, Zea mays
  misc_feature (171)..(171): Xaa can be any naturally occurring amino acid
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQXNILTEDGQSSESVMTALHSGSSLDCDDGSDISLKLSLP

SEQ ID NO: 3737 - protein, 311 aa, Arabidopsis thaliana
MTSHQNIKISEKIMISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKKKATPKKPEANQKNKKAHVEHIS

SEQ ID NO: 3738 - protein, 288 aa, Oryza sativa
MDHILKLEPTMHTECGRRARRPAPSRYKVGASSVSATLSSYTRVINMVTVREEIRKGPWTEQEDLQLVCTVRLFGERRWDFIAKVSGLNRTGKSCRLRWVNYLHPGLKRGRMSPHEERLILELHARWGNRWSRIARRLPGRTDNEIKNYWRTHMRKKAQERKSNMSPSSSSSSLTYQSCHPETPSMIIGIEEQELHGGSGCITSIMKSTPVDMDGYPMDQIWMEIEAPNVLPGPCFDEAKDSASNSLSGPLLPYPMWDYYCPETCLRMDDEIKVAPQFGYGKGVGPCY

SEQ ID NO: 3739 - protein, 242 aa, Liriodendron tulipifera
MGRGRVELKRIENKINRQVTFAKRRNGLLKKAYELSVLCDAEVALIIFSNRGKLYEFCSTSSMFKTLERYQKCNYGAPEAAVTTREIQSSHQEYLKLKARVEALQRSQRNLLGEDLGPLNGKELDTLERQLDVSLKQIRSTRTQYMLDQLTDLQRREQMLSEANKALKRRLDEGMQANPHQGWNHNPHAMEYVRQQGPPQGDGFFHPLDCEPTLQIGYQTDQITMSTAPGPSLNNYMPGWLA

SEQ ID NO: 3740 - protein, 253 aa, Brassica napus
  misc_feature (31)..(31): Xaa can be any naturally occurring amino acid
  misc_feature (237)..(238): Xaa can be any naturally occurring amino acid
SETSALFFIKKYLLDDLSPLPNATTTNPWEXSSDFSFFGSFDQTGFDFPEFETKPEITDTPLAPNDSFTFQSNPPVVSQSNRKPPLKIAPPNRSEWIQFAAGKPQREQVPLPQVAAEEKRHYRGVRMRPWGKFAAEIRDPTRRGTRVWLGTFDTAIEAARAYDQAAFRLRGAKAIVNFPLEVGMWEPRAENGQNKRKRDGAEEEETRVVAKVVKTEESHGVEQVTSSLTGVDDWDLXXSFLSMPLFSPLSPHP

SEQ ID NO: 3741 - protein, 165 aa, Brassica napus
MDDSSNAKSNQCPPPLSNPTPTPFRGPYHRRAHSEVQFRLPEDLDLSEPFGGFDDLGSEDDIFCTYMDIEKLGGSGSDNPFTGENVGRGEEGGSSSSRPRHRHSLSVDGGSSSLESIEAKKAMAPDKLAELWVVDPKRAKRIIANRQSAARSKERKARYIMELER

SEQ ID NO: 3742 - protein, 231 aa, Hevea brasiliensis
MDVFPQYSDSLPFATHSCSLHYPESSTLSDTCSALRANLSDEEVLLASSYPKKRAGRKKFRETRHPIYRGVRRRNSGKWVCEIREPNKKSRIWLGTFPTEEMAARAHDVAALALRGRSACLNFADSSWRLPVPASREAKDIRKAAAEAAMAFQPEGTEGFSGELKQENKWTTESAPEDVFYMDEEAVFAMPGLLASMAEGMLLPPPQCVAGSGGEDGEMDAADVSLWSFSI

SEQ ID NO: 3743 - protein, 269 aa, Zea mays
MEVEGMGVQQVEDGEEEVQAPRKEEASPAKELDLLGALGSDQPPEVEAVAPRKEKEKAMVAEPEDDKSPATAPGGAEKKRTFKCNYCLRKFYTSQALGGHQNAHKRERSLAKQRGAAVAAAAGRGLYGGADPFPPPHHLRFQHAWPYSAGGSRPSSFPGFGRGSAAAPFYGMHHWWAAHAHAHTQPSMAGLTRRTGADDRTVYAPHGYGSSSKAPAPAVLDSGLSGLRWSGAAVDSGAAASGDPGVAQHEAPTQHEEAKSCKIDLDLRL

SEQ ID NO: 3744 - protein, 374 aa, Solanum tuberosum
MNYSTYTQFVASRRMGICEPIHQMGMWDDFNASCPSTSATMILEVEKCLEDQIPIIDKRLDIETEDTSHGTVGTSNRYEAETSKPIEKVLRRLAQNREAARKSRLRKKAYVQQLENSKLKLIQLEQELDRARKQGLYVGAGLDASQLSYSGTASSGTAVFDTEYGQWVEEQNRQTNDLRNALHHSQISEAELRIIVDGCLNHYFELFRVKATAAKADVLYIMSGMWKTSAERFFMWIGGFRPSELLKVLTPHLELLTEQQLREVCNLRQSCQQAEDALSQGMVKLHQILGEAVAAGRLGEGNYSLPQMGPAIEKLEALVRFVNQADHLRQETLQQMSRILNTHQAAQGLLALGEYFEQLRVLSSHWATRLHEPA

SEQ ID NO: 3745 - protein, 395 aa, Oryza sativa Japonica Group
MSISVNGQSVVPPGFRFHPTEEELLTYYLKKKVASERIDLDVIRDVDLNKLEPWDIQERCRIGSGPQNDWYFFSHKDKKYPTGTRTNRATAAGFWKATGRDKAIYSSSNRIGMRKTLVFYKGRAPHGQKSDWIMHEYRLDDPSSASASVSVNLPSYYSSSSSSSSPMHGVAGDQGAQEEGWVICRVFKKKNLVHHGGGAAAASHHAAAKLAAAAMEGSPSNCSTVTVSDHVKAQMLHSSASDDALDHILQYMGRSGCKQETKPAAMSASSAAAAAALEQHLSTPQYGKFMKLPPLEHVAGGVGLLAAAGGGGEYCSAADASGIADWDTLDRLAASYELNGALSDVASGKNMAGFFDVVDQPAGAAAFSSGDGDLWSLARSVSSSLHADLTTMNNV

SEQ ID NO: 3746 - protein, 304 aa, Petunia x hybrida
MTTAELQLPPGFRFHPTDEELVMHYLCRKCASQPIAVPIIAEIDLYKYDPWDLPDLALYGEKEWYFFSPRDRKYPNGSRPNRAAGTGYWKATGADKPIGHPKAVGIKKALVFYAGKAPKGEKTNWIMHEYRLADVDRSARKNNNSLRLDDWVLCRIYNKKGSIEKNQLNNKKIMNTSYMDMTVSSEEDRKPEILPPLPPQPAPQQQQVYNDFFYLDPSDSVPKIHSDSSCSEHVVSPEFTCEREVQSEAKLSEWEKAALDLPFNYMDATTGATTLDNSLLGSQFQSSYQMSPLQDMFMHLHKPF

SEQ ID NO: 3747 - protein, 804 aa, Vitis vinifera
MESDRTITPPTEGVSDGFQKMRPPHGRTSGPTRRSTKGQWTAEEDEILCKAVQRYKGKNWKKIAECFKDRTDVQCLHRWQKVLNPELVKGPWSKEEDEVIIELVNKYGAKKWSTIAQHLPGRIGKQCRERWHNHLNPAINKEAWTQEEELALVRAHQIYGNKWAELTKFLPGRTDNAIKNHWNSSVKKKLDSYIASGLLAQFQGLPLVGHRNQSIHSSSSRMQQSSGDDSGAKGGIEAEEISECSQGSTAVGCSQSVSEMSNSGLHTREEFQMTEESGQGKEQSSSPISCSKQYYASIEEVTLSIPEIPCELDCPSNYLEPNFPHDARISGSVERQFNSNEQPAISSFELGQASSGLSSHFNGGNENRDTVSIPLQTSVGLNASSSMGNMGVDSDIPEHLLISEGDCCGFRFQEAGTDEYFSSENLTRCTNAIELECTDPLVCQSSDFQISETSGTSASQPYYPLRSEMLEASCCQSLLSVPSVHPAVDCTFIFGTETNQLSDCSLQTQGLDDFIYTNDSTNSICHNGTENKDLQEQPGPAKDSVNLVPVDSFGSGPSDIMHTCPSREGKQLAHTEQQDEGALFYEPPRFPSLDIPFFSCDLIQSGSDMQQEYSPLGIRQLMMSSMNCLTPFRLWDSPSRDDSPDAVLKSAAKTFTGTPSILKKRHRDLLSPSPLSERRSDKKLESDINQGFFCTSSLTKEFSRLDVMFDNSGTNQKSNSGPFDEDKENLGHVFVVGKEERRDGPPSSHNRNSEVDFDGRNSLDNIRQGNVDVDAKTKFDADADVQIVSVFSYFVSLSALCFYK

SEQ ID NO: 3748 - protein, 407 aa, Zea mays
MPSPPKDRSSGRLGRFLAALRPSRAGPLPVQTGFPTSLADLVVKNHGRLKKQPSPSSKRGRRAAAAAAAASPSPSPCSPTTSPSPSPSPPPASPPPPAAAAAVSPSDRPRPDLPPAQPPRGFGLGFLAVSGVVSLALLVIWSKKVVAAVTVAAFSLYLLESVRSSSLPRRRPRPRPGPGAAERRLCLDGRGRVSPIREVDAADTEPSRPSCSDSDRASEAEGRSGVLDESSNTKAKARNKSWKKLLAVAGAKKLQRGRRSKEADSSGSFRSDGDREDAATACGGGGNARAADSSGSRRGSASQSDVLAEDGAAREADSSMGSRRSQGVEVEIDADVIEVEEEEEQAGTGFPALVLVAVVLVGLVAGKAVALALTVLCSAFLSSDRRSPCGGGGGGCSQGRRLEPSMP

SEQ ID NO: 3749 - protein, 770 aa, Zea mays
MDTPDRPRAAAAAGFEDSPVFNFINNLSPIPPPKPLDSAHNVQLFKSSDLAPVSSIFASPHVNPVKETKVLIRDESVHLPQELHSPSSVRTRIDTSGSFRMIRCKDIVSDNCNITCQLNEASIDSSDHTSNSTGQLTQSIQDAAGSMESDKDQCDANKTDLTISQECTGLEGMNLDESGPDKMDSSHSGIVVHENQLSEQNNDEPAAYNEGYIITHQSTSDMLTLAIPSGTETQPVNDTQMADNPYSCESLLDDQSSGYCTQNSVHEPHLYWTGAVEGSAVSYTPQTLPGALQSQLMPCNKLSEPKDYVPTEQNALSQHLRGMRRRSLFNEKAGISNKGVDKTSDHHPVNSTTPKCKTISGDNSKPLRTPPCALPGIGLHLNALATIPKEKIVPREIQSTINESSNLIGPAGSSPAPFEQNIINDDFTQTTDVATAEASSQGSPKKKRHKFDNGDGTSCKRCSCKKSKCLKLYCECFAAGVYCSEPCSCIGCQNNQSHMETVLSTRQQIESRNPLAFAPKVIHTSEPGMDLGDFSNKTPASARHKRGCNCKKSSCLKKYCECFQGGVGCSVSCRCEGCKNAFGKREGASVLGIGEPKQGLEEKDVCVKEEKSEIDKQLVVYQTTDAAPAENVLTTPSMVECRPLACLPPASSKKSSKKPRSSTKLTGHPSRPCNLQAPPKTDVVLSPFENYAEMVLGDSTSDILKGNSSPHTSVKVVSPNKKRISPPRMGIGLSPICRSGRKLILKSIPSFPSLGGDVNNEDPKAKLPAP

SEQ ID NO: 3750 - protein, 790 aa, Vitis vinifera
MLLFLRRTRGPTRRSTTGKWTVEEDDMLREAVQCYKGKNWKKIVECLKDRTVIQCQHRWQKVLNPEIVKGSWTKEEDEKMMKLVKIYGPKKWSNIAKHLPGRIGKQCRERWHNHLNPAINKEAWTEEEDLALMHAHQIHGNKWAELTKFLPGRTDNAIKNHWNCSVKKKMDKYMASGLLAQFKSLPDVNYQNHSLHSLSLGAQDSNGNDSGVEHGKETEEITDYAKTSTVIDYSQSANRTANAVPSTREEFQMNEESIQGKGQHISLVSDSNRCHNSAEGVSFSLPEMPDQPRFSKVLGKNLSYDAGTFESRDWQFALQELTNISSLDLGQDLIKVSKHCICASGNHEMLPGPVLNAVGLTSSVMQNVEACSDQPVNMLISKCDCCPVIFPEAENHECLSFRDHLDCSAICNLDGCTDSLHYQSSNSQSSEISETLASQSIHPLRSELLGTSSCQTSLPVALPDDDSTPIFGSEPNHLNDASLGTTEQEPVTCSQAGFIHTNDSASSPCDNGTDSFGLHIQPDNKESSRSVHLVAFVSGPSDIMKNFLATDEKPIMHTEQIDSGDIFNETCCFPSLDVPFFSCGLIESDSSHQQEYSPLGVRKLMMSPMDCFSPLGLWDSPSQDVSHETDLKNAAKTFASSPHILKKRHHELLTPSSQKRCEKKLGNAMNHGLYCTNSLTRDFSCLDLMLGENGDKASFVSPKNIQKKNSRPCMEDKENLSCAPERKKEWRNDAALSNHAIPGMNFDRSCPSDKIEKSSNVLAAEAKVDADAAVKVVSSIFLALVLYTSN

SEQ ID NO: 3751 - protein, 310 aa, Triticum aestivum
  misc_feature (72)..(72): Xaa can be any naturally occurring amino acid
HSYARQYADPYLFMHQQPSLTVESSRGMHTENNEMHFWNGPSTAYSNSRDQAQDFRFTEHPSNWLSPQFSRXEQPRVIRPHASIAPIELEKTTEGSDFKIFGFKVDTASAGFNHLNSPMAGTHEPVLQTQPSVSLDHLQTDCSPEVSLSIAGTTENEKNMQQCPQSSKDVQSKSHGASTRSCTKVHKQGVALGRSVDLSKFVDYDELTAELDKMFEFDGELLSSNKNWQIVYTDNEGDMMLVGDDPWEEFCSIVRKICIYTKEEVQKMNSKPSGPRKEEGSVDGDGATEKAHLPESSDLNSSQLGCVKAD

SEQ ID NO: 3752 - protein, 324 aa, Arabidopsis thaliana
RTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIACQLEPLTEQQSLDINNLQQSTQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 3753 - protein, 158 aa, Oryza sativa Japonica Group
MEKEIISARSTTTTTTTAAAGDVNLDLRLVHSTAAGRQHTAATRNPAPPLAAAGDDRAFSCTYCRRRFYSSQALGGHQNAHKLERSLAKRSRELSAGVTTAAAPPPPHPELGWPYPPQGGAAAAVVSWIADGGRRYGYRVHAAAAGGDAEDIDLSLKL

SEQ ID NO: 3754 - protein, 390 aa, Arabidopsis thaliana
  misc_feature (314)..(314): Xaa can be any naturally occurring amino acid
MPTLYKKAGCLGIREFMEDNDAAYDQVKSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAKHFYTTSESLLRHELLPSYGYLSNTQEEDEFYLKTIMTSEGNDWPSYVTNNVYCLHPLELVDLQDVMFQSYGTCIFANGTCGESDKCDGGYWKILHGDKLIKSNFGMVTGFKKVFEFYETVIHRYFCDGEEVKEEATEXERLGHQRCQGLLLPHRRGHVQTKSCGVVTVKEKRSLVEQPEEIVAAPETPRQGKSEHNDPLKRKKAIGCVGEKAEM

SEQ ID NO: 3755 - protein, 250 aa, Zea mays
MVKGAHFQDAAVDGGAGGNAEAAMQGGAKRQYKGVRMRSWGSWVSEVRAPSQKTRIWLGSYSTAEAAARAYDAALLCLKGSAAADLNFPVHLPFHVPAAAAMSPKSIQRVAAAAAAASGGATCSPPQLQAGAAASAPYSAGGGAGATPPCSYGDASSSSGVSSPETGRNAGLCYGTAHYDDMDMDLAGDADADLAALADIEAFFQSPKCMEYAMMDPCSTFFAPAPVATDAASEWAEEGEIDLWSFSSLN

SEQ ID NO: 3756 - protein, 438 aa, Oryza sativa Japonica Group
MAAAGNSFLNQELVKVADGVSDWHLPSSSHGGTCHTNTRGAPITVGVPDLGCPVSSIGMATSSSLMPKEGLTTASYNSVVAFPVGATMVPQQQQTQAAGSNDNPGLVKGGWTREEDEVLRQMVRHHGDRKWAEIAKSLPGRVGKQCRERWTNHLHPDIKKDIWTEEEDRMLIEAHQTYGNSWSAIAKQLPGRSENTIKNHWNATKRSLNSKRRLRKKNSEQTVPGQPSLLESYIRSCQHMLPSETVPPPPAPFDISRYGNSGVIGASPTLPVVQEPGTSTPPGLVMFLDLLNQAIPHPPQPETMDLFNMTPEVSHLNTSGYCLQLDAGGNLYYGRLPAPAPVQPHGISTQELQDTPQLSLYYPLSSFAGSHTDGTVEFNHQLSNPNGGHYGEEAGPSSVATGGSANGMDDNDVVQMASNQFMMPSEDEGILDLARWIN

SEQ ID NO: 3757 - protein, 366 aa, Capillipedium parviflorum
PSVKHMFPFCDSSSPMDLPLYQQLQLSPPSPKPDQSGSFYCYPCSPPFAAAAAEASFHLSYQIGSAAAATPPQAVIDSPDLPVKPLMEQAPAPATELAACASGAQGAGVSLGLDGAPAAARKDRHSKICTAGGMRDRRMRLPLDTARRFFRLQDMLGFDKPSNTIEWLLREAGLAIQALNMANDVDASSECVEDGSSSLSVDAKQHNPAEQLGGGGDQKPKGNGRSERKKPAKSRKTATTPKPPRKSGNNAHPVPNKETRAKARERARERTEEKHRMRWVKLASAIDVEAAAATSVASDRPCSNHLSHHHHHHSSSSSSMNMPRAAVADELQERERCSSSALNNRGRTMQEITGASDVVLGFGNGG

SEQ ID NO: 3758 - protein, 996 aa, Arabidopsis thaliana
MPAIASKQYSDDVSLLVLLLDTNPLFWSTTSITFSQFLSHVLAFLNAVLGLNQLNQVVVIATGYSSCDYIYDSSLTSNHGNFESNGTGMPAIFGSLLKKLEEFVTKDEELSKEEVSEDRIPSCLLSGSLSMALCSKPIACLRPSMLSDIQRVFRSGHLHPQPRILCLQGSPDGPEQYVAVMNSIFSAQRLMVPIDSCYIGVQNSAFLQQASYITGGVHHTPKQLDGLFQYLTTWRTNETEGRESSVWRAMDLKKRRKILEKKKTIHDLIKRASSIDDPLSPFDSFRRYRRNVLTCFVLSSQKSLDDLSLYLESGRGDRLSSSVKHHIQKLLKTNMEGFYGSDWPIQAKVKRKEMSSADAHYIFVRELRFGKAYETSTQRTCMEGCNQIAGFVHYRFILEEEIPVLYVYEIQLESRVQGKGLGEFLMQLIELIASKNRMSAIVLTVLTSNALAMTFYMSKLGYRISSISPSKANLPTLSVKYEILCKTFDSEAKSVLEKTDESDEDLVPPMTWFTPEADTELQQCLATAKLTILKPESSQQTSRLQPAETKFEIFGGRITCRVLIEAGFVRIIVAARKRFRYFLMAAEDRSEELSSNVENGSCNSNEGINPETSSHWIENVVKVRKPYTVTKQREKWSEEEHDRFLEAIKLYGRGWRQIQEHIGTKTAVQIRSHAQKFFSKVLFVHMFHNISSTDLMAQEADSRSEGSVKAIVIPPPRPKRKPAHPYPRKSPVPYTQSPPPNLSAMEKGTKSPTSVLSSFGSEDQVNRCSSPNSCTSDIQSIGATSIDKKNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRAPICWVTWIIAFHEPNPKSELINIRVKLQTLRIETLCKGNPLNFCGHLLKNWSPQV

SEQ ID NO: 3759 - protein, 345 aa, Danthoniopsis dinteri
PSVKHMFPFSDSSSPMDLPLYHQLQLSPPSPKPDQSSSSFFYYPCSPPFAAADASFHLGCQVAAATPPQDVIESPDLPEHPAVMEQAPKPKPDAGNAQGAGGSVDRSAAAAARKDRHSKICTAGGMRDRRMRLSLDVARKFFALQDMLGFDKASKTVQWLLNTSKAAIQEIMTDDASSECAEDGSSSLSVDGKHNPPAELQPEGDQQPKASGGGRSEGKKPARARKAAATPKPPRKSGSAHPVVPDKETRAKARERARERTREKHRMRWVKLASAIDVEAAAASAARDRPSSSNLIHQHSSSMSMPSAAAELEERCSSSTLNNNGGRMQEISEASDVMLAFGNGG

SEQ ID NO: 3760 - protein, 237 aa, Neurospora crassa
MATATESAPRNHLADKPENSMGGRNLSIITPTIQMSAPPGDPMDITSSNSNSSSNSNSSSINNNNATMAAPSNSDSLPPPKSPVEDTLNAQAAPNGRPQLSSANDQLSPDNIIMPAPAAAAPAVHQPKIVQTAFIHKLYNMLEDKSIQHLISWSPTSESFVMQPSQEFSKASSQYFKHTNISSFVRQLNMYGFHKGKESPDVAGYQQSLTWSKSERCLPPWSSRRYHLGVQAWQRQL

SEQ ID NO: 3761 - protein, 174 aa, Zea mays
MGHHRGGCRCELCGAPAAVHCAADAAFLCAACDAKVHGANFLASRHRRTRLLLAAPDECGYESGASSCVSTAVDSAARALRAHAHGLASARVAMAAALWREVAVRGGTGGGGHGHGEALRRLEACAHVPAGLVVAVAKSMARARGRGDEADTDAAAEGWDECAWAGPKSSPPRP

SEQ ID NO: 3762 - protein, 635 aa, Cochliobolus heterostrophus
MLENPSDESVVRWGNDGDSFVVLENEKFTKHILPKHFKHSNFASFVRQLNKYDFHKVRHNNEENGQSPYGPGVRFAHALCGYCPLGAWEFKHPDFKMNNKDALDNIRRKAPAPRKPNQAAAEDFAPSQQMDMVSGQLMATQAQLHQLEGRYNELNIHHSMLLQEVIGLQKTVVNHEHVMQQIMTFLHGVDATQRRNSKLVFNGGEAQNGNMDPPSNNDDDNPASPLQHASKLLSETNADAMLNPRNLEHMNEITMRMNGTLTTPPPDFARAQMRPTSRGPPSATSTNSMRLDNLDNLVYPVGSSNGIDPMYSEHINNIPYAAPPKAVDQNEPKVPEGKKKSAFPDPGWIRPPQILLVEDDPTCRRIGSKFLYAFHCSIDSALDGLEAVNKMNAGSKYDLVLMDIIMPNLDGVSACHLIRQFDTTPIVAMTSNIRSDDISMYFQHGMNDVLPKPFTKEGLLHMLEKHLVHLKKPSAQGDGSMVAPQPVPIARQLVLKEEESPGKSPQAVSNWNSPNQIPGVSPVGTSVPEDFAQAMRGQPVQHPNSYGVNPMQGNMGYNASSHMQIQSQQQQQQQQQQQQQQQQQQQQQQQAQLQGHRRQVSEISGGDDMNNPAKRQQMYPPQMQQQMGGMQPRPH

SEQ ID NO: 3763 - protein, 228 aa, Zea mays
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDSQFLEQINDLERKSTQLAEENMQLRNQVSQIPPAGKQAVADTENVIAEEGQSSESVMTALHSGSSQDNDGGSDVSLKLGLPCVAWK

SEQ ID NO: 3764 - protein, 356 aa, Sorghum matarankense
PSVKHMFPFCDSSSPMDLPLYQQLQLSPPSPKPDQSSSFYCYPCSPPFAAATADASFHLRYQIGSAAAANPPQAVINSPDLPVQPLMEQAPAPATELGACASGGAQGAGVSVGLDRAAAAAAAAARKDRHSKIRTAGGMRDRRMRLSLDIARKFFALQDKLGFDKPSKTVQWLLNVAKPAIQKIMVADDVDVSSECVEDGSSSLSVDGKHNSAEQLGGGDQKPKGNGRSEGKRPAKSRKAATTPKPPRKSGNNAHPVPDKETRAKARERARERTKEKHRMRWVKLASAIDVEAAAASVASDRPSSNHLSSSTNMPRAAAAELEEMERCSSTLNNRGRMQEITVLGSDVALGFGNGG

SEQ ID NO: 3765 - protein, 607 aa, Medicago truncatula
MEISIMRNLYDASLKGCVSSLKALIQKDPLILSRVSLYPFSETPLHIASLLGHLELCQILLDINPNLAAEVNSEGHCALHLASAKGHIEIVKALLLTDQETCLIRDKDDKLPLHFAVMRGHVGTIKELISAMSETETIRVMAEIDDHGSILHLCVFYNHLEALKILVESMRGNIDQFLSSKDKEGNNILDLAVKRGQIKIIKYLLSLSEMSETINTSKTEALRALYMLEHSPRDFSSHTIQHILTEERAQTSTNIVIGQQDHVNSPSNDPQQLLEQQSQINGHEQSQTPSPNNDPPQNQQPSQNIDPPQPPQSSPINDPQVQLVQSPISHPLQLTNHSPPNSPSQPPSHNPSPTNEPQHPQSPSPHNDPTQEITHSSPGLNPLPPPPPFSPSDDPSPTPSIANEQHEHNRWDRVESFCNKYLINQGYWIDKKTREQLMVAATVIATMTFQSVISPPGGVWQEDTTKGGYACPDYGFCEAGTAVVGYVWSPDYLKFIFFNSASFFASLCVLLVLVSGFPLHNKFIVWVLAVLMIVAITCMLLTYMWALGLVSPNHIFYRIRDLGFILVGIWSFLLFVVCLIQIARIVFWVRSKRRSSSRSSSSTDVAL

SEQ ID NO: 3766 - protein, 342 aa, Medicago truncatula
MEILQDDTMRELYNASLNRSVSSLRTLIQRNPLILSKVSLYPFSITPLHIASLLGNFEFCQILLDIDPNLASEVNLEGRCPLHLVSAKRYTKIVRAILLTNSKTCFIRDKDDKIPIHFAAMRGRVEAIKELNSVMPETEIIKVMFETDDHGSILHLCVRYNHLEALKILVKLVRGNHRLRFLSVKDKEGNNVLHLVVRRAQTKDHMLSPHNDSPQPQLLPTQTSPDGTCLRTSAQHTQGNWIDKKTKEQSMVAATVIATMTFQSVISPPGGVWQEDTKHSVSFCNGSRSNKLKNRKQKLEKKRNGRERDNNNVYYAANFLYIIHTSFLHTYSQILSNNSAYV

SEQ ID NO: 3767 - protein, 296 aa, Glycine max
MEDIYKMNPLLSCSGGDVVREVNVNSATGASELNLGLVANNFFSDISDRFIKSQIATHPLYPNLVSAYIECRKVGAPPELASLLEEIARESYPTDALREIGDDPELDEFMESYCEVLHRYKQELSKPFNEATLFLCSIESQLSNLCKGTLTMPLDNNHSDEAAGTSEDELSWEKVEAVEGHESSGPRPGDQELKEMLLRKYGGYLSSLKKEFLKKRKKGKLPKDARMVLMDWWNTHYRWPYPTEEEKVQLSEMTGLDQKQINNWFINQRKRHWKPSEDMRFAIMDGVSGSGFGGPI

SEQ ID NO: 3768 - protein, 619 aa, Oryza sativa Indica Group
MVGSSEDEPCSGDADAADFGQEHSSRLADHELKEMLLKKYSGCLSRLRSEFLKKRKKGKLPKDARSALMDWWNTHYRWPYPTVMSRKRLFDTQKPLTHTDLGLCLPTDLSQEEDKVRLAAMTGLDPKQINNWFINQRKRHWKPSEDMRFALMEGVTGGSSSGTTLYFDTGTIGLLDTFGKQILRVSRSVVLGFGCFMGVLATGFVYGIIPEKGKPVSSASDNLRSWWKEKKTNSEIGENLLKGDLWDPDISDGSVVQRVGDDDSQHGASTLGSPIPFLPEGQTFSCKVDNILRNHSAIGLKTLTLNLNDDHATFPYVDSWLQVAFTAGIEELTLRLHEKYNFPCSLLSDGVRKSIRYLELKFCAFHPTVEVGPLRSLTTLYLNSVRITGDELECLLSNSLALERLLLIDIKDIVILKIPCLQQQLNSLGVMLCQGLEVVNTPMLPSKFLHLKHLTLSMISGSAFSPSYDYFSLVSLFDASPSLETLFLDVSQGRMEHESVFGGGSSAHLRQLPELHRHDRLKSVEIMGFSSAKGLVELTCCIVKKAVSLERLVLNTLRHNSCCSKEYIPPYSPFNKVVLDEAFRAVAAIRSYIQDEVPPEVNLTVVEPCARCHSFCASS

SEQ ID NO: 3769 - protein, 185 aa, Oryza sativa Indica Group
MEDLYSIHPGISRGGGGGGGGAASEASGVAGGGSSPPHPPPPATTAAAADLTELMKAQIAGHPSYPSLLSAYIECRKVGAPPEVTTLLEEIGREGRGGGGGATAGGEIGLDPELDEFMETYCRVLERYKEELTRPFDEAASFLTGIHTQLASLCGGAPPPTDNSALVGQAHFESKVSESNKVLSL

SEQ ID NO: 3770 - protein, 433 aa, Zea mays
MVLDLNVASPADSGTSSSSVLNSADGGFRFGLLGSPVDDDDCSGEMAPGASTGFMTRQLFPSPTPPAEPEPEPVAAPVPVWQPQRAEDLGMAQKPVAPAKNTRRGPRSRSSQYRGVTFYRRTGRWESHIWDCGKQVYLGGFDTAHAAARAYDRAAIKFRGLDADINFSLSDYEDDLKQMRNWTKEEFVHILRRQSTGFARGSSKYRGVTLHKCGRWEARMGQLLGKKYIYLGLFDSEVEAARAYDRAALRFNGREAVTNFEPSSYNAGDNNLRDTETEAIDDGDAIDLDLRISQPNVQDPKRDNTLAGLQPTCDSPESSNTMASQPMSSSSPWPGYHQNPAVSFHHQRLYSSACHGFFPNHQVQERPVERRPELGAQPFPSWAWQAQGSPHVPLHHSAASSGFSTAAGANGGMPLPSHPPAQFPTTTNPFFFP

SEQ ID NO: 3771 - protein, 295 aa, Medicago sativa
MGNTNSSHNLLITVTVFAVTVTVFFILYFILRRRRFSPSSSSTVRVSPVTPTSSTSSSVVDSLPIFTFSSIKRRSSTVVSGDCAVCLSKFEQNDLLRLLPLCCHAFHTECIDAWLASNQTCPLCRSSVFVSESEIMKIFRSSSTSSGNNSFRLEIGNISHRREATATDNNNNNNNVAGETDRRTYSVGAFDYFVDEEAEIPVGNTNRRIFSGEKDDAAVLSVEVETPVDSQASLIGEGNWLKDYVDGLTRVMSFRGSGSSRRNDVVAGVGDFDVEANGNGFGEEISEMFRWISGV

SEQ ID NO: 3772 - protein, 222 aa, Zea mays
MAPRNAVPAASAVANGMVMEPRFRGVRKRPWGRFAAEIRDPARKARVWLGTFDTAEAAARAYDAAALHFRGPKAKTNFPVAFAALPPPPPKKPAAVTVSPSSSSTVESSSSSSSRDSPATPPRAASPSQQAPSLDLSLGGTPAMVAAQPFLFLDPRLAVTVAVPAPVPYRPTAVAAGANKHAAASCREEEQSDTGSSSSVVDASPAVGVGFDLNMPPPAEVA

SEQ ID NO: 3773 - protein, 225 aa, Glycine max
  misc_feature (113)..(113): Xaa can be any naturally occurring amino acid
  misc_feature (126)..(126): Xaa can be any naturally occurring amino acid
  misc_feature (133)..(133): Xaa can be any naturally occurring amino acid
  misc_feature (147)..(147): Xaa can be any naturally occurring amino acid
MDSKFRKNNRNSYTSEQDQDTDHDVAQENIAESPPSSTVFNIDGLVPSPTPSSKRRRAIQKRVVQIPMKETEGCRLKGESNTPPSDSWAWRKYRQKPIKGSPYPRGYYRCSSXRCPARKQVERSWXDPTMLVXTYSFDHNHPLPPSXTTPGPPKNPETGPEPVETRKEGRGRSMITTRRRKMGGLGENEATPGLEKPLLSRTIGAWPFFPGGRAVFPPSKAPEVS

SEQ ID NO: 3774 - protein, 288 aa, Petunia x hybrida
TDEELITHYLCPKVLDSNFCAKAIGEVDLNKIEPWDLPWKAKMGEKEWYFFCVRDRKYPTGLRTNRATEAGYWKATGKDKEIFKLKTLVGMKKTLVFYQGRAPKGQKSNWVMHEYRLEGKYSAHNLPQTAKNEWVICRIFKKSAGGKKIHISGLTRYNNNINDNSLCSNLPPLMDISSNDNQITKTATCRGDTSNYSHVTCFSNSLEDQKPQISFVDDLSTNNNHSYVENFQYGDFGLMQDHSILRLLLENNGSEPKPSYEMCTRAYEDQDLPITSAAPVDLDCLWNY

SEQ ID NO: 3775 - protein, 381 aa, Oryza sativa
MRSSLAVDRPTRPYPLPAQRPNRLPAPPVSGTGIASPRMGMGRGGAVQCTARAGAATTTTTMGEWIVPGPHVNDEEENDNGPGIRGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRKLAVATTTTTTTTGAAAAPGVVADAAELVERPCKRFSPTPDSPSGSGSGSDRSDLSHGGGFGQIFRPVARTGAFEPVDCAISRRQEEDPFTSLSLSLPGTDQRFNHDSAHSHFQELPSSPSPPPPPPPAAAASTTQYPFTPEFAAAMQEMIRAEVHKYMASVGVRAGCGDAGGADLHMPQLVEGVMRAAAERVGRMH

SEQ ID NO: 3776 - protein, 98 aa, Oryza sativa Japonica Group
MVGGGRERNGGVRQYNRSKVPRLRWTPDLHHCFVHAIHKLGGQDKATPKRVLQLMGVGGLTISHVKSHLQMYRNMRNDLGMQAATPQSLERSHCFTSN

SEQ ID NO: 3777 - protein, 351 aa, Ostreococcus tauri
MAHAAFGTSPGSFGASPTFYGSSPTAIPQVSRPMAQPERGLGFPGLSSSLPGKHHIGSPNSGFSAFSPPMNMKDSPRSLASFSSSPPVRSGGVHKPSTSVTKVKRMELARAAVSEATAAAQAVASLPNAAAVSSPPLNSSGKPQKSVYRGVRQRPWGKYAAEIRDPTRGSRLWLGTFDSAEEAALAYDAAARAIRGDAAVTNFGKDVPIPASVRSQLPPLPTRPVQGRGGGIPRDDSALSGRMSKLSTSTKPANLEEEAEMLLMLQGADSGKGSTPERSESIEDGAGGMDLDEDNGASSVTVGLTLRAQKSNAQPIAPMASMPRETGDTSNAMISALKASNVSTRPRRGNA

SEQ ID NO: 3778 - protein, 356 aa, Sorghum australiense
PSVKHMFPFCDSSSPMDLPLYQQLQLSPPSPKPDQSSSFYCYPCSPPFAAATADASFHLRYQIGSAAAANPPQAVINSPDLPVQPLMEQAPAPATELGACASGGAQGAGVSVGLDRAAAAAAAAARKDRHSKLRTAGGMRDRRMRLSLDIARKFFAPQDKLGFDKPSKTGQWLLNVAKPAIQKIMVADDVDVSSECVEDGSSSLSVDGKHNSAEQLGGGDQKPKGNGRSEGKRPAKSRKAATTPKPPRKSGNNAHPVPDKETRAKARERARERTKEKHRMRWVKLASAIDVEAAAASVASDRPSSNHLSSSMNMPRAAAAELEEMERCSSTLDNRGRMQEITVLGSDVALGFGNGG

SEQ ID NO: 3779 - protein, 366 aa, Bothriochloa odorata
PSVKHMFPFCDSSSPMDLPLYQQLQLSPPSPKPDQSGSFYCYPCSPPFAAAAADASFHLSYQIGSAAAATPPQAVIDSPDLPVKPLVEQAPAPATELAVCASGAQGAGVSLGLDGAPAAARKDRHSKICTAGGMRDRRMRLPLDTARRFFRLQDMLGFDKPSNTIEWLLREAGLAIQALNMANDVDASSECVEDGSSSLSVDAKQHNPAEQLGGGGDQKPKGNGRSERKKPAKSRKTATTPKPPRKSGNNAHPVPNKETRAKARERARERTEEKHRMRWVKLASAIDVEAAAATSVASDRPCSNHLSHHHHHHSSSSSSMNMPRAAAADELQERERCSSSALNNRGRTMQEITGASDVVLGFGNGG

SEQ ID NO: 3780 - protein, 178 aa, Zea mays
MATTHDDCVSLCLMALAAAGGGGMTTQSYAPSTAAWTTQECELRFRCSVCGKAFASHQALGGHKASHRKPTHLQTQQASSSSVTTSSAGSGGGQGRHRCSVCHRSFATGQALGGHKRCHYWDGLSVSLTASGSGSTVKGFDLNLMPATRWGEEEEVQSPLPIKKRRLSGPSLDLSLTI

SEQ ID NO: 3781 - protein, 357 aa, Picea sitchensis
MVRSPCCSKEGLNRGAWTKTEDIILCEYIRIHGEGGWRTLPKKAGLKRCGKSCRLRWLNYLRPDIKRGGISPDEEELIIRLHRLLGNRWSLIAGRLPGRTDNEIKNYWNTCLSKKLLLSMTKSQSKVMKNVKSTSKSSPVQNRVFKTTPVKVTTAVRLSETIRPKGSINGYGCSNRSTDEAFKLCNAKETTNSSKSWCDLLGNDTEGRISTSSMSLALERSPNSYYFGADAATLADSLLDLNELSSPDCSLLSPPSNCSADFGLQDFCGEPVTLTAEANEFEVVSSDQSIMQRDKGFTVLDDQGIEEFYNHTQPLDWIHELDYIEKSSPRALSFLLLESEDEREEKLGDHTQIPDVV

SEQ ID NO: 3782 - protein, 109 aa, Triticum aestivum
  misc_feature (42)..(42): Xaa can be any naturally occurring amino acid
  misc_feature (84)..(84): Xaa can be any naturally occurring amino acid
LQQYFSGSLKNAAKSLGVCPTTMKRICRQHGISRWPSRKINXGPLPTIPVGPSSDSFNKEKASESKAEHSNRAVDGDRDSSLQXKPQENGSTFGALKSQQGFADTGNNV

SEQ ID NO: 3783 - protein, 241 aa, Tradescantia virginiana
  misc_feature (228)..(228): Xaa can be any naturally occurring amino acid
VQLKRMENKINRQVTFSKRRGGLLKKAHEISILCDAEIALIIFSTKGKLYEYATNSKMDNILERYERYSYAEKALTSSDPDIQGNWCQEYAKLKSKVEALCKSQRHLMGEQLETLNLKELQQLEQQLEGSLKHVRSRKTQVMLDSISELQRKEKSLEEQNKNLEKEILEKQKIKALAQQAHWEHQNQPAPRGSPPRPFVIAESHPTLNIGHFQGRTNAVEAEENQQPXMRICSSLLPPWML

SEQ ID NO: 3784 - protein, 206 aa, Acacia mangium
VLCDAEVALIVFSTKGKLSHYSSDPCMEKIIERYERYSYAERPQAAPDRSPTENWTLEHAKLKARMEVLQRNQKHYRGEDLEGLSLKELQNLEHQLDSALKHVRSRKNQLMYESISEFQKKDKKLQEQNNLLAKEIKEKEKALAEKAREEKHNDEDALVQPQLPPSNIGEIVEARGGAEDNEATTTHHQPRSGPLLPSWMLPPISE

SEQ ID NO: 3785 - protein, 303 aa, Populus trichocarpa
MTPAYLNPASSSFPFVDLREEQNLQLFLSPHQAATSLSGPTNFFNTSAHDHQRETKPGESRQHDNQEVDMYNISHGGSSSSFQPEVNDHNYNSNFHNLSSSKMEDGAEESGESSVKWMPSKMRLMQKMTNSNCSETDHMPMKFMLKFHNQQYQNNEINSSSNSNSNIRVCSDCNTTSTPLWRSGPRGPKSLCNACGIRQRKARRAMAAAAAAANGTVIAIEASSSTRSTKVNNKVKKSRTNHVSQNKKLSKPPESSLQSQKKLCFKNLALSLSKNPALQQVLPHDVEEAAILLMELSCGFIHS

SEQ ID NO: 3786 - protein, 222 aa, Tradescantia virginiana
  misc_feature (11)..(11): Xaa can be any naturally occurring amino acid
  misc_feature (218)..(218): Xaa can be any naturally occurring amino acid
  misc_feature (221)..(221): Xaa can be any naturally occurring amino acid
GLVKKAHEISXLCDAEVALIIFSTKGKLYEYATDSKMENILERYERYSYAEKALTSSDPELQGNWCQEYVKLKAKVEALHKSQRHLMGEQLEALDLKELQQLEHQLEGSLRLVRSRKTQMMLDSISELQRKEKSLEEQNKNLEKEILEKQKEKALAHQAHWEQQNQPLQSTNSPPRPFVIAETHPTLNIGNFQGRTNTVHAEESLQRQMRISSSLLPXWMXH

SEQ ID NO: 3787 - protein, 289 aa, Triticum aestivum
MSGGRQTYWCFQCRQRVRPRGREMECPYCDAGFVAEMDDVDALMSQFVGMYSDFHRDPRFGIMEAMSTVMRHGMGSMNREADVRGRPSILSDLEMEFGSGPWLLFRGQLPGHLSEANSGFDVFVNGRRGVGMRRADVADYFVGPGLEDLIEQLTHNDRRGPPPASQSSIDAMPSVRITARHLTGDSHCPVCKDKFELGSEAREMPCKHLYHSDCILPWLEQHNSCPVCRYELPTQSSSGASCSRSRSTNQNDSSSSSSSSGRTSGRQRRRNPFSFLWPFRSSSSSTGSR

SEQ ID NO: 3788 - protein, 199 aa, Tradescantia virginiana
GLVKKAHEISVLCDAELALIIFSPKGKLYEYATDSKMEIILERYERYTYAEKALIASDPDVQGNWCHEYIKLKAKFEALNKSQRHLMGEQLDTLNQKELLQLETKLEGSLKNVRSRKTQLMLDSISELQEKGKSLQEQNTCLEKEILGKQKDKAPKQHVQWEKQNQPPPTSSAPMPFLIGDIHPTPNIRNFQGRTVADA

SEQ ID NO: 3789 - protein, 465 aa, Arabidopsis thaliana
MDNGNDQQIDVGSVVEAVSADHSFGAPLYVVESMCMRCGENGTTRFLLTLIPHFRKVLISAFECPHCGERNNEVQFAGEIQPRGCSYHLEVSAGDVKTFDRQVVKSESATIKIPELDFEIPPEAQSGSLSTVEGILSRAADELSALQEERRKVDPKTAEAIDQFLSKLRACAKAETSFTFILDDPAGNSFIENPHAPSLDPSLTIKFYERTPEQQATLGYLTNPSQTGQSERSLGTPSTQTTALPHGTIGATAGHRAIAQSNSTDISDNLFRYSAPEEEVIVMASTCDDCGYRNSELKPGGAIPEKGKKITLSVKNITDLSRDVIKSDTAGVKIPELDLELAGGTLGGMVTTVEGLVTQIRESLARVHGFTFGDSLEQSKINKWKEFGSRLTKLLSLEQEWTLILDDELANSFISPVTDDIKDDHQLTFEEYERSWEQNEELGLNDIDTSSADAAYESTEPTKLP

SEQ ID NO: 3790 - protein, 385 aa, Oryza sativa Indica Group
MSGEYQFQDELAPLFARPGGGAGEMQMLPSSWFADYLQAGTPMQMDYDLMCRALELPVGEDVKREVGVVDVVAAGGGGAPPLTPNTTSSMSTSSSEGVGGGGGGGAGAGAGEEESPARCKKEEDENKEEGKGEEDEGHKNKKGSAAKGGKAGKGEKRARQPRFAFMTKSEVDHLEDGYRWRKYGQKAVKNSPYPRSYYRCTTQKCPVKKRVERSYQDPAVVITTYEGKHTHPIPATLRGSTHLLAAHAQASAAAAAAHQLHHHHGHHGHHGMAPPLPLGSGAAAQFGRSSGIDVLSSFLPRAAAAHHGMTTMGGAAATTTTSHGLNSAISGGGGVSSETTSAVTVAASAQPSSPAALQMQHFMAQDLGLLQDMLLPSFIHGTNQP

SEQ ID NO: 3791 - protein, 398 aa, Zea mays
MVAVKQLTGPARPAHTCAAHAHQLLSARYDHRGASQAELPDRISPSNASTFCTSMYSSSAADSSKSCRQAGALPFLPHPPKREQQQQQSSSSPSLLVCTDLGNGGQDEAEAEHPAELKDFLNLSGEASWRGGFHGESSGVAFRFREKVEFQFLSEQLGIAITDHDESPRLDDQEDIYDRPPQTSSCPVLSCSNQEEGLQRAGSPVKAQLSSYRAACNNKPRLRWNLELHELFVKAVNKLGGPEKATPKGVLKLMKVEGLTIYHVKSHLQKYRFAKYLPETKEDMKSSSEDKMPGSNPGRKKILKSLQVAEALRMQMEVQKQLHEQLEVQRQLQVRIEEHAKYLQKILEQQKARNSLSATTSSIQTELSESTKEEKPETQADTSSAQLPNKKNSDTDME

SEQ ID NO: 3792 - protein, 299 aa, Triticum aestivum
  misc_feature (220)..(220): Xaa can be any naturally occurring amino acid
  misc_feature (238)..(238): Xaa can be any naturally occurring amino acid
  misc_feature (278)..(278): Xaa can be any naturally occurring amino acid
  misc_feature (283)..(283): Xaa can be any naturally occurring amino acid
MSGGRQTYWCFQCRQRVRPRGREMECPYCDAGFVAEMDDVDALMSQFVGMYSDFHRDPRFGIMEAMSTVMRHGMGSMNREADVRGRPSILSELEMEFGSGPWLLFRGQLPGHLSEAKYGFDVFVNGRRGVCMRRADVADYFVGPGLEDLIEQLTHNDRRGPPPASQSSIDAMPSVRITARHLTGDSHCPVCKDKFELESEAREMPCKHLYHSDCILPWAXEQHNSCPVCRYELPTQSXSGASCSRSRLTNQNDIQATQVAVGRTSGRQEEKDPFSFLXAFRSXSSTRFLIIGTGIHNAT

SEQ ID NO: 3793 - protein, 422 aa, Nicotiana tabacum
MAYNPNHMSQEMDMHHFSDENSAVLRSILPEQLAQSSPDVKPLDHQQPPTWLNSAILRQESHYTGTGGRGVGENFLNLHSNSESSAAASQASNQWLSRSILRRNVSDVQTSNNSSAVIAAADLKNDDGNNNNDNGNNNAGGQLTDSEVVGGGGTDGILNWQNAGYKAEILAHPLFEQLLSAHVACLRIATPVDQLPRIDAQLAQSQQVVAKYSTLGQNIGDDKELDQFLTHYVLLLCPFKEQLQQHVRVHAMEAVMACWEIEQSLQSLTGVSPGEGTGATMSDDEDDQVDSEANLFDGSLDGHDGMAFGLPTESERSLMERVRQELKHDLKQGYKEKLVDIREEILRKRRAGKLPGDTTSVLKAWWQSHAKWPYPTEEDKAKLVQETGLQLKQINNWFINQRKRDWHSNASSSTTSKSKRKR

SEQ ID NO: 3794 - protein, 193 aa, Cucumis sativus
  misc_feature (193)..(193): Xaa can be any naturally occurring amino acid
TGDEGNNEYKKGLWTVEEDKILMDYVKAHGKGHWNRIAKKTGLKRCGKSCRLRWMNYLSPNVKRGNFTEQEEDLIIRLHKLPGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFINX

SEQ ID NO: 3795 - protein, 400 aa, Oryza sativa Indica Group
MSISVNGQSCVPPGFRFHPTEEELLNYYLRKKVASEQIDLDVIRDVDLNKLEPWDIQERCKIGSGPQNDWYFFSHKDKKYPTGTRTNRATAAGFWKATGRDKAIYNAVHRIGMRKTLVFYKGRAPHGQKSDWIMHEYRLDDPATDTAAATPTVTSAAAAAAAMAAAADGGQEDGWVVCRVFKKKHHHKEAGGGGGKHGGDGSAGAKAAHAYSSSDDALDQILQYMGRSCKQEHELPSPQASGGGGAGAGSRPASRYLRPIDTVLGGHGFMKLPPLESPSAATALSSTPSTGGDAASSAAAAAADHLLLHHHHRTDWAMMDRLVASHLNGANSDAPDDQLCFDAADDDGLAYYSAAATRLLGGANAGTDDDLWSFARSAAPPPPPPPPSSATPERLSHVAL

SEQ ID NO: 3796 - protein, 263 aa, Triticum aestivum
  misc_feature (195)..(195): Xaa can be any naturally occurring amino acid
MIEQVCTKKQAGTGPEFPGYRRPTRPNKGGSSGSRRAERERKKRESSLIPIPIPPPPPLVGAPPPPPNPPPPPMSKTPGKTPRTPRRILESYTIKGSDGVIRPGDSVLMKAPDTSNPPYVAKIEEIEVAGPRGANVKVKVRWYYPPEESIGGRRPFHGEKEVFLSDHQDVHSADTIKCMFNVYSFRDYTTLSACXPETIFARFEYNSITGRFCPLSRCCFFVSLTCAATPANLFIQVLGIAPLWFPPCLVSGLDSPGSLRIFV

SEQ ID NO: 3797 - protein, 475 aa, Zea mays
SFVRSSRSAPGTTTHIPISRGQAAGVCGVNYRTSLYKKAGWYRSGIPSASAPPHPSRLRFVATASPTPPIGAPPAAAAPDPMEAEVGPPNPPRPEPAGSEPDDARLSPPPPAPAPPPPPPPPPAAEAAAAPTASAAFSLQAPAPAPAEANGSSDRKRRRKAEDGDGCKTCSCKKSRCLKLYCVCFASGLHCTESCGCEPCHNKPQLQGTLRMATVLPLKPVQTFEAGQDIVEQVIRSPMDLIRRKCTCKKSGCLKKYCDCYQGGAGCSINCKCDDCRNPFGRKVGVILDGKSSLTAPILHERNGTEVDSSDEEDDFYMNRQLSPIPPSPVSRESSFQQETLVGVEVQTMNGHLYPKPLTQVRPEPSSWQLSRRPIEEPRGEIWRFSRRPSEDGTSDAMEVHAVAPRESKKAAEVRGDRFGIPRCIEVMSAMAELSPVEKSLAPDVFLDASNREIFLSLSVDIRPIWLRRKMKSLV

SEQ ID NO: 3798 - protein, 214 aa, Brassica napus
  misc_feature (41)..(41): Xaa can be any naturally occurring amino acid
AVVAPSSQPSITLDFTKPTVFGSSSKSSEMDFAKENFSVSXNSSYMSSAITGDGSVSKGSSIFLASQPVNSSGKPPLAGHPYRRRCVEHEHSENFSGKISGSGHGKCHCKKSRKNKMKRTIRVPAISSKIADIPPDEYSWRKYGQKPIKGSPHPRGYYKCSTFKECPARKHVERALDDPSMLIVTYEWEHDHNPSAMQQNVSSSGVNDFVFNSA

SEQ ID NO: 3799 - protein, 207 aa, Glycine max
MGSSEMDKTTKEKESKTPPPPTSQEQSSTTGTGTINPEWPGFQAYSPIPPHGFLASSPQAHPYMWGVQQFMPPYGTPPHPYVAMYPPGGIYAHPSMPPGSYPFNPFAMPSPNGIAEASGNTPGSMEADGKPSEVKEKLPIKRSKGSLGWLDMITGKNNEHGKTPGTSANGIHSKSGESASEGEGTSEGSDANSQNDSQLKSGGRQDS

SEQ ID NO: 3800 - protein, 245 aa, Zea mays
MAMLREHLDLIRAHLLDDNHDAVSSDDSAPSHSPSPSPSPPGRRPLPALSVSLPPRPAVVLQQQHMRAAAPPLQIPQQEQHCCPEPEEDDFRRYRGVRQRPWGKYAAEIRDPSRKGARVWLGTYDTAVEAARAYDRAAFRLRGSKAILNFPNEVALSTAAWWATPAPPPQPSATVAGNKRARSPQEQDARCMVREVKKERIQEPASGGADYFWEDESLKGAICSLPPLSPLSPHPHLAVPQLYVS

SEQ ID NO: 3801 - protein, 414 aa, Zea mays
MAMVPCGGDDAEWCNMMEAINHLMMSSMSSPHAAMGASRAEDCLSIAAAPPGPGGHRSCCEDQVLEASSDGACAFAAPPDCLSSSALTNLQREEDDDSLYLPMYYSSAPPPAVVSDQYCPEQLPPLPAAGAMTGLDEALMQPFTDIDLEAFDNAEEQKPPVDQMVMMPPTVEHPAAAGTRAPIIIDAASDEEPAVSTTTWPSSFTMSSVGRQAGSTAAALLPPPQPSLPRPRARASGGAGERSAPAAAGKTRMDHIGFDELRKYFYMPITRAAREMNVGLTVLKKRCRELGVARWPHRKMKSLKSLMANVQEMGNGMSPVAVQHELAALETYCALMEENPWIELTDRTKRLRQACFKESYKRRKAAAGNAIETDHIVYSFGQHRRYKQQLLPPPTAGSTSADDRHGQSSRFFCY

SEQ ID NO: 3802 - protein, 207 aa, Brassica napus
  misc_feature (185)..(185): Xaa can be any naturally occurring amino acid
  misc_feature (203)..(203): Xaa can be any naturally occurring amino acid
MGIQERDPLTQLSLPPGFRFYPTDEELMVEYLCRKAAGHDFSLQLIAEIDLYKFDAWVLPSKALFGEKDWYFFSPRDRKYPNGSRPNRCAGSGYWKATGTDKAISTEGRRVGVKKALVFYVGKAPKGTKTNWIMHEYRLIEPSRRNGSTKLDDWVLCRIYKKQSSAQKDDYNSNLMTREYSHNGXSSTSYSSHQYDDVFEDKXRFLT

SEQ ID NO: 3803 - protein, 235 aa, Tradescantia virginiana
VQLKRMENKINRQVTFSKRRTGLLKKAHEISVLCDAEVGLIIFSTKGKLYEYSTDNSMAKILERYDRYATAERAVLEANLNLEVGSHYEYRKIKAKVDALQKSQRHLMGEQLDTMTNKELQQLEQQLETALKHIRSRKNQMMLESVAALQKKEKALREQKSILEKKLIEKQKDMEISQIHQYQAHEDNTSPTSLVLTNSLPTTLNTNGCITHAIEEEHAPTLPHTNNNNLPPWMV

SEQ ID NO: 3804 - protein, 352 aa, Ischaemum afrum
PSVKHMFPFCDSSSPMDLPLYQQLQLSPPSPKPDQSSSIYCYPCSPSFAAADASFHMSYQIGSAAAATPPQAVINSSELPVQPLMEQALAPGMELGACASGAQRAGAGVSLDRAAAAARKDRHSKIRTAGGMRDRRMRLSLDVARDFFAVQDLLGFDKPSKTVRWLLNVCKAAIQEMVGDDVDASSECVEEGSSSLSVGGKHNPSEQLGGGDQKTKGNGRSEGKKPAKARKAATTTPKPPRKSANNAHPVPDKETRAKARERARERTKEKHRMRWVKLASAIDVEAAAASVASDRPSSNHLNHHSSSSMNMPRAAAAELEERERCSSALNNRGRMQEITGASDMVLGFGNGG

SEQ ID NO: 3805 - protein, 128 aa, Physcomitrella patens subsp. patens
MGRSQCSKGEGGIYKGPWTEAEDTTLSAYIKAHGEGNWRLLPKCAGLSRCGKSCRLRWLNYLRPGLKKGKFSWDEEDLIVTLHALLGNRWSLIAGRIPGRTDNEIKNYWNTHLSRKLRNKGIDPCDHK

SEQ ID NO: 3806 - protein, 403 aa, Vitis vinifera
MWDLNVESGCDEDERMIVVVVEKGEEEELVPGGCRSLMEDSGTSNSSVVNADEAPSNGGDEDSSNNSSAFNFGILNKLGRHVPTYGAVEETPEFVTRQLFPATGDRGGGESELCSGSSSTSFPKPQWLNLSCPEPIGQQKPKQQQQQQQQQVRKSRRGPRSRSSQYRGVTFYRRTGRWESHIWDCGKQVYLGGFDTAHAAARAYDRAAIKFRGVDADINFSISDYEEDMKQMKNLNKEEFVHILRRQSNGFSRGSSKYRGVTLHKCGRWEARMGQFLGKKYIYLGLFDSEIEAARAYDKAAIRYNGREAVTNFVPSTYGEGAILEANDRSSGHNLDLNLGLSFPPDGPRGNDTVGRRSMVTFQLKCLSLIAFPRLPFHPSNFHGVFIIQLFLSLLSFGKHCNS

SEQ ID NO: 3807 - protein, 226 aa, Paeonia suffruticosa
SQVTFSKRRGGLLKKAHEISVLCDAEVALIVFSTKGKLFEYSTDSSMEKILDRYEQYSIAERQLVEEPGSQGNWSLEYSKLRAKIELLQRNQRRFMGEDLDSLSPKDLQNMEQQLDVSLKNIRSRKNQLMYESISELQKKERAIQEQNNLLAKQIKEKEKTMAQQAQWEQQIHHGPNASAYLLSPHELTTLNMGGNYQGEPTEMRRNELDLTLEPIYTCHLGCFGA

SEQ ID NO: 3808 - protein, 242 aa, Daucus carota subsp. sativus
MGRGKVQLKRIENKINRQVTFSKRRGGLLKKAHEISVLCDAEVALIVFSNKGKLFEYSTDSSMEEILERYERYSYAERQVIANDPESTGNWTLEYTKLKARIDLLQRDHRHYMGEDLDSLTLKEIQNLEQQLDTALKHIRSRKNQLIFESISDLQKKEKAIQEENGKLTKKIKEREKTMVQQAQWEKQNPSPNLSTFLMPQENPFLNIGGTFQGESSQGMTRNDLDLTLEPNHYPCNLRCFA

SEQ ID NO: 3809 - protein, 266 aa, Brassica rapa
MADRVKGPWSQEEDEQLRLMVEKYGPRNWSAISKSIPGRSGKSCRLRWCNQLSPEVEHRPFSPEEDETIVSARAKFGNKWATIARLLNGRTDNAVKNHWNSTLKRKCSDGNPTAEEEQDPAKKRRSMSSESVPPVDTGLYMSPESPADVGSDSSAVPPQLFKPMTSSAEEDPATTLSLSLSVPVSQESRNTGSSDNSLPFPRFERQMKINVEERGGEARRAEFMTVVHEMVKAEVRSYMAEMQRNNAGGFVVGGFYDSGGITPKVE

SEQ ID NO: 3810 - protein, 334 aa, Brassica rapa
MAAPDRSEDGSSNVENGSCNSNEGTNHETSSCRIANAAKVRKPYTVSKQREKWSEAEHERFLDAIELYGRAWRQIQEHIGTKTAVQIRSHAQKFFSKVAREADSGRDGSVKTVVIPPPRPKRKPTHPYPRKSPVPYAQSPSSNLEKGTKSPTSVLSPFDSEDQVNRCSSPNSCTSDMQSIDKKNDYATSKQSFKEDDAVTGSKPISSIMLFGKIVLVTGESHKTSSSREDSGVDHKSTTGQDSRHVDTALSLGVWDTSCTGSNVFGSVTEISDNLEKSAEARKRLTSLEKQEPCYRANGFRPYKRCLSEREVTSSLSLVASEEEGSRRRARVCS

SEQ ID NO: 3811 - protein, 615 aa, Nicotiana tabacum
MMMFEEMGFCGDLDFFPAPLKEVETAASQIEQESEPVMDDDYSDEEIDVDELERRMWRDKMKLKRLKEMTKGGKEGVDAVKQRQSQEQARRKKMSRAQDGILKYMLKMMEVCKAQGFVYGIIPEKGKPVTGASDNLREWWKDKVRFDRNGPAAIAKYQADNAIPGKNEGSNPIGPTPHTLQELQDTTLGSLLSALMQHCDPPQRRFPLEKGVPPPWWPTGQEDWWPQLGLSKDQGPPPYKKPHDLKKAWKVGVLTAVIKHMSPDIAKIRKLVRQSKCLQDKMTAKESATWLAIINQEEVLARELYPDRCPPLSSAGGSGTFTMNYSSEYDVDGVVDEPNFDVQEQKPNHLGLLMYVDRFKERLPMQQQSLPIKDEIMIANLDFTRKRKPADELTFLMDQKIYTCECLQCPHSELRNGFQDRSSRDNHQLTCPFRNSPQFGVSNFHVDEVKPVVFPQQYVQPKPASLPINQAPPSFDLSGIGVPEDGQRMINELMSFYDNNIQGNKSSMAANVVMSKEQPRQQPSIQQNNYLHNQGIILDGNIFGDTNISANHSMFPQGDRFDQSKVLTSPFNAGSNDNFHFMFGSPFNLQSTDYTEALSGITQDNMPKQDVPVWY

SEQ ID NO: 3812 - protein, 173 aa, Triticum aestivum
MVRAPCCEKLGLKRGPWTAKEDMTLVAHIEKHGHSNWRALPKQAGLLLCGKSCRLRWINYLLPDIPRGGWGSEEEEAIIQLHAVLGNRWSTIAARLPGRTDNEIKNVWHTHLRKRLESSSKTSGQAAPKRKAQKPAVGGSAIEGPTSEPGSSVTGAVPLDVARSSASRTSSAA

SEQ ID NO: 3813 - protein, 223 aa, Hordeum vulgare subsp. vulgare
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQRVLCTKDRQFMQQISDLQQKGTQLAEENMRLKNQMHEVPTASMVAVADVVPEDVHSSDSVMTAVHSASSQDNDDGSDISLKLALPWK

SEQ ID NO: 3814 - protein, 729 aa, Zea mays
VDPRVRFGQAETDTDEVYAQIMLMPEPEQTDVPAEKPSSAPAASPRPAVRSFCKTLTASDTSTHGGFSVLRRHADECLPPLDMTQSPPTQELVAKDLHGMEWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSIGMRFRMRFEGEEAPEQRFTGTIVGCENLDPLWPDSSWRYLKVRWDEPSTIPRPDRVSPWKIEPASSPPVNPLVHSSRAKRPRQNVPPPSLESSVLTKEGATKVEIDSAQTQHQNSVLQGQEQMTLRNNLTESADSDSTVQKPMMWSPSLNGKAHTHFQQRPAMDNWMPLGRRENDFKDTRSAFKDARTASQSFGDTQGFFVQAYDDNHHRLSFKNQGSTHRFADPYFYMPQQSSVTVESSTRTQTANNDLCFWGDQNAMYGNPSDQQQGFNFGQNPSSWLNQPFPQVEQPRVVRPHATVAPFDLEKTREGSGFKIFGFQVDTTSPSPVQLSSPLPAIQEHVLQTRPSAPVNELQPVQIECLPEGSVSTAGTATENIQQAPQSSKDIQSKSQGASTRSCTKVHKQGVALGRSVDLSKFTDYGELQAELDKMFDFEGELVSGSQNWQIVYTDDEGDMMLVGDDPWEEFCSIVRKIYIYTKEEVQKMNSKSAAPRKEESPAAGGGGGCAAATNE

SEQ ID NO: 3815 - protein, 230 aa, Spinacia oleracea
GRGKIEIKRIENTTNRQVTFCKRRNGLLKKAYELSVLCDAEIALIVFSSRGRLYEYANQSVKGTIDRYKKACSDQTGAGSVAEANAQYYQQEAAKLRNQIRTATENNRLLSRHMMGEGLSSLSMKELKNLETKLEKGISRIRSKKNELLFAEIEFMQKREIELHNNNQFLRARISENERAQQSMSLMPPGGSDYDLVPSQSFDSRNYFQVNALQPNSQYARQDQTPLQLV

SEQ ID NO: 3816 - protein, 130 aa, Brassica incana
AQTNWSMEYSRLKAKIELLERNQRHYLGEDLESISIKELQNLEQQLDTSLKHIRSRKNQLMHESLNHLQRKEKEILEENSMLAKQIKERESILRTHQNQSEQQNRSHHVAPQPQPQLNPYMASSPFLNMG

SEQ ID NO: 3817 - protein, 325 aa, Arabidopsis thaliana
MHSLNETVIPDVDYMQSDRGHMHAAASDSSDRSKDKLDQKTLRRLAQNREAARKSRLRKKAYVQQLEDSRLKLTQVEQELQRARQQGVFISSSGDQAHSTGGNGGALAFDAEHSRWLEEKNRQMNELRSALNAHAGDTELRIIVDGVMAHYEELFRIKSNASKNDVFHLLSGMWKTPAERCFLWLGGFPSSELLKLLANQLEPMTERQVMGINSLQQTSQQAEDALSQGMESLQQSLADTLSSGTLGSSSSDNVASYMGQMAMAMGKLGTLEGFIRQADNLRLQTLQQMLRVLTTRQSARALLAIHDYSSRLRALSSLWLARPRE

SEQ ID NO: 3818 - protein, 337 aa, Glycine max
MGVPERDPLAQLSLPPGFRFYPTDEELLVQYLCRKVAGHHFSLPIIAEVDLYKFDPWVLPGKAVFGEKEWYFFSPRDRKYPNGSRPNRVAGSGYWKATGTDKIITTEGRKVGIKKALVFYIGKAPKGSKTNWIMHEYRLLDSSRKHNLGTAKLDDWVLCRIYKKNSSSQKVEANFLAMECSNGSSPSSSSHVDDMLGSLPEINDRCFTLPRVNSLRTMHQQDEKFGSPNMGSGFFSDWVNSTDLDSISEFESGCQTQRMVNYDCNDFFVPSLPPLGHVDYMVDAPLEEEVQSGVRTRRVDGPGHFQPNPDTRLLPGSGDPFGFGFIMGQQVEFGFRD

SEQ ID NO: 3819 - protein, 347 aa, Arabidopsis thaliana
MKVEDEATYELIKDELMKAEDEATYWLIKEELIKAEDDVIISRYLKRMIVNGDSWPDHFIEDVDVFNKNPNEEFHSQSPRFVIVKPRTENCGRTDGCQSGCWRIIGRDKLIKSKETGKILGFKKILKFCLKKKPREYKRSWVMEEYRLNNNLNCKQDHVICKIRFMFDAEISFLLAKHFSCLSTRSPLPANQLLPAYGVCFFDSEAEGAFYLETIIGYDGNTWPSYVTNDVYRLHPLTLVDPQDDKFKEFGTCIFANRTKTCGKTDECDGGGCWRIVEGHRVIKSKGKVLGYRRIFQFSENEEPRNVCEGEDPKKTAWFIEEYRPDENNKKDKVLCVIKFLIPLNQR

SEQ ID NO: 3820 - protein, 340 aa, Oryza sativa Japonica Group
MSSTMPAQGGVRHHRTCRMYWCYQCGRAIRIISYPSTDVFCPRCFGRFLHEIDPPPRPAPPPPHFFPQPYHPHYDGHPRRWLIYGGEAPPVAAPGRAFRQPAPAVPGRAFRQPGPAPAPSPAPAPPRRRMPSPPPVARRPSTPPAIDPGNYFNGPNLNNLIEELTQNDRPGPAPAPSSAIDSLPTVQITGAHLSDGSQCPVCKEDFELGEAARQMPCKHVYHSDCIVPWLRLHNSCPVCRYQLLSSAAAGSNANSRARRGSANNGGGGGGGDGRDREQTIVRWGPFSWMWPPRGLEDPDDGWEYGRRGRPEAGDAGGNDMTALQSFVLVATCVFFFSFLT

SEQ ID NO: 3821 - protein, 345 aa, Glycine max
MGVPEEDPLSQLSLPPGFRFYPTDEELLVQYLCRKVAGHHFSLPIIAEIDLYKFDPWVLPSKAIFGEKEWYFFSPRDRKYPNGSRPNRVAGSGYWKATGTDKIITTEGRKVGIKKALVFYIGKAPKGTKTNWIMHEYRLLDSSRKNTGTKLDDWVLCRIYKKNSSAQKAVQNGVVPSNEHTQYSNGSSSSSSSQLDDVLESLPAIDERCFPMPRVNTLQQQQHEEKVNVQNLGEGGLLDWTNPSVLNSVVDFVSGNNNHNQLVQDQTQGMVNYNACNDLYVPALCHVGTSVPQKMEEEVQSGVRNQRVQNNSWFLQNDFTQGFQNSVDTSGFKYPVQPVGFGFRN

SEQ ID NO: 3822 - protein, 491 aa, Oryza sativa Japonica Group
MEMACLPGNAMATDENGADDRAGGESTVDHLRSHMNYGDMDLSGEEHVPKARKPYTITKQREKWTDEEHRLFLEALQLHGRAWRRIQEHIGTKTAVQIRSHAQKFFSKVVRESSGSNTGSGGASAAAAAAAIQIPPPRPKRKPAHPYPRKVDGAAKKHVPALRQLEKPPLWMQSLSEQEEGSPTSVLTAAQIGTEALGGGFSNNSSGSGSLAPSAAGTDEHVDGGGSPASSVDREDGCLSPSIPTAELAMQAPNTKMSIATTDAKEASSEASVFRLFGKSVVVKDSDQLHLLNGSNIATSGSVERATRNILVPSFAAAPEGSSSNPWPSSMQQFLYFLPRSDGFAAQPVMPWLSYNGSLPCALFYPAAAAAANQQCHRDSEGVEFRVSQREGSLTGSNTASSVVLGSSAAVPAAAAAAQNSDVAESRGQGNSREAAASPRLTKCESSASVTLLQRGFMPYKRCAAESELLRSEAAGGEEAVADGELTRLCL

SEQ ID NO: 3823 - protein, 238 aa, Oryza sativa Japonica Group
MVKSGQEAAPGSGGNAAAAAARQGGGGGGRGRQYKGVRMRSWGSWVSEIRAPNQKTRIWLGSYSTAEAAARAYDAALLCLKGSAADLNFPVHLPFHIPAAAMSPKSIQRVAAAAAANATSPLQHHSGAPSFATATGGYNPAAAPTTPPCSYGDMSSCSAVSSPETANYYGADHDMVAREDDVDYAALADIDAFFQSPKCMDYSMMDPCSTFFSPAPESLAAEWEDEGEISLWSFSSLN

SEQ ID NO: 3824 - protein, 234 aa, Triticum aestivum
MRSLSLDAAFFDGLALQGGGGGGAGHKRSGSMDGASSPSDGESALSGGLPDYAKKAIPAERLAELALLDPKRAKRILANRQSAPRSKERKIKYTGELERKVQTLQTEATTLSAQLTLLQRDTSGLTVENRELKLRLQSMEEQAKLRDALNDALREEVQRLKIAAGQVPNMNGNPFGGGLQQHQQQQQQIPNYFSQQQMHYQGHQHHHPQNHSQNSSNGGQSLSGQSLSDSMDFM

SEQ ID NO: 3825 - protein, 489 aa, Vitis vinifera
MELPQPRPFGTEGRKPTHDFLSLCSHSTVQQDPRPSQAGYLKTHDFLQPLERGEKNSIKEENAIEIRTVDKPPPPAPPPNSSVEHILPGGIGTYSISHISYFNQRLPKPEGSIFTAAQASTSDRNEENSNCSSYTGSGFTLWEETAVKKGKAGKENAVERSIGIEPAVKLGQWTSERPSQSPSNHRSSFSSLSSSQSSGQKNQSFMEMIQSASAKGTQEEEEEDEEEFVLKKESSSNKGDLTVKVDGKSSDQKAEEEQDKRQASMLRDLIPHSDQKRDKASFLLEVIEYIQFLQEKVHKYEGSFQGWNHESAKLMPWRNSHRPAEMGLFDENNVAVSPNISRNTQNPVESDLSASTTFKAMDRHPGLTNKALWQSRSSVTTECTVASDKLKEQELTIEGGTISISSAYSQGLLNTLTQALQSSGVDLSKASISVQIDLGNKANSRPTAPTPIIKDNQVPSSNHATARSRVASSGGDSDQALKRHKTCKN

SEQ ID NO: 3826 - protein, 382 aa, Chlamydomonas reinhardtii
MLMRKLASIPACTGRNPLPVVPSVAPRARQLTAAAPVASRVHQQLLAPARAGPPALVYAEGYKEVEELAGARVVVESDPPRVEYLVKWKDGSDSTWEVAADLSEDLVRDFEEKWWAAARKGALLQAVVIGSALHFAAALGSAECTRLLVEAGAELDLQDKEGERGEVNLIENLRASMPLSMGSVQRILQLEEVKNCLTDRLYDEVEPGNVLNCRATPDGTGREFLVSFGDGRDDEWVPERNVSADVLEDYLAGLEYAVAEEVLDVVQVRTERRFKIRWSDGYPTSWEPEEHVPPELIQLFAAQHPELFAARTSAEAAAAPDGWAQVEYETQSSPVAAYAQPAAASGNGAAGNGASGSNGSSESSGSGNGIGSSQREAVGAAR

SEQ ID NO: 3827 - protein, 739 aa, Mesembryanthemum crystallinum
MEAYSSGEELVIKTRKPYTITKQRERWTEEEHNRFLEALKLYGRAWQRIEEHIGTKTAVQIRSHAQKFFSKLEKEALVKGVPIQQAIDIEIPPPRPKRKPSNPYPRKTGAAGSPSTQIKVKDGNKVPPGSSHTANQLLDLEKEPPPENTTGDDGKQNAKETCGAYKCSETFTLFQEAPSTLTASGNENSAITTGATRKSCKVDDPVPKKLLVDIDGSDCPAADGRQRNQKLDKTDTVETAQNDTENEMHAVKNFPRHTPVHILDGSLGACSQALSSDVSYQESAFHRMGIPGYPAIFSNPAVSAAVESQNSTSRTTNQQMFTSFHPPFTPFPNTPEDYSSFVQMSATFSSLIVSALLQNPAAHAAASFAASFWPCSNMENSANCPAGLSGGFPPRPMNTAPSMAAIAGATVAAATAWWAAHGLLPLCAPVHSGFNCPPASANAPLTNVAQSQATNKEREENNFQNPGSQVQQPDQELSEALQPQHSASKPSATSSSDSGDSAGAKMEIEIPTNDNEIKVPAMTEQKDSSKGKSKKLVDRSSCGSNTPSGSDVETDALQKNDKGKEEPLEPDISQIAGELNNRRNRIASNNLNDSWKEVSEGGRLAFQALFSRERLPQSFSPPQDVSIMDQVMNNGVERNGQNATETNEDASQLDLNSNTWESCSGDQGHLENTGLREKENGKDHFLSIGLAQGKPRDRRTGFKPYKRCSVEARESRLNSNSQDQEKCPKRIRLEGEAST

SEQ ID NO: 3828 - protein, 271 aa, Oryza sativa Japonica Group
MAACQQQIWQEGKQQQHLHHGGYDDLSSVYRGTVVLPRRQGGLAPEPPPPRPSSSSGRSAAAQATAMTIHSEAERRRRERINAHLATLRRILPDAKQMDKATLLASVVNQVKHLKTRATEATTPSTAATIPPEANEVTVQCYAGGEHTAAARTYVRATVSCDDRPGLLADIAATFRRLRLRPLSADMSCLGGRTRHAFVLCREEEEEEDAAAEARPLKEAVRQALAKVALPETVYGGGGRSKRQRLMMESRYSTAVVHTHVDPQYCWYNSR

SEQ ID NO: 3829 - protein, 361 aa, Glycine max
MSPPVLSIGEEEGKSNVTLLVSSSTTMESVCLKSLEFKERNYMGLSDCSSVDSSVPSFSEETKSNLNLKATELRLGLPGSQSPDRDSDLCLRSSTQFDEKTLFPLRPLTDDHHSSAKTAVLGNKRGFSDAMNGFSSEGKFLVDSEAANPILSPRPASNLGLKPGSTLEKVGVQQTKMKEVATTKANEARPTIDGSANNNNSAPATKAQVVGWPPIRSFRKNSLATTSKNNEEVDGKVGVGALFVKVSMDGAPYLRKVDLKNYSTYPELSSALEKMFSCFTMSKCGSHGILGREMLNETKLKDLLHGSEYVLTYEDREGDWMLVGDVPWEMFIETCKRLRIMKSSDAIGLAPRAVEKCKSRT

SEQ ID NO: 3830 - protein, 164 aa, Triticum aestivum
MSSSVEKGNGSLDPGERPAAGSQPKACTACNTTKTPLWRGGPSGPMSLCNACGIRYRKKRREAMGLEDPPKKRQPAAAAAPAAAAVACSEAGGESADPEQQQPQQPKKKTTTTKKGREVELRVVGFGKEVVLKQRRRMRRRPRLGEEEKAAILLMALSSGVIYG

SEQ ID NO: 3831 - protein, 226 aa, Triticum aestivum
MAGKRERIAIRRIENLAARQVTFSKRRRGLFKKAGELSILCDAEVDLAVFSATGKLFQFASSSMNQIIDRYNSHSKILKKADEPSQLDLHEDSNCARLRDELAEASLWLQQMRGEELQSLNVQQLQALEKSLESGLGSVLKTKSQKIMDQISELERKRVQLIEENARLKEQASKMEMQVAADSPAVYEEGQSSESVTNTSYPRPPLDTEDSSDTSLRLGLPLYNSK

SEQ ID NO: 3832 - protein, 228 aa, Lolium perenne
MARERREIKRIESAAARQVTFSKRRRGLFKKAEELSVLCDADVALIVFSSTGKLSQFASSSMNEIIDKYSTHSKNLGKADQPSLDLNLEHSKYANLNDQLAEASLRLRQMRGEGLEGLTVDELQQLEKNLETGLHRVLQTKDQQFLEQINELQRKSSQLAEENMQLRNQVSQIPIAGKPVVADTENVIAEDGQSSESVMTALHSGSSQDNDDGSDVSLKLGLPCSAWK

SEQ ID NO: 3833 - protein, 214 aa, Solanum lycopersicum
AAGRKPSLNISIPSVKKTEEPKTGEVKTGEPKTEEPKTGEVKTEYSVKEKMVENSEKKRYRGVRQRPWGKFAAEIRDPTRKGTRVWLGTFDTAMDAAMAYDRAAFRLRGSKAILNFPLEVSNFKQENHEIEKNVVNLNSNTNSCGKRVRREMENDDGIVMKKEVKREQMVATPLTPSNWSSIWDCGNGKGIFEVPPLSPLSPHSNFGYSQLLVS

SEQ ID NO: 3834 - protein, 311 aa, Arabidopsis thaliana
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKIALAEETGLDQKQINNWFINQRKRHWKPSENMPFDMMDDSNETFFTEE

SEQ ID NO: 3835 - protein, 226 aa, Lolium perenne
MAGKRERISIRKIENLAARQVTFSKRRRGLFKKAEELSILCDAEVGLAVFSATGKLFNFASSSMNQIIDRYNSHSKTLQRSDEPSQLDLREDGNCTELREELAEASLWLRQMRGEELQSLNVQQLQALEKSLESGLGSVLKTKSKKIMDEISELERKRVQLIEENSRLKEQASKMEMQVAADSPVVYEEGQSSESVTNTSYPRPPLDTEDSSDTSLRLGLPLFNSK

SEQ ID NO: 3836 - protein, 558 aa, Zea mays
MADPPTSRMVQHPFGDIPSQTPKQFLYSGSSQHLCHPYQSASDAHVAPQRHYTVRSQSQSQSPDAGSEDFETHSRQYTLDSSSASGCSGHGSPSCQSVHAGSRSPVSHSHDDSHSGSTNGNGSPASASCVTEDPTDLKQKLKDLEAVMLGTDTDPETVDSLEIAIADRLSVEPEEWKNNMVSVPRGDLKELLIACARAVEQNNGYSIDLMVPELRKMVSVSGEPLERLGAYMVEGLVARLAASGSSIYKALRCKEPRSSDLLSYMHFLYEACPYFKFGYMSANGAIAEAVKGEDRIHIIDFHIAQGAQWVSLLQALAARPGGPPFVRVTGIDDPVSAYARGGGLELVGKRLSHIAGLYKVPFQFDAVAISGSEVEEGHLGVVPGEAVAVNFTLELHHIPDETVSTANHRDRVLRLVKGLSPRVLTLVEQESNTNTAPFAQRFAETLDYYAAIFESIDLALPRGDRERINIEQHCLAREIVNLVACEGEERVERHEVFGKWKARLMMAGFRPSPLSALVNATIKTLLQSYSPDYKLAEREGVLYLGWKNRPLIVSSAWH

SEQ ID NO: 3837 - protein, 313 aa, Gossypium arboreum
MEPAWVDTTLDLNINPCFRTNKAMKREFEGDVAESAPVKYESGVLVEELNRVSAENKKLTEMLTVLCEQYYSLQHQFMELVNKNPEIETTAAATTSSSKKRKAEWEDYGANMIGFSGNTETSSSDDGSPKTPKDCIKPKVSRVQVRTNPSDNSLIVRDGYQWRKYGQKVTRDNPCPRAYFKCSFAPSCPVKKKVQRSAEDPSILVATYEGEHNHHEHHRSPPAEISLNSNNNTPSSNTGSGPVSSAPTKALASTVTLELLQPAGLGGDETERAALQIDAPAIQQILVHQMAASLSRDPNFTAALAAAISGRAV

SEQ ID NO: 3838 - protein, 231 aa, Nicotiana benthamiana
MAPKEKGTAAGKVNGVSKEVHYRGVRKRPWGRYAAEIRDPGKKSRVWLGTFDTAEDAARAYDAAAREFRGTKAKTNFLVLEQENVKLANGNRSPSYSSTVENSPPVMPENSPPAVILDTSPLDLSLGGSGSLFSNGVGRFHMYYLEAVQREQVISSYKKSCRTTAEFIAGCGGGASGESDCRTTAEFIAGCGGGASGESDSSSVIDFMGHDLKPTTRPINLDLNLPPPENM

SEQ ID NO: 3839 - protein, 720 aa, Cryptococcus neoformans var. neoformans B-3501A
MDNHQHLQQHPPPPVFSMTIAMPGPAPPRSSPPADGSDAHQAADSNQGPAQESTIYWTFHIGPGSVRSPNDNQSSNEHPAVPGPNGRSGEPRGPAEGGGDANNNAPPPWLFPPFFQFLMPRREPQPNPEKAAELLRSLPTVGKRLLNRVNNVVAAQDVDSYEDDDDKGWKCGICLEGIHKEKLEKGEGKAVGDGKTEGEKEDKGTGVKALPCNHLFHGDCLEPWFTTHHTCPTCRLDLDPLQTLNSPLRPGPARNNSFRPARTGAGRSTSNAHPYSPDQSRNGERDQNDTAGDQVSADASGSGDNSRSNTPQERGQRSSLTPHLFIFAGPNHPREPQQEHSPEAANDAAAVPHDPTSQPAEPPSANVPTGGEAPTTPGGNSRPSASHRPFFDPAEILGAIFGGPPSASPLPMHRHSSPFPSSPGENATQSSNVPLSGNTGSTPTSQSGGSEPQDASSVESQPASEQSAQPPPSDRPQPERRAHIQIIQEALEQLPFIFNNHPIVPPLPTAFPFPGMVPVGERPSTPNAVDHTTDGSTAGAPSNGDTATAADEALGAGQAQSQTSAKQPFVPQSLESWTEEKEKSLGWRCDAPECVYGPSTSEEDDDSDGYPPTTDELEEDQKNKEMVSIFSAVQPPLSSAEAKEAHENDHDFTLLACTHRWHRGCLEIAERSAGRMSKDDGEGRIWVRCERCRKDGWIPPVAESTGSGVGRKRKEAEMTV

SEQ ID NO: 3840 - protein, 247 aa, Dendrobium grex Madame Thong-In
MGRGRVQLKRIENKINRQVTFSKRRSGLLKKAHEISVLCDAEVALIVFSNKGKLYEYSTDSSMEKILERYERYSYAERALFSNEANPQADWRLEYNKLKARVESLQKSQRHLMGEQLDSLSIKELQRLEQQLESSLKFIRSRKTQLILHSISELQKMEKILLEQNKTLEKEIIAKEKAKALVQHAPWEKQNQSQYSSALPPVISDSVPTPTSRTFQARANEEESPQPQLRVSNTLLPPWMLSHMNGQ

SEQ ID NO: 3841 - protein, 372 aa, Oryza sativa Indica Group
MEAKSGEASVAPVAVATEATAATVSFQPQAAVAEQGSSSGGVLVPPPPMAAGGGGVVVAAAPVAGVVKVGKKRGRPRKYGPDGSLIRPLNATPISASVPMAASAVGPYTPASAVGAAMKRGRGRPLDFASTAKLHHHHQHQHHHQQQQFGFHFDSIGEMVACSAGANFTPHIITVAPGEDVTMKVISFSQQGPRAICILSANGVISNVTLRQPDSSGGTLTYEGRFELLSLSGSFMPTENSGTRSRSGGMSVSLASPDGRVVGGGVAGLLVAASPVQIVVGSFLPSYQIEQKNKKPRVEAAPALAQTPPAVPISSTDTHSSEQGQHSSVAPRTTNIVTSAYNPDQSWASPAQSIPDSARTPSGDVKVTASGA

SEQ ID NO: 3842 - protein, 247 aa, Arabidopsis thaliana
  misc_feature (35)..(35): Xaa can be any naturally occurring amino acid
  misc_feature (89)..(89): Xaa can be any naturally occurring amino acid
  misc_feature (95)..(95): Xaa can be any naturally occurring amino acid
  misc_feature (109)..(109): Xaa can be any naturally occurring amino acid
  misc_feature (184)..(184): Xaa can be any naturally occurring amino acid
MNHNSKMVRSMFTTFDCSNHRDLFSSSPSFSCYQXHMSSSFFGFNNSHMPYHMMRRNIDYVFGTDYLPINDNIRVTRVSFTQTITNRYXSFIVQXAMDSKPNIWNPIFXPPKFLGKQYYILNPESLNFISSHQNSENRLHLNMFSLSPKQNHDQNIFHESRSLKKIPKPTMSNEKTADYINCEXNDKSIDDQYDGLTHSLPYEKYDLYTCLKCNNIFDISQNFDVHMSSHYKYYMDKKGDFETSDKK

SEQ ID NO: 3843 - protein, 127 aa, Vitis hybrid cultivar
RCHEHDHSDDISGKYSSSGRCHCSKRRRSRVKKTIRVPAISTKIADIPADEYSWRKYGQKPIKGSPYPRGYYKCSSMRGCPARKHVERASDDPAMLIVTYEGEHSHSQVAMQEMIPHGGVGLVFEST

SEQ ID NO: 3844 - protein, 179 aa, Pisum sativum
MAREGLGLEITELRLGLSCGEPKKNEKKRMFSEIDGGVEENGGSGDRKSVDKKNQVVGWPPVCSYRKKNMNEGSKMYMKVSMDGAPYLRKIDLCLHKGYLELALALEKLFDCCGIEEALKDAENCEHVPIYEDKDGDWMLVGDVPWEMFIESCKRLRIMKRSDAKGFDLQPKGSLKRFI

SEQ ID NO: 3845 - protein, 177 aa, Saccharomyces cerevisiae
MSEQKEDLFKPVGEAAAEVEDESIAEQNKANDGVKLTGAQDAMGHPVQEIESLCMNCGKNGTTRLLLTSIPYFREIIIMSFDCPHCGFKNCEIQPASQIQEKGSRYVLKVECREDFNRQVIKSETATCKFVELDIEIPAKRGQLTTVEGLLSEMIDDLSQDQEMRKSIDEVSLQEDR

SEQ ID NO: 3846 - protein, 116 aa, Saccharomyces cerevisiae
MKPVNIPHFKEVIIMSTVCDHCGYKSNEVKTGGAIPDKGRRITLYCDDAADLSRDILKSETCSMVIPELHLDIQEGTLGGRFTTLEGLLRQVYEELESRIFTQTSDSMDEATKAAG

SEQ ID NO: 3847 - protein, 359 aa, Glycine max
MASDAKLSSSESLNGLKFGQKIYFEDVGLATPATSLTSSSSSSSAATVTSSSSSRKGRGGSVQPAQPPRCQVEGCKVDLSDAKAYYSRHKVCGMHSKSPSVIVAGLQQRFCQQCSRFHQLPEFDQGKRSCRRRLAGHNERRRKPPTSSLLTSRYARLSSSAFDNSGRGSNFLMELTSYPKLSLRNSLPTPRSSELAPGNQTSTLSWNGNSETSSDLFLQGSVGGTSFASPGHPPGESYIGVTDTSCALSLLSNQTWGSRNTAPSLGLSNMINFNGTPLTQLAASSHGASIHQLPNTSWFFKGIDSGNCSPEVVPDLGLGQISQPLNSQLHGELDLSQQGRRHYMDLEQSRAYESAHWSL

SEQ ID NO: 3848 - protein, 878 aa, Oryza sativa
MSSSASPAAWWARSRVRILLPVIFLAPALYFLLSPPSSPPFFFTLPTSREESPSASGSRVIWAQRRVAEWRSCGWWRAAMPAPSRRNGYIRIDCYGGLNQLRRDLCDGIAVARLLNATMVLPKFEVAAYWNESSGFADVFDVDYFIEQTRGYVEVVKDMPEEIASKEPFKVDCSKRKGHFDYVETVLPALLEHQYISLTPAMSQRRDRNPSYAKASYCQGCYNALRLNKNVETKAIELLQAIPKPFLSLHLRFEPDMVAYSRCVYTGLSSKSLSAIEAARGEDRKALTGEAALLWRNRGKCPLTPSETAFILKALGIPTDTNIYLAAGDGLMELEGFTSIYKNIYTKSSLLTHDDFEKMHGNTKAALDYYVSVSSDAYVATFFGNMDKMVTAMRTMQGHQKTLVLSRRAYANYTAVGLSGEQLAMAMWDAHREEYIMGRGSALPEQCFCEFKLIFRCANMDENFTAIESNADDKEETVLGEMGFHSQHGGWALWREAGSRTEMHLGPPSVSPAYCFDFSALHYSYRFCSVELGRKLDASMMTDYFNYSYSSYQCSSASSAIKGTRVDRLREASDTGHHRGRHKRARSSPPRHDDEPPPPPPLSPAVTGGAHGGAAWHSTVLAEDVESAVIVAALTHVISSTAAEVTTAVPPVTVAPQRAATATMFGQQVMQQPPRGFPPLPSSSGSAATAPEQQQPRRRYRGVRQRPWGKWAAEIRDPVKAARVWLGTFDTAEDAARAYDAAAVRFKGSKAKVNFPDEVAGASIAAVQLPRHHQHHPPTSLPPLPVPAHLRPHFSLAGGQSTTPAPAAAAVAAPPREEFPDLSSYAHILQSGDLEYDFHAAVSAGLTTTAGRSSSSSSLSMPPPSEDLDYKPPFGPSN

SEQ ID NO: 3849 - protein, 270 aa, Ostreococcus tauri
  misc_feature (1)..(2): Xaa can be any naturally occurring amino acid
XXRAGGASTSTSRGRARGKERAETEQVKRKRGKGDGTGERGSGVTGRKNPRGAARLRWTPELHAEFLKAVHQLGGLELATPKGIATLMTTSGMTLQHIKSHLQKYRLQELGGATRTPAGDDTAERARRAMIKRARQEQAEELARRASSGDLAAYEAASTPTSAGNLSELIHSQFASPDATPDERSLDAILARASTDPVSASAALGASLGVDVNDVDIKSMPKVGQALLKQLEMQKQLHDQLLTQRRLETAIAEHSKYIASMLAGDTPPRS

SEQ ID NO: 3850 - protein, 294 aa, Brassica rapa subsp. chinensis
MGRSPCCEKAHTNKGAWTKEEDERLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTTHRPIQESSASQDSKPTHLEAITSNTINISFASSSSTPKMEIFQESTSFPGKQEKISMVTFKEEKDECPVEENFPDLNLELRISLPDVVDHHHQGFVGEGKTTTPRRCFKCSLGTINGMECRCGRMRCDVVGGSKGSGKGSDMSNGFDFLGLAKKETNTCLFGFRSLEMK

SEQ ID NO: 3851 - protein, 240 aa, Brassica oleracea
MFTVSQASCNERNAVEDNSVSNCSSYAAKNGFTLWNESIEKRGHTRKRQSQSFMDMIKSAKVDLRVKVDKKGHGNEQKPNTPRSKHSATEQRRRSKINDSQTLRQLIPNSDQKRDKASFLLEVIQYIHFLQEKVDKHEDTTSFPVLGQRNSFFSPELSQLCPVSSSDVAAMECENLREEEEVEELSIHKGTISISSVYSQGLLKTLSETLQSSGVDLSRSRISVQIKLSKQPQEVCFRCF

SEQ ID NO: 3852 - protein, 219 aa, Lolium perenne
MARERREIRRIESAAARQVTFSKRRRGLFKKAEELGVLCDADVALVVFSATGKLSQFASSSMDEIIDKYSAHSKNLGKSQEKPALDLNVEHSKYNSLNEKLAEASLHLRHMRGEELGGLSVGELQQMEKDLETGLQRVLCTKDQQFMQQISDLQQKGTQLAEENMRLRNQMPQVPTAGMMAITEDVLSSESVMTAVHSGSSQDNDDGSDISLKLALPWK

SEQ ID NO: 3853 - protein, 374 aa, Oryza sativa Japonica Group
MERCSVLGLGGGGGRGGRLDGELPPGFRFHPTDEELITYYLLRKVVDGSFNGRAIAEIDLNKCEPWELPEKAKMGEKEWYFYSLRDRKYPTGLRTNRATGAGYWKATGKDREIRSARTGALVGMKKTLVFYRGRAPKGQKTQWVMHEYRLDGTYAYHFLSSSTRDEWVIARIFTKPGVFPVVRKGRLGISGGGGDTSCFSDSTSASVGGGGGTSASSALRAPLAEASLFAAAAAPAVDGADSSNYGGAAAPAAPPPPQTWSPALSSCPASPPQPTWMPRSATRAVQPGPRWPSSRRRRRRPSSRASARCRRTCSCRCSSPGGMQAGVSSQPLSGGGAFHWQSGMDVKVEGAVGRAPPQMAVGPGQLDGAFAWGF

SEQ ID NO: 3854 - protein, 352 aa, Antirrhinum majus
MGRSPCCDKVGLKKGPWTPEEDQKLLAYIEEHGHGSWRALPARAGLQRCGKSCRLRWTNYLRPDIKRGKISLQEEQTIIQLHALLGNRWSAIATHLPKRTDNEIKNYWNTHLKKRLAKMGIDPVTHKPKSDTLMSNDGQSKNAANLSHMAQWESARLEAEARLVRQSKLQPPSANSFQASTSNPVQKSMGQARCLDVLKAWNGVVWGKNDEAAGVSVTVTTGIVGELGSPTSTLSSAAGTNGIMKEESEEEWKQMPENRDEIGNATPFTSNWESEQVALNSSEACSSREFRGKLYGLVTECFLCRWRGMRIVGYTNSGGNDVGVSDYYEDNKNYGNSILNLVNSSPSHSPIF

SEQ ID NO: 3855 - protein, 187 aa, Triticum aestivum
  misc_feature (96)..(96): Xaa can be any naturally occurring amino acid
  misc_feature (99)..(99): Xaa can be any naturally occurring amino acid
  misc_feature (127)..(127): Xaa can be any naturally occurring amino acid
  misc_feature (134)..(134): Xaa can be any naturally occurring amino acid
LPPQQAPPDRKGRGGAGGGVMESGSRSSGAAGFDDDDGLTTRREVSSSLQDLTVRVDRKGGSCSDGGTDQRPNTPRSKHSATEQRRRSKINDRFQXILXELLPHSDQKRDKATFLLEVIEYIRFLQXEKVQKYXATFQEWDQENAKDASWVIAFKLQCLVLLLQGKINSDCRECNISSIVFHYRKIQ

SEQ ID NO: 3856 - protein, 518 aa, Zea mays
MEGGMSSLEAAMEASSSMASSMARNADPDQQTLRPNLVEQFYFPRPGQSLPGIPPFFGPPSSLYLPNDNEAKFGNNFESNPSQNTDWNPQAIVSNLTFLEQKIKQVKDIVQSMSNRENQVAGGSCELAAKQQLITADLTSIIIQLISTAGSLLPSMKNPLLSSNPAVRQLGNTLGSPMGLGMNANQRPSVDSKTDIPDTGKTSDYDELMNSLNPTQDERDEMIKCPNPCGGEGSEPTPMEDHDVKESDDGGEGENLPPGSYVVLQLEKEEILAPHTHFCLICGKGFKRDANLRMHMRGHGDEYKTPAALAKPTKDSGADHAPVTRYSCPFVGCKRNKEHKKFQPLKTILCVKNHYKRSHCDKSYTCSRCNTKKFSVIADLKTHEKHCGRDKWLCSCGTTFSRKDKLFGHVALFQGHTPALPMEDVKVSEASEQPQDSEPMNEMARSNVYSFPCSSSDGISNLDMKMADDVRGYFSPLNFDPCFGALDDFTRPGFDISENPFSFLPSGSCSYGQQNGDS

SEQ ID NO: 3857 - protein, 272 aa, Brassica napus
  misc_feature (183)..(183): Xaa can be any naturally occurring amino acid
MTYQLQSVDKEGLGTATCLKERNYLGLSDCSSSVDSSTVPNLVLDTDKKSSLNFKATELRLGLPESSQSPQRETDFGLLSPRTPDEKLLFPLLPCKDHASGNKRGYLAKSGSNNAPASKAQVVGWPPIRSYRKNTMASSTSKNTNEVGLGPLFVKVSMDGAPYLRKVDLRTYTCYQHLSSALXEKMFSCFTLGQCGLHGAHGRERMSEVKLKDLLHGSEFVLTYEDKDGDWMLVGDVPWEIFTESCRKLKIMKGSDSIGLAPSAVEKSKNKD

SEQ ID NO: 3858 - protein, 248 aa, Picea sitchensis
MEKRDKCAIAARQPMKKLYRGVRQRQWGKWVAEIRLPRNRTRLWLGTFETAEAAALAYDRAAYQWRGECARLNFPHLFSKNCQDSYISSTSGMSPRHYRESSDQKYAYNSGSVHMNACKGDPVRTTAYNGDPVQINVYKSDPVQISAHNGNAVGKVASLAEFMPESSSSHESPNAQVERFVWEEGEDENWLNNLPVLEADMTWDVLNGCSDLGTEGSQTRTCALQTENACISSGKFEFQGVWLGCCCE

SEQ ID NO: 3859 - protein, 213 aa, Cardamine flexuosa
MVRGKTQMKRIENATSRQVTFSKRRNGLLKKAFELSVLCDAEVSLIIFSPKGKLYEFASSNMQDTIDRYLRHTKDRVSSKPVSEENMQYLKFEAANMMKKIEQLEASKRKLLGEGIGTCSIEELQQIEQQLEKSVKCIRARKTQVFKEQIEQLKQKEKALAAENGKLSEKWGSHETEVWSNKNQESGRGDEESSPSSEVETQLFIGLPCSSRK

SEQ ID NO: 3860 - protein, 329 aa, Oryza sativa Japonica Group
MCGGAILAELIPSAPAARRVTAGHVWPGDANKAKKKGARADDFEAAFRDFDNDSDDEEMMVEEAEEEEATSEHKPFVFRAKKAAAAASSRRRKPAQYRGVRRRPWGKWAAEIRDPVKGIRVWLGTFTNAEAAALAYDDAARAIRGDRAKLNFPSATTPDTRKRGRATAAAAPAVKATPVINLVEEEDEEEVAAAMASIKYEPETSESSESNALPDFSWQGMSASDEFAVAAAALSLDSDDDLAKKRPRTEPEDTTDSGSGDDTDALFDALLFADQYNHFNGGAYESLDSLFSADAVQTTAAAAAADQGMGLWSFDDGCCLVDVEASLSF

SEQ ID NO: 3861 - protein, 349 aa, Zea mays
MGMSSTQAAAQTQQQQQQLVPPGFRFHPTDEELVDYYLRKKVASRRIDLNVIKDVDLYKIEPWDLQDKCRLGGPGEEEQNEWYFFSHKDKKYPTGTRTNRATAAGFWKATGRDKPIYANKQRQLVGMRKTLVYYKGRAPNGHKSDWIMHEYRLETNENGPPQEEGWVVCRVFKKRLPTTRRESDHDAPCWYVDEDGTFMHDLNSPMGGLPPHHSIAQLHEQHLQMLNNSYKRRELKLQFQMPSHHILNAAAAIPHELEPPSFHSLLVSPDHHQAAKAHHRAVQLMDEHAADQVTDWRVLDKFVASQLSHDDAAKGVDYTDEGDILQINEKQATEYASTSTSSSQVDPWK

SEQ ID NO: 3862 - protein, 371 aa, Oryza sativa
  misc_feature (51)..(51): Xaa can be any naturally occurring amino acid
  misc_feature (74)..(74): Xaa can be any naturally occurring amino acid
MDAQYNPRTVEEVFRDFKGRRAGLVRALTADVEDFFRQCDPEKENLCLYGXFPNEHWEVNLPAEEVPPELPEPXALGINFARDGMQEKDWLSMVAVHSDAWLLSVAFYFGARFGFDKNDRKRLFGMINDLPTIFEVVSGKSKAKPPSANNHSNSKSKSSNKTKSSEPRAKQPKPQPQPPVKNEGREEEGGPDDEEGGGGGGGGGREEEHGETLCGACGESYGADEFWICCDICEKWFHGKCVKITPAKAEHIKQYKCPSCSGGNGGGGGVSGNGKQLKICSTKREAIISQYLVRDERSKNTSTHARSPLISDNPYEVISDIRIMLAEQYTTNAREDDFDAKPNDKDNQGEGNVAWGGINKELYSLQVTIQN

SEQ ID NO: 3863 - protein, 216 aa, Triticum aestivum
MAKTKQGKRDIDSYTIRGTTKVVRVGDCVLMRPSDTDNAPYVARVESLESDGRGSVRVRVRWYYRPEESKGGRRQFHGAKELFLSDHFDTQSAHTIEGKCIVHSFKNYTKLDNVGPEDFFCRFEYKAATGAFTPDRVAVYCKCEMPYNPDDLMVQCEGCKDWFHPTCMGMTIEQAKKLDTFLCADCAKENGAKRPSNSYPSSPSSDSKVEPKRRKW

SEQ ID NO: 3864 - protein, 402 aa, Glycine max
PGFIERAARFSCFSGGNFSDMVNSYGIAQSMGLYGARDAIAGHGMKSVTGGQSQGGDMNVVEATKDVSPSVEHLVAAKGSPLKSDRRSEGHVISQDEGKQSLVRPANESDRAESSDDGGGQDDSPMLEGTSGEPSSKGLNTKKRKRSGQDGDNDKANGAQELPSEGAEDNYENQQKGDHQPTSTAKASGKNAKLGSQASDPPKEEYIHVRARRGQATNSHSLAERVRREKISERMKFLQDLVPGCSKVTGKAVMLDEIINYVQSLQRQVEFLSMKLATVNPRLDFNIEGLLAKDILQQRPGPSSALGFPLDMSMAFPPLHPPQPGLIHPVIPNMTNSSDILQRTIHPQLAPLNGGLKEPNQLPDVWEDELHNVVQMSFATTAPLTSQDFDGTGPASQMKVEL

SEQ ID NO: 3865 - protein, 221 aa, Oryza sativa
  misc_feature (161)..(161): Xaa can be any naturally occurring amino acid
MRVDREMERGDEASVNRGWLELRLGVNGGGGVETVPVTAADSSASSEAGEADTVTPSQQQQQQQQGSPSSPAASSAPNKVFSCNFCMRKFFSSQALGGHQNAHKRERSAAKRTPSSSPYHLHHHRMMMAGAGLPLEAHAAFMRAALRVNPAGSAIHKQQQXAAAVTPWAPVAPLAYDEVLSSSASSWPGSFRFRTQPEPPPSSEQEPPSEQSKKIALSLRL

SEQ ID NO: 3866 - protein, 395 aa, Oryza sativa
MKAPPTPMEAVRRHPSLSRLKPPNPNAQRTPALSITVPFRLRLPNRRLTAAAVFQDQTNPRNPASKGGDDDEAYGEVDRIVSSRTIKNPVFAEDGSATTVTATEYLVEWKDGHEPSWIPAEAIAADVVAEYETPWWTAAKKADAAEITALLADETLRRDPDAEDAQGRTAMHFAAGLGSEECVRALAEAGADVGRPERAGGGLTPLHIAVGYGRPAAVRVLLELGAEPEAPDGQGRTPLELVQDVLAKTPKGNPATFERRLALEAAAKELEKAVYEWGEVEKVVDGRGEGKWREYLVEWRDGGDREWVRAAWVAEDLVKDFDAGLEYAVAEAVVNKREAAEGEGKWEYLVKWVDIEEATWEPAENVDAELLQEFEQRQSGVAAGGDAPPPPPVAG

SEQ ID NO: 3867 - protein, 198 aa, Guazuma ulmifolia
CPVKKKVERSFDGQIAEIVYKGEHNHSKPQPPKRNSSGTQGLGFSSDGTAQDTTNNSLWSNNPNERNEGSEGRVEHQNEVGLSAPPPYQRKAAVLPYEHVTTGAVNAGVTPENSIGISGECEERSKEGEEDEPRSKRRKSENQSSEVGTSGEGIQEPRVVVQSSTDSEIMGDGFRWRKYGQKVVKGNPYPRSYYRCTS

SEQ ID NO: 3868 - protein, 332 aa, Thellungiella halophila
MERVEAALKSSIRKEMALKTTTPVYDECMAMTTVQTGFPADDFSVDDLLDLSNDDVFADDDVEPKAQQEEMLRVSSSEEPHDHGDASHRDFGSLPLSELSVPADELANLEWLSHFVDDSFMEYSAPNLTGTSTKPAWLTGDRKHPVTPATEESCFNSPVPAKARSKRNRNGGKVWSLGSSSSSGPSSSSSTSSSSSSGPSSPWFSGAELPEPFATSEKPPVPKKHKKRSAESVYSGQPLQQRRCSHCGIQKTPQWRAGPMGAKTLCNACGVRYKSGRLLPEYRPACSPTFSSELHSNHHRKVMEMRRKKEPTDDNATGLNQLVHSPQAVPSF

SEQ ID NO: 3869 - protein, 224 aa, Brassica napus
MAKTRPGVPSKIKTGRKELDSYTIKGTNKLVRAGDCVLMRPSDAGKPPYVARVEKIEADARNNVKVHCRWYYRPEESLGGRRQFHGAKELFLSDHFDVQSAHTIEGKCIVHTFKNYTRLENVGAEDYYCRFEYKAATGAFTPDRVAVYCKCEMPYNPDDLMVQCDGCKDWYHPACVGMTTEEAKLLDHFACAECSSDDDVKKSQNGFTASPADDVKVEAKRRKR

SEQ ID NO: 3870 - protein, 196 aa, Herrania albiflora
CPVKKKVERSFDGQIAEIVYKGEHNHSKPQPPKRNSSGTQGLGSASDGTGQDTNNSLWSNNPNERNEGSDGRVENQNEVGLSAPPSYQGKAVLSYEHVSTGAVNAGVTSENSIGLSGECEEQSKEGEDDEPRSKRRKGENQSSEVGTSGEGIQEPRVVVQSCTDSEIMGDGFRWRKYGQKVVKGNPYPRSYYRCTS

SEQ ID NO: 3871 - protein, 222 aa, Gossypium barbadense
MAPQDKNASKTLKKANGTGSTSSQEVHFRGVRKRPWGRYAAEIRDPGKKSRVWLGTFDTAEEAAKAYDAAAREFRGPKAKTNFPLPDETNCYKGQNQQSPSQSSTVEESGSPTVERGVNTLSGAVGRFPFACHQQLALGGGVANGGISGVTRSRPVLFFEALGGAGVVGQVYPVRFDPVGVQLGMGFASVVRSEPDSSSAIHCKARRPGLALDLNLPPPVDA

SEQ ID NO: 3872 - protein, 367 aa, Triticum aestivum
LDEQVCTKKQAGTGPEFPGISSTHASESYQGLVHEVFVKVLRGLSGAKVTRPGSFRNYKNGYAVKSSLKAEDGLLYPLEKGFFFLPKPPTLILDEEIEFVEFERHGAGGASMSSQYFDLLVKLKNDQEHLFRNIQRSEYRNLFNFINGKGLKLMNLGDGQGTSGVTDVLQDTDDVAPDPHLERIKNQAASSEDSDEEDEDFVLHKDDGGSPTDDSGGEESDASESGGEKQKSSKKEARSSKPPVKRKPKGKDGEGSGKRKPKGMDGEGSEKRKPKKKKDPNAPKRPMMPFMYFSMAERAGVKGSNPDLAPTDIAKKLGEIWQKMSTEDKQPYILQSQADKKRYEKESAAYRAAAPVDVDAGSGNGSD

SEQ ID NO: 3873 - protein, 284 aa, Triticum aestivum
MAGLDLGTNSYLHHHQQLHLRHDDGAGGSDDGQDALSPGGGGGSAAAGAGIGGSEVVGRRPRGRPPGSKNKPKPPVIITRESANALRAHILEVAAGCDVFEALTAYARRRQRGVCVLSAAGTVTNVTLRQPQSAQSGPASPAVATLHGRFEILSLAGSFLPPPAPPGATSLSAFLAGGQGQVVGGSVAGALVAAGPVVVVASSFSNVAYERLPLEDGDEVVPTPPPPGSDQAGGGMPFGVEPSGGSAGAGLPFFNLPMGMPPMPVDGHNGWPGAAGGIERPPFS

SEQ ID NO: 3874 - protein, 714 aa, Ostreococcus tauri
MTFGDDFEFHFDGLIDDGVGFDAWCDEEIDLSAFASEDALDCAFGIELTPTPAPMKRAHGGSSGGRASKRRTNGRTQVALPFSPREDDLSTWEEDDYPMIMSPETKAKLKGQWSTEEDQKLVGLVEKYGVRRWSYIARALSGRVGKQCRERWNNHLAPDIKRGTWTLDEEEKFIEAHLELGNKWSYIAKRLPGRTENSVKNHWNATRRRKDGQMTTFRAYVLEAFEKRAHEDCSTPRSKSQSTTSDSLECSMRASHKPSSPSPSYSAMKDEVTKLLKFETNSECAHGLVFQILNRQLSARIDASSSRMRADISAHSLRALHRSVAFLSRVGGEIMLDAREDGREGSLTLKSVNANRSAFARVRVLARAFDAFEVRGKRVQACALAKHVLASLRASARAETLSIELADDDAAREEPRVVVRTTSAKTGVTRTYEMCEVIDCEHVDAEMDAEAMPGKCVMRARAFGALLQHFASAAQEDVTITFGIEGEVCVEVDEGRIGNSSGNILTLSSFATAGAGLSQALQTSVSVRRDDESILFYRNTAGSKIEVTVNLKDLRGVVQLCEASDVDLAIYCAQAGAPVIAKPTADYKLFHQHGESQQAAAPSVDFEAELVLATVLPPEIANDASTQSERAEPSAPSAAQLPNVPIGSQPWSAVPDTEDGSQREIGGADEVGALPRPWGQNASTIANVSADEDWHATNVDDFVEATPPEKRRRS

SEQ ID NO: 3875 - protein, 405 aa, Arabidopsis thaliana
MPTLYKKAGCMNSFSHVPPGFRFHPTDEELVDYYLRKKVASKRIEIDFIKDIDLYKIEPWDLQELCKIGHEEQSDWYFFSHKDKKYPTGTRTNRATKAGFWKATGRDKAIYLRHSLIGMRKTLVFYKGRAPNGQKSDWIMHEYRLETDENGTPQEEGWVVCRVFKKRLAAVRRMGDYDSSPSHWYDDQLSFMASELETNGQRRILPNHHQQQQHEHQQHMPYGLNASAYALNNPNLQCKQELELHYNHLVQRNHLLDESHLSFLQLPQLESPKIQQDNSNCNSLPYGTSNIDNNSSHNANLQQSNIAHEEQLNQGNQNFSSLYMNSGNEQVMDQVTDWRVLDKFVASQLSNEEAATASASIQNNAKDTSNAEYQVDEEKDPKRASDMGEEYTASTSSSCQIDLWK

SEQ ID NO: 3876 - protein, 405 aa, Zea mays
MDHGGGGGGGGAPSSSNSAGGAAAGGGATAGGASGGRGSEHHPFYYAGPAASNSGVPQAQQQPSPFAGALAIAPVPEQPQPSSADKKALVPAAPAAAGPVVAKRPSKDRHTKVDGRGRRIRMPALCAARVFQLTRELGHKSDGETIEWLLQQAEPAILAATGTGTIPANYSSLNISIRSGAAAPAARAAPFPALALHPHHHHQAAPAHDMSAMMAGYHHHLLPPQPQPQEDPSAGDAYMRKRYREDLFKEDDERQDPSAPKAREQQAATPPPQPPPSATMWAAAAPSGGFWMLPVSASSAAAARPAEQPMWSFSGGGGTGTVQAPLQFMSRASYPGGAAGGGGGAMSDTNLGMLAALNAYNRGGSEEQQQTEGEQQHGGDGGVNDDGDEDGDDSAEENNGNNSSQ

SEQ ID NO: 3877 - protein, 340 aa, Zea mays
  misc_feature (150)..(150): Xaa can be any naturally occurring amino acid
MAACRGGGGGKDVDRIKGPWSPEEDDALQRLVGRHGARNWSLISKSIPGRSGKSCRLRWCNQLSPQVEHRPFTPDEDDTILRAHARFGNKWATIARLLSGRTDNAIKNHWNSTLKRNDAVVADADDERPLKRTSSDGHPGLCFSPGSPSXGSDLSDSSNHSLPSVLPSAASAAAVTSHQQQQHVYRPVPRAGGVVMLPVAPLAPPPPPPPPQPPATSLSLSLSLPGLDGQKPEPSPAVLAPAPAPPQPPLQIQQQQPAPPQMPPSQAQPSLPFQLQAAATNLTSQQPAAAPFSSEFLLLMQEMIRIEVRNYMSGSGLDPRTDGAAVHAVSKRMMGMAKIE

SEQ ID NO: 3878 - protein, 853 aa, Arabidopsis thaliana
MVSHKCVEEFGYASYLVPSNARAPRSARKRRSIEKRISKEDDNMCAIDLLATVAGHLSFESGSSLMSIDKLIEDHRVKEEFPEEEKPLMPVALSPYRGSLSPCGFSSVINGKVENEVDGFSYSGGSDACQVGNFSQDVKPDIDGDAVVLDARPNVVVSLGSSSRTEVPSIGNCVSHGVRDDVNLFSRDDDENFSKYIHPRVTKHSPRTVPRIGDRRIRKILASRHWKGGSRHSDTKPWRNYYLHQQRSYPIKKRKNFDHISDSVTDDYRMRTKMHRGSRKGQGASFVASDSHGNNGVSSEFFVGLFLSPPIKKRMVMEAVSTLLSDGHRVGLMVQGKKVRDDNKTLHQTGISQDNSHLDSLDFSLEPSSEMPQLLTSHPLGHACEELLPVCQATKIDNVLESDHHDSALFPSDSLGNNNVTEDSKAMISVALNELSSQSQPPSRKSRRSEQQQQQAAQRRIRRPFSVAEVEALVQAVEKLGTGRWRDVKLCAFEDADHRTYVDLKDKWKTLVHTAKISPQQRRGEPVPQELLNRVLNAHGYWTQQQMQQLQQNVNKLEQETQSQTTEALEVVSPLCITTTIDDYVLANKGMKRICSVSSVQLFSRSFRALASPRSLNYPLQCIKRSSVRMESSNFSSGVRTESSVKPRGALIVLEGLDRSGKSTQCAKLLSFLNGLGHPTELWRFPDRETSVGQMISAYLSNKSQLDDHTIHLLFSANRWEKRSLMEEKLKTGTTLIVDRYSYSGVAFSSAKGLDIEWCKAPEIGLLAPDSVLYLDISPERAAERGGYGDERYERVEFQKKVADFYQTLGDSSWKIINASDAMEEVEKKIQQVVLDQVKECTEGKPLSLLWSS

SEQ ID NO: 3879 - protein, 392 aa, Triticum aestivum
MDSARSCLVDDVSSGASTGKKASPSPAAPATKPLQRVGSGASAVMDAPEPGAEADSGRVGRLPSSKYKGVVPQPNGRWGAQIYERHQRVWLGTFTGEAEAARAYDAAAQRFRGRDAVTNFRPLTESDPEDAAELRFLAARSKAEVVDMLRKHTYPDELAQYKRAYFAAAAASSPTSSSVPPASSPSSAASPSPAARREHLFDKTVTPSDVGKLNRLVIPKQHAEKHFPLQLPSAGAAVSGECKGMLLNFDDSAGKVWRFRYSYWNSSQSYVLTKGWSRFVKEKGLHAGDAVGFYRSASGSNQLFIDCKLRSKTTTMTTTFVNAAAAPSPAPVMRTVRLFGVDLLTAPAPSHAPEHEDCSMVPKTSKRSMDANAAATPAHAVWKKRCIDFALT

SEQ ID NO: 3880 - protein, 269 aa, Oryza sativa Japonica Group
APSSRRRRRRSCSSSRRRPAAWRTRRSRYLDCQKVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 3881 - protein, 535 aa, Zea mays
  misc_feature (181)..(181): Xaa can be any naturally occurring amino acid
MSARDSNHSYKCSDDSQMPYYNNSAPVGENGRIHMAENSLGHHYSSSDIGSQRINNSNPQVFEAQYCTLESSSANGVYPAQSSTSSHSISPLSGSPLSQHDSHSDHTYSSPPSASCLTEVADLLIKQKELENSIVGPGLDISSDCSRSLLQAHVPVRPDNWRQLLGIYGGDLMQVVIACGXKAVAENDVFATELLISELGHLVSVSGDPMQRLGAYMLEGIVARLSSSGSMLYKSLKCKEPTSSELMSYMHLLYEICPFYKFGYMSANGAIAEAIKGENFVHIIDFQIAQGSQWVTLLQALAARPGGPPYIRITGIDDSNSAYARGGGLDIVGRTLCDVANSCGLPFEFNAVPAASHEVELQHLAIRHGEIIAVNFAYQLHHVPDESESNTNTAPFFPRYMETLNYYTAMFESIDVALPRDDRRRMSAEQHCVARDIVNLIACEGAERVERHELFGKWKSRFAMAGFRPYPLSSVVNNTINTLLHTYNSYYRLEERDGVLYLGWKNRVPSHFGLHLTFLRHHYACLMCCNAQGLC

SEQ ID NO: 3882 - protein, 292 aa, Arabidopsis thaliana
MGSSCLPPGFRFHPTDEELIEYYLKRKVEGLEIELEVIPVIDLYSFDPWELPDKSFLPNRDMEWYFFCSRDKKYPNGFRTNRGTKAGYWKATGKDRKITSRSSSIIGYRKTLVFYKGRAPLGDRSNWIMHEYRLCDDDTSQGSQNLKGAFVLCRVAMKNEIKTNTKIRKIPSEQTIGSGESSGLSSRVTSPSRDETMPFHSFANPVSTETDSSNIWISPEFILDSSKDYPQIQDVASQCFQQDFDFPIIGNQNMEFPASTSLDQNMDEFMQNGYWTNYGYDQTGLFGYSDFS

SEQ ID NO: 3883 - protein, 482 aa, Ashbya gossypii ATCC 10895
MAEEIQMMGGMEVGKKLPAAQKGCVPRGNGSRAAYNDFVRKLFAILESGEYTDIISWTKEGNSFVVVDTNEFTTNILPKHFKHSNFSSFVRQLNKYDFHKVKRTPEERQSSVYGEHSWEFQHPRFRRNDEAALDRIKRKTVTQKKVSLTDDMLAGHQRVGNGAVAFPAMDLGATTNLLLNNTINKTKFSQLKKRVDSIELHNQQLRAENNSLKIEFQKMSSRYNSMVENLVSLKNYNNSLVENFNLLVSTLAQQGLKVPHPLNLGNYASSQVAKNSSASDVQPHVSPLGTVAPTSIPLAQATPSKEEANPPTSLRPGFHVLLVEDDSVCIQLCSKFLRKYGCSVEVVTDGLSAIETVEKFQYDLVLMDIVMPNLDGATATSVIRSFDNQTPIIAMTGNIEDQDLVTYLQHGMNDILAKPFTKDDLHSMLVRYLKDRIPLTEQASVVGTAQSGAQPPLLKEEQGGIQDQVLLQGEPLLKKPRV

SEQ ID NO: 3884 - protein, 175 aa, Draba nemorosa var. hebecarpa
MVRGKTQMKRIENATSRQVTFSKRRNGLLKKAFELSVLCDAEVSLIIFSPKGKLYEFASSNMQDTIDRYLRHTKDRISSKPVSEENMQHLKHEAANMMKKIEQLEASKRKLLGEGIGTCSIEELQQIEQQLGKSVKCIRARKTQVFKEQIEQLKQKEKALAAENEKLSEKWGSNE

SEQ ID NO: 3885 - protein, 261 aa, Zea mays
MVKTATATAAARHGGAHKRTYKGVRMRSWGSWVSEVRAPGQKTRIWLGSHSTAEAAARAYDAALLCLRGSAAAPDLNFPPRRPLADGLHPLPPAAMSPKAIQRVAAAAAACCAPQSNGIGSACCAAPCAPPSNGIGSACGHAETAPALSGSPPSSDSDVSSPEAGSTASSDGELARYGDGDGDGGVSVDYGSLADIDAFFQSPKCMDDDHYYYAALMDPCGAFFAPAPSVAADDDAAAAAGCWEDGDGIALWSFSFPALDC

SEQ ID NO: 3886 - protein, 219 aa, Hordeum vulgare subsp. vulgare
MGATEDSSSGSETTTSSSVEALASPPSPTATTASSKKKRARNDGRHPTYRGVRMRSWGKWVSEIREPRKKSRIWLGTFATAEMAARAHDVAALAIKGRAAHLNFPDLAHELPRPATAAPKDVQAAAALAASADFPASATATANAGAKNPDGPEPNAASASTPPDTAEDALFDLPDLLFDLRHGPPSCQVSCASTWDDDVAFAGPGAGVFRLEEPLQWEY

SEQ ID NO: 3887 - protein, 464 aa, Humulus lupulus
MGRSPCCEKVGLKKGPWTPEEDQKLLAYIEEHGHGSWRALPAKAGLQRCGKSCRLRWTNYLRPDIKRGKFSLQEEQTIIQLHALLGNRWSAIATHLPKRTDNEIKNYWNTHLKKRLTKMGIDPVTHKPKIDALGSGSGNPKDAANLSHMAQWESARLEAEARLVRESKLLVTNNIVNNSNNNNNNNNSNSNNIAVLPHNHNHQLGSAPAHHFMNKPGGAIAPPPCLDVLKAWQGAWTKSSNSSRDCNTLAGMMAVDDLESPTSTLNFPDANHSYTRINNQTTTTVGGGFGTNTTTDHDQTDNVDGWKSCYGTTTTNTPTKVAMSDHNHNNNHMAVAPPTPPEFKERNMEHANTMSLQDIAFACSHDGGAWFVDHGFRAGATMDGTSDSVAVPTVALSNIIEGFTDAFMYNSEQEPNSAVVDVVGDGENSNDGSCGASGIFEENKNYWNSILNLVNTSPSGSPVF

SEQ ID NO: 3888 - protein, 196 aa, Herrania cuatrecasana
CPVKKKVERSFDGQIAEIVYKGEHNHSKPQPPKRNSSGTQGLGFASDGTGQDTNNSLWSNNPNERNEGSEGRVENQNEVGLSAPPSYQGKAVLSYEHVSTGAVNAGVTSENSIGLSGECEERSKEGEDDEPRSKRRKGENQSSEVGTSGEGIQEPRVVVQSCTDSEIMGDGFRWRKYGQKVVKGNPYPRSYYRCTS

SEQ ID NO: 3889 - protein, 456 aa, Oryza sativa Indica Group
MAAFSSSNGVPPGFRFHPTDEELLLYYLKKKVGFEKFDLEVIREVDLNKIEPWDLQERCRIGSAPQNEWYFFSHKDRKYPTGSRTNRATTAGFWKATGRDKCIRTSYRKIGMRKTLVFYRGRAPHGQKTDWIMHEYRLEDADDSQSASSEDGWVVCRVFKKKCFFKIGGGGGGEGSGGSQGGDVGGGHLAVSPPLGGGHAMAAASHYMHPHHQYHHHHHHAAAASPFYYTQMPPPAAAAPPHAAYSHHVQVQDLLTNHRPSADAGYDFSGLPAVDHHHHHPGLDVGSSDGGGGVAAGGADGDQAAAAAAGSTDQQQWQAMDGFSNGGAGAAAAVQQQLGAMSSGQRGGEMDLWGYGRLTFYIFGNASPSNLTQASYFPSTQCNVHLLQIIEAFQKCHVDHPVKKFFGECTDLKIKLDQCFRQEKALKRKANFEESKKFKEQLLAYKKEMAEQDKES

SEQ ID NO: 3890 - protein, 349 aa, Glycine max
  misc_feature (79)..(79): Xaa can be any naturally occurring amino acid
  misc_feature (98)..(98): Xaa can be any naturally occurring amino acid
  misc_feature (296)..(296): Xaa can be any naturally occurring amino acid
  misc_feature (340)..(340): Xaa can be any naturally occurring amino acid
MGAPKQKWTAEEEAALKAGVLKHGAGKWRTILTDPEFSAILRMRSNVDLKDKWRNINVTAIWGSRQKAKLALKRNLPAXKIDNNHMALSTIVRNDEFXDTKPIAVSGGPLQSPNLKEQISRLVDNHILEAIVNMKEQKGSDKVAIASFIEEKYRSPPNLSKLLSTKLKHMVASGKIVKEKHKYRIAPSSTVSEKRRCSSLVLLEEKPKDPSEVHKNDDVNILSKSQIDAEISKVKGLTAQEAAAAAAKAVAEAEAAIAQAEAAAREAEAAEAEAEAAQVFAKAAMKALKCKMLHIXWCGLTHAHHQQSWLEMIVLLLCFLPVFFVTVHNFRLVNLEYAGXFMKYSVRNQ

SEQ ID NO: 3891 - protein, 265 aa, Humulus lupulus
MGRSPCCEKAHTNKGAWTKEEDDRLIAYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNESGQETTNTSTTTTATTTTTTTASNTTTTISFAASTVKEEEKTTSVLLNPIQEQCPDLNLELRISPPYPHQQRQPDQLKSGGASLCFACSLGLQNSKECCCTISSMDSNNPSTSVGYDFLGLKSGVLDYRSLEMK

SEQ ID NO: 3892 - protein, 196 aa, Herrania kanukuensis
CPVKKKVERSFDGQIAEIVYKGEHNHSKPQPPKRNSSGTQGLGFASDGTGQDTNNSLWSNNPNERNEGSEGRVENQNEVGLSAPSSYQGKAVLSYEHVSTGAVNAGVTSENSIGLSGECEERSKEGEDDEPRSKRRKGENQSSEVGTSGEGIQEPRVVVQSCTDSEIMGDGFRWRKYGQKVVKGNPYPRSYYRCTS

SEQ ID NO: 3893 - protein, 292 aa, Arabidopsis thaliana
KDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLGDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 3894 - protein, 196 aa, Herrania nitida
  misc_feature (6)..(6): Xaa can be any naturally occurring amino acid
  misc_feature (10)..(10): Xaa can be any naturally occurring amino acid
  misc_feature (25)..(25): Xaa can be any naturally occurring amino acid
  misc_feature (70)..(70): Xaa can be any naturally occurring amino acid
  misc_feature (90)..(90): Xaa can be any naturally occurring amino acid
  misc_feature (115)..(115): Xaa can be any naturally occurring amino acid
  misc_feature (133)..(133): Xaa can be any naturally occurring amino acid
  misc_feature (152)..(152): Xaa can be any naturally occurring amino acid
  misc_feature (191)..(191): Xaa can be any naturally occurring amino acid
CPVKKXVERXFDGQIAEIVYKGEHXHSKPQPPKRNSSGTQGLGFASDGTGQDTNNSLWSNNPNERNEGSXGRVENQNEVGLSAPPSYQGXAVLSYEHVSTGAVNAGVTSENSIGXSGECEERSKEGEDDEPRXKRRKGENQSSEVGTSGEGXQEPRVVVQSCTDSEIMGDGFRWRKYGQKVVKGNPYPRSXYRCTS

SEQ ID NO: 3895 - protein, 319 aa, Arabidopsis thaliana
MAPLESPATASSSEVESSSEEIFKSSSEESKPKDPVTVPSSKTLKSPSAAVNSKTDSSDDSEKQSFVLTRRKKKEGAAESPAVKSGKKRAGEGSTSRDMHVKRVKKEDDNKKANPQRVWSEEDEISLLQAVIDFKAETGTSPWDHKNAFFDIAKKSISFDVSHVQFFDKIRRLKNKYFVNRKNKSGESNHDKKCLGLAVLIWGSDGMNVESPVKKDESILVKGKANSKEKKVEKPLVIEDEQVILGADSEWFEESFLVPVIANLGLDEYSVKKKWSKVSLETKKKIQEKMKVVDAKKCELLLAEMDVLKDVTSVLAQTN

SEQ ID NO: 3896 - protein, 192 aa, Vitis vinifera
MALGLEITELRLGLPGHADSHHPAGVNAVERNEKKRVFSEMSGDSSATTCERKAQNKNQVVGWPPVCSYRRKNSFNDKDRTEATKMYVKVSMDGAPFLRKIDLSSHQGYFNLVTAFEELFGCFGIGEALKDADSSEYIPIYEDKDGDWMLVGDVPWEMFIESCKRLRIKKKSETKNFGLQLNSLKELQKIND

SEQ ID NO: 3897 - protein, 356 aa, Arabidopsis thaliana
MVLNMESTGEAVRSTTGNDGGITVVRSDAPSDFHVAQRSESSNQSPTSVTPPPPQPSSHHTAPPPLQISTVTTTTTTAAMEGISGGLMKKKRGRPRKYGPDGTVVALSPKPISSAPAPSHLPPPSSHVIDFSASEKRSKVKPTNSFNRTKYHHQVENLGEWAPCSVGGNFTPHIITVNTGEDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSFLAGTDHQDQKPKKNKHDFMLSSPTAAIPISSAADHRTIHSVSSLPVNNNTWQTSLASDPRNKHTDINVNVT

SEQ ID NO: 3898 - protein, 117 aa, Physcomitrella patens subsp. patens
MGTAQRCHVSEEVDRIKGPWSPEEDSALQQLVDKYGPRNWSLIGKGIPGRSGKSCRLRWCNQLSPQVQHRPFTTVEDETIIAAHSQHGNKWATIARLLPGRTDNAIKNHWNSTLRRR

SEQ ID NO: 3899 - protein, 365 aa, Oryza sativa Japonica Group
MEELEGHRGEGRLPPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPAPEDPELKLVTEDYCKLLVECKEELSRPLQEAEEFLRTVESELNSINSGPPLTALISESKAGLDSSDDDEHEDGSGMEMMEAAEDEDLGIIDPRSDDKALKRHLLRKYSGYLGGLRKELSKKRKKGKLPKEARQKLLTWWELHYRWPNPSEMEKIALAESTGLEQKQINNCFINQRKRHWKPTEEMEFAVMEAYHHQSTDAAAAFYVDVDARLVGATAAAPASAVYTARPDHGVWRA

SEQ ID NO: 3900 - protein, 172 aa, Brassica napus
MAPTAKTTAFETNGGDGGNKENRYRGVRKRPWGRYAAEIRDPTKKTRVWLGTFDTPEAAARAYDKAAFQFRGAKAKTNFHLPFFVAENESPSQSSTVESPSSLPDLNLGSISSVDSRFPFPKIQVKSGMIVFDEESGRSESDSSSVVVYLSSEKRPRVFLDLDLNLPPKPEN

SEQ ID NO: 3901 - protein, 860 aa, Oryza sativa
MWGPGGGMARAEVGDRGGQGGAAPADVSRNPEAQGQGGGVGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGWMQMSKPESYSEMLSGFQPPKDVRTPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 3902 - protein, 591 aa, Populus trichocarpa
MAASSGSLDTSGNSHPQSSNNYFSFSTNSSNHYPFMTSSSFTDLLASNDEEPINNNTGNSKLGDRIAERTGSGVPKFKSTPPPSLPLSPPPVSPSYYFAIPPGLSPTELLDSPVLLNPSNILPSPTTGTFPGQGLNWKSSSGNIQQNVKKEDRSFSDFSFQQPARPSTTSSAMFQSSNSTVQPGQQQTWGFQEPAKQYEFVSGKSNMVKMEYNSNSMKSFSPEIAAIQANPQSNNGFQSDHGNQPQQYQSVREQKRSDDGYNWRKYGQKQVKGSENPRSYYKCTFPNCPTKKKVERSLDGQITEIVYKGSHNHPKPQSTRRSSSTGSNPAMIPAPNSNSNEIQDQSYVTHGNGQMDSSVATPDNSSISIGDDDFDSQKSKSVGGDDLDEDEPEAKRWKRERDNEGISAPGSRTVREPRVVVQTTSDIDILDDGYRWRKYGQKVVKGNPNPRSYYKCTFQGCPVRKHVERASHDLRAVITTYEGKHNHDVPAARGSGSRSLQDHSNNGNNNAAMAIRPSTVNHVSNNPIRNQRAPPTATSEGDMPFTLEMLQSPGSFGFSGFGNLMGSYMSQSSTDEVLSRAKRELEVESFW

SEQ ID NO: 3903 - protein, 387 aa, Triticum aestivum
  misc_feature (195)..(195): Xaa can be any naturally occurring amino acid
  misc_feature (236)..(236): Xaa can be any naturally occurring amino acid
  misc_feature (248)..(248): Xaa can be any naturally occurring amino acid
  misc_feature (254)..(254): Xaa can be any naturally occurring amino acid
MPPLLPYTELRGIEKRSLSVELYFSLSSYELGFVNLLMDQSSFGNLGAGEGGSSSSKASSSFLQLQPLSTTTVASGPGPMGGTYYGTPLALHQAAAAAGSSQYQFHHHKSSGEEISQAEAEAIKAKIMAHPQYTALLVAYLDCQKVGAPPDVLERLTAMAAKIDAHPPGRLHEARDPELDQFMEAYCNMLAKYRXEELTRPIEEAMEFLKRVEAQLDSLTGGGHGSARLSLADGKXKALALSEDEMDXPAGREXNEPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGQFMADGMYSLGS

SEQ ID NO: 3904 - protein, 156 aa, Physcomitrella patens subsp. patens
MSRRCSHCGLNGHNSRTCPERGVRLFGVRLTDGVSSTNMRKSVSMNNLSHYSNVHNPASPPEQWESGAAPDGYVSDGLVQTSNNARERKKGVPWTEDEHRLFLLGLQKLGKGDWRGISKNFVQTRTPTQVASHAQKYFIRQSNMNKRKRRSSLFDM

SEQ ID NO: 3905 - protein, 121 aa, Oryza sativa
MEVGNGKCGGGGAGCELCGGVAAVHCAADSAFLCLVCDDKVHGANFLASRHPRRRWGVELVDDGGRARRRPPPPGGAGPSAPDPPPPPATARRIFRPPEIESTKNAKLVGNDCLFASSLIN

SEQ ID NO: 3906 - protein, 187 aa, Physcomitrella patens subsp. patens
MSRRCSHCGLNGHNSRTCPERGVRLFGVRLTDSVSSTNMRKSVSMNNLSHYSNVHNPASPPEQWESGAAPDGYVSDGLVQTSNNARERKKGVPWTEDEHRLFLLGLQKLGKGDWRGISRNYVHTRTPTQVASHAQKYFIRQSNLNKRKRRSSLFDIVSESASVYHISAAFPRVSNVCNTDSNRTATN

SEQ ID NO: 3907 - protein, 361 aa, Populus tremula x Populus alba
MEGGDGGSSTTSCMMAFGDNSNGLCPMMMTPLMSSSSAHHHHRANEGDSSVSNTLFLPLPPTNNQGHNRIHSNASGSSSMIIDDHNHNNTVTATGCYFMDNNDGSSSSVKAKIMAHPHYHRLLAAYANCQKVGAPPEVVARLEEACASAASMAPANTGCIGEDPALDQFMEAYCEMLTKYEQELSKPLKEAMLFLQRVECQFKALTVSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 3908 - protein, 208 aa, Nuphar advena
LGDAEVALIVFSTRGKIYEYSSDSSITRILERYERFSCAERDPSVTDLDSQESWCVEYKKLKSKFEQLQKTQRRYMGEDLEPLSVKELQQLEHHLDSSLKDIRSRKIQLLLDSISELRRKEKSLQEQNEAIQKKLREQEAALNCLQSARSEQPQSRTVGFLFNSHSPTPDSGAYQTRNREAEESPHQHLQTQTSINNMPPWTLRLMTE

SEQ ID NO: 3909 - protein, 186 aa, Brassica napus
  misc_feature (98)..(98): Xaa can be any naturally occurring amino acid
  misc_feature (158)..(158): Xaa can be any naturally occurring amino acid
MTKMVLKPDPNLTQSNAKEIPYRGVRKRPWGRYAAEIRDPRKKTRVWLGTFDTAQQAARAYDAAAREFRGAKAKTNFPTSLELNVNDGGYSRSPSQSXPVDSASPTVARLVTPPQLELSLGNGSGAGYQIPVARHVYLFNMTAFPLAATCGVQSESDXSSVVDFEGGGEKKSQPLDLDLNLAPPAE

SEQ ID NO: 3910 - protein, 309 aa, Arabidopsis thaliana
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 3911 - protein, 371 aa, Helianthus annuus
MAGVVKEFDSSHDMFKVREEPKVVFNNKDLSEEMMKIKEEPMLVFDEHEDFVGGEEAPKPIEGLRDGGPPPFLKKTFEMVDDPTTDSIISWSSSKNSFILWDPHKFSTDLLPQRFKHNNFSSFVRQLNTYRFKKIDPDRWEFANEFFQKGKKHLLRDIKRRTNQPQNTQKQEEIRKQEQQQCCGHQTNSTMETELKNLRKERITLKQEILKMKQQQENTEKHLEMVEERMLRMEFKQQQLLVFMSKAFRNPIFVKLLQHLVQKQKTGSVEMCKKRKLEQMLNTDDLDRFQEMWNMIEPDAYTVLSSDGSVSPPEDQNTSDKSGSNGSDYNSESFILWEKLMEDELIFGGEQSGKDQTETYLQEWEELIPKA

SEQ ID NO: 3912 - protein, 182 aa, Physcomitrella patens subsp. patens
TDPKPRLRWTPELHERFVDAVNQLGGADKATPKSVMRVMGVKGLTLYHLKSHLQKFRLGKQLQRDSHEANKDATYVCGILTGSSHLRGTSSDSKFSPANHQNPQEYYVNVNEALQLQMAAQIRLQEQLEVQKQLQQRIEAQGKYLQSILEKAKETLADHTSASPVLKEVHEELTTLASKVIN

SEQ ID NO: 3913 - protein, 163 aa, Oryza rufipogon
MEELEGHRGAGRLPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 3914 - protein, 208 aa, Buxus sempervirens
EVALIVFSTKGKLFEYSTDSCMDQILERYERYCCAERELGAADTESQGSWTQEYTKLKSTIEVLQKNLRHLKGEDLESLRLKELQNLEQQLDNSLKHVRSRKNQLMHDSISELQKKEKELQEQNNMLNKKLKEKERAKTQQAQWEQQNQGPNSPSLQLSQPLPFLNIGGTYQTRSTRNQEEGGRPHHSNRTDALMPPWMLTYMNNLDD

SEQ ID NO: 3915 - protein, 161 aa, Oryza glaberrima
MEELEGHRGAGRLPPPPPLLPFPKVSVQVYTVPSSSTAASAAAAGGARQAVAPATRDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 3916 - protein, 199 aa, Buxus sempervirens
EVALIIFSHNGKLTQYSSTNSRMESILERYESYACAERELIPADPNSQGSWSQEYTKLKSRIEALQGSQRKLMGEDLDFLSLKELQYIEQQIDSSLKHIRTRKNQLLCDSISELQRKEKALQEQNNKLDKELKERDKALAQYIYWKQQGQNPSSFLLSQPHPSLNIEGNFQARTRRDEAEGTELHTKTNGFMPPWMRHH

SEQ ID NO: 3917 - protein, 181 aa, Physcomitrella patens subsp. patens
MQGGQPQQGQLICSGCRTLLVYPQGASNVRCALCSSVTQVPSHGTEMAQLVCGGCRTLLMYMRGATSVQCSCCHTVNLAMEAPQVAHINCGGCGMTLMYAYGAQSVKCALCQFVTTITMPSMRVQLPSISQQPRPPQAHGGPPPALTSSHTQTVVVENPMTMDESGKLVSNVAVGVSTDRR

SEQ ID NO: 3918 - protein, 159 aa, Oryza meridionalis
MEELEGHRGAGRLPPPPPLLPFPKVSVQVYTVPSSSTAAAGGARQAVAPATRDGGGGGRAAGVLDDPVKARIVSHPRYHRLLAAFLDCHKVGCPAEAAEEIAAAARVREARQRAAAAASHMPPAPDDPELDQFMEDYCKLLVECKEELSRPLQEAEEFL

SEQ ID NO: 3919 - protein, 206 aa, Buxus sempervirens
EVALIVFSTKGKLFEYSTDSCMDQILERYERYCCTERDLIAADTGSQGSWTLECAKLKSRIEVLQRSQRHLMGEDLESLRLKELQNLEQQLDTSLRHVRSRKNQLMHESISDLQKKEKELQEQNNMLIKKLKEKEKTIAQQAHWEQQSEGTNSATLQLSQPLPSLTIGGTYQTRSTGSQEEENHPRNRTHALMPPWMATHMNNAQM

SEQ ID NO: 3920 - protein, 426 aa, Glycine max
DNAASAGDQVSEMLEISRAQLDRSFKQLRKTVYHSSSILSNLSSSWTSKPPLAVKYRLDTGSLDEPGGPKSLCSTLERLLAWEKKLYEEVKAREGVKIEHEKKLSALQTQEYKGEDEAKIFKTKASINRLQSLIAVTSQAVSTTSTATIGLRDSDLVPQLVDLIHGFMYMWRSMHHYHEIQSNIVQQVRGLVNRSSRGDSTSELHRQATRDLESAVSAWHNSFCRLIKFQREFILSLHGWFKLSLVPVHNDNINGRETSETYQFFDEWKLALDRVPDTVASEAIKSFINVVHVISSKQVEELKIKKRTETASKELEKKASSLRNLERKFYSSYSMVGISLPDSAPDNGQVLDARDPLAEKKIELATCQRRVEDEMLRHSKAVEVTRAMTLNNLQTGLPGVFQALTSFSSLFAEALESVCTRSYAIK

SEQ ID NO: 3921 - protein, 204 aa, Decaisnea insignis
EVALIVFSHKGKLSEYSTDSSMERILERYERCSYAAQELVTIDPESQGSWPLESRKLKARLEVLQKKQSHFMGGDLDSMSIKEIQSLEQQLDYSLKQIRSRKNQLLYESISELQRTEKALQEQNDQLGKKIKEKENILTQQANWEQSNQGQNSPSFLLSQTLPSLNIGGPYQARGSSIGEEVGGGQPQTRPNTLMPPWVLRQVN

SEQ ID NO: 3922 - protein, 252 aa, Arabidopsis thaliana
MDYNSLEKVFKFSPYSSPFQSVSPSVNNPYLNLTSNSPVVSSSSNEGEPKENTNDKSDQMEDNEGDLHGVGESSKQLTKQGKKKGEKKEREVRVAFMTKSEIDHLEDGYRWRKYGQKAVKNSPYPRSYYRCTTQKCNVKKRVERSFQDPSIVITTYEGKHNHPIPSTLRGTVAAEHLLVHRGGGGSLLHSFPRHHQDFLMMKHSPANYQSVGSLSYEHGHGTSSYNFNNNQPVVDYGLLQDIVPSMFSKNES

SEQ ID NO: 3923 - protein, 264 aa, Glycine max
MVRAPCCEKMGLKKGPWTPEEDQILMSYIQKHGHGNWRALPKLAGLLRCGKSCRLRWINYLRPDIKRGNFSSEEEEIIIKMHELLGNRWSAIAAKLPGRTDNEIKNVWHTHLKKRLMNSDTNKRVSKPRIKRSDSNSSTLTQSEPTSSSGCTTSSDFSSFSEGTKNMDNMIKREDIESMETVKPPIDESFWPQETVDYESSTMMQSSNSWTISNELAPPQYQFNSVETFQQQSVGYNDSKFDDGMDFWYDIFIKSGESIELPEF

SEQ ID NO: 3924 - protein, 161 aa, Oryza glumipatula
MEELEGHRGAGRLPPPPPLLPFPKVSVQVYTVPSSSTSASAAAAGGARQAVAPATRDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 3925 - protein, 380 aa, Glycine max
  misc_feature (91)..(91): Xaa can be any naturally occurring amino acid
  misc_feature (141)..(141): Xaa can be any naturally occurring amino acid
  misc_feature (154)..(154): Xaa can be any naturally occurring amino acid
MEMQDQIESTRSTIFGSASNIHSNAEKQAENVAPKVRKPYTITKQREKWTEEEHQKFLEALKLYGRGWRQIEEHIGTKTAVQIRSHAQKFXSKVVRESEVSDEGSIQPINIPPPRPKRKPLHPYPRKSVNSFRGPTIPNEXEISPSTNLLVAEXDTPSPTSVLSTVGSEAFGSQFSEQTNRCLSPNSCTTDIHSVSLSPVEKENDCMTSKESEEEEKASPASRPLSTVSNPKMCMKPEFSSKEIEDATDMPQTTSIKLFGRTVSMVGNQKSLKIDDDGKPITVKSDEVDDVENEKLGQSGESKQVDTQLSLGVVSGNWPITPDADGANVTSIEPPKENQCFSESAPDAFFPQWSLSQGLPPFYLRPCNQVLIPCLLGPPL

SEQ ID NO: 3926 - protein, 260 aa, Oryza sativa Indica Group
MSSRQPIGSGGGGAPPDWHDVEPQWQPVDDVVTVAAAAAYLAAPAGATLSSESADRRWRPVGPSAAAAAAALQAVEAQGAAAAERHYRGVRRRPWGKWAAEIRDPNKAARVWLGTFDTAEAAAAAYDDAALRFKGAKAKLNFPERVRGRTGQGGFLVSPAVPRPPPHGVPAPAPAVAPAPFPDLIQYARLLRSGEDAAAAAAVAGIAATAAPAAQILDFAAQRLVGVSPAMAPRPPSTLPTTTTAASSPSAWTHGGGHGS

SEQ ID NO: 3927 - protein, 569 aa, Gibberella zeae PH-1
MTAIESFDNIYLDLSKESGKCRFAETGFGWKPVGGGDTFTLDHNNIASAQWSRAAKGYEIKIVQRSKSGIIQLDGFQQEDYDRLAKVFKNWYSTVLESKEHALRGWNWGKAEFSKSELTFSVQNRPAFELPYSEIGNTNLAGRNEVAVEMALPESGANAQLGGARSKGSKAAAGRDQLVEMRFYIPGVTTRKEAEGEDAGSDAGNDEQEKNAATLFYETLIDKAEIGETAGDTIATFLDVLHLTPRGRFDIDMYEASFRLRGKTYDYKIQYEAIKKFMVLPKPDEVHYMLVMGLDPPLRQGQTRYPFVVMQFKKDEEVTIDLNLNEEELKSKYQDKLEPHYEEPLHQVVAKIFRGLGNRKISSPAKDFITHRNQYGIKCSIKASEGFLYCLEKAFMFVPKPATYIAYEQTQSVTFSRVSGAVSALSTFDITVLLKNGAGSSQFSNISREDLKALESFFKLKGLRVKNEIDEDANLLAAAMNQQMDDSEDEVAAKADRGSADEDEESVDEDFRTDSESDVAEEYDSAHESDGSGSDESNVDDDEQDDDDDDDDDDGEDEDERPKKKKKTG

SEQ ID NO: 3928 - protein, 534 aa, Arabidopsis thaliana
VNSTFSFFFFSRFHKNSLDLKLTAENNPTLITGYIKAAIVVLFTLWVIRVYDFWVGFKCMDGREAMAFPGSHSQFYLQRGVFTNLTPSQVASGLHAPPPPPGMRPMSNPNIHHPQASNPGPPFSMAEHRHSDFGHSIHMGMASPAAVQPTLQLPPPPSEQPMVKKKRGRPRKYVPDGQVSLGLSPMPCVSKKSKDSSSMSDPNAPKRARGRPPGTGRKQRLANLGEISSEWMNTSAGLAFAPHVISVGSGEDIVSKVLSFSQKRPRALCIMSGTGTVSSVTLREPASTTPSLTFEGRFEILSLGGSYLVNEEGGSKSRTGGLSVSLSGPEGHVIGGGIGMLIAASLVQVVACSFVYGASAKSNNNNNKTIKQEIKPKQEPTNSEMETTPGSAPEAAASTGQHTPQNFPAQGMSGWPVSGSGSGRSLDSSRNPLTDIDLTRGSSSIHYVSAVHIFVVVDFSLGMLKPDISGLRPELSVPYCNILNVTEPPHFQATQRDCNSFISLIKASFGFFKKKKKKSFRGEKKKKKKKNASC

SEQ ID NO: 3929 - protein, 207 aa, Brassica napus
TSAGLAFAPHVISVEAGEDVVSKVMAFSQQRPRALCVMSGTGTVSSVTLRQPATTEASLTFEGRFEILSLGGSYLVNEGGGPKSRTGGLSVSLSGPEGHVLGGGIGMLIAASLVQVVACSFVYGGIAKPNNTNKTIKQENKPKEEHDNSEMEPTPANAPEEAHETPQDFSAQGMSGWPGSGEGSVSGSGRSLDSSRNLLTDIDLTRG

SEQ ID NO: 3930 - protein, 244 aa, Triticum aestivum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAATTSIHPAASGERAEDAAVQPQAPPRTGLPLWMVSHING

SEQ ID NO: 3931 - protein, 278 aa, Oryza sativa Japonica Group
HASDGRTQLASWARIAMDRGDHHHLQQQHQFLMPPPAPVVPPQLCMPAMMADEQYMDLGGGGAAAAPGRGGAGERKRRFTEEQIRSLESMFHAHHAKLEPREKAELARELGLQPRQVAIWFQNKRARWRSKQLEHDYAALRSKYDALHSRVESLKQEKLALTVQLHELRERLREREERSGNGGAATTAASSSSCNGSGSEEVDDDDDKRNAAAGCLDLEPPESCVLGGATCATPADVSVESDQCDDQLDYDEGLFPESFCATPELWEPWPLVEWNAVA

SEQ ID NO: 3932 - protein, 720 aa, Oryza sativa Japonica Group
MESGGGSHVAEMPRVPKSARGKRSIRKKESQGQVMCAFDLLATVAGKLLDEGEGSLGNASSGTPAVDASPKDVRVKQEQCDEEAKHFKNEVMDQDSCNESALVSHIAFQRPVNHHGRKGEDPEGSHAVIEDPKAKSEALDKESSMISCTKAELGCNFAAIADRWSPESVESGAFTGDAAAIAMPATTSGFHKNAPDMYNLLDPMDVDVKPPPLVSSDSTGEMPLYGNKIRRSTSFPRVPKGGAGFTVDRDEDDDDKSSGCTHPSTATNRGFRPNCTAGHSRVKKLLACKHRKVAPARMHKGDLSYSGEHCEIPFTFSFFEEHCIDGTHIQTCLLYSYLSSLILLDVDRKPSFRNKKMYYTRQRTQRSTFKRRKMFDRHSAQVSEEYAKANTKFAARDSHAVSLEANKGTNSTAFQKSQESSDCHVKLRIKSFKVPELLIEIPETATVGSLKKTVLEAVNAILGGGLRVGVLHHGKKVRDDNKTLMQAGISHDEVLDNLGFSLEPNCAPHPSQLSPPEDNEFMETVDTTEPLARIAPADSSSKHGEVDASQELALAPLSANYQGSDHDFVHSPGGMSSPDKASTNSRAIVPVTPADSNAGAIVPANKAKRSPEQGQRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPPLAEALLLT

SEQ ID NO: 3933 - protein, 345 aa, Glycine max
MGVPEKDPLSQLSLPPGFRFYPTDEELLVQYLCRKVAGHHFSLPIIAEIDLYKFDPWVLPSKAIFGEKEWYFFSPRDRKYPNGSRPNRVAGSGYWKATGTDKIITTEGRKVGIKKALVFYIGKAPKGTKTNWIMHEYRLLDSSRKNTGTKLDDWVLCRIYKKNSSAQKAVQNGVVPSNEHTQYSNGSSSSSSSQLDDVLESLPAIDERCFPMPRVNTLQQQQHEEKVNVQNLGEGGLLDWTNPSVLNSVVDFVSGNNNHNQLVQDQTQGMVNYNACNDLYVPTLCHVGTSVPQKMEEEVQSGVRNQRVQNNSWFLQNDFTQGFQNSVDTSGFKYPVQPVGFGFRN

SEQ ID NO: 3934 - protein, 646 aa, Arabidopsis thaliana
MADGHSFNNISLSGRGGKNPGLLKINSGGIQWKKQGGGKAVEVDRSDIVSVSWTKVTKSNQLGVKTKDGLYYKFVGFRDQDVPSLSSFFQSSYGKTPDEKQLSVSGRNWGEVDLHGNTLTFLVGSKQAFEVSLADVSQTQLQGKNDVTLEFHVDDTAGANEKDSLMEISFHIPNSNTQFVGDENRPPSQVFNDTIVAMADVSPGVEDAVVTFESIAILTPRGRYNVELHLSFLRLQGQANDFKIQYSSVVRLFLLPKSNQPHTFVVISLDPPIRKGQTMYPHIVMQFETDTVVESELSISDELMNTKFKDKLERSYKGLIHEVFTTVLRWLSGAKITKPGKFRSSQDGFAVKSSLKAEDGVLYPLEKGFFFLPKPPTLILHDEIDYVEFERHAAGGANMHYFDLLIRLKTDHEHLFRNIQRNEYHNLYTFISSKGLKIMNLGGAGTADGVAAVLGDNDDDDAVDPHLTRIRNQAADESDEEDEDFVMGEDDDGGSPTDDSGGDDSDASEGGVGEIKEKSIKKEPKKEASSSKGLPPKRKTVAADEGSSKRKKPKKKKDPNAPKRAMSGFMFFSQMERDNIKKEHPGIAFGEVGKVLGDKWRQMSADDKEPYEAKAQVDKQRYKDEISDYKNPQPMNVDSGNDSDSN

SEQ ID NO: 3935 - protein, 216 aa, Illicium floridanum
KRIENTTNRQVTFCKRRNGLLKKAYELSVLCDAEVALIVFSTRGRLYEYANNSVKGTIERYKKACTDTSNSGCITEANSQYYQQESSKLREQIGILQKANRHLMGDGISSMSIKELKQLENRLEKGIGKIRTKKNELLYAEIEYMQKRETDLQKDNMYLRAKITENERAQQHMNMLPGPEYDMMPQFDSRNFLQVNLLEPSHHQYSHQEQTTLQLG

SEQ ID NO: 3936 - protein, 220 aa, Oryza sativa Japonica Group
MTAALQALLDPTALSLGLPTPAINKEEYLAICLAALACTRAGKALVGVGGQQQVQACSKWLCPAPAAPEELRFRCTVCGKAFASYQALGGHKSSHRKPPSPGDHYGAAAAAQQLASAGDSKEDSASSAAGSTGPHRCTICRRSFATGQALGGHKRCHYWDGTSVSVSVSASASAASSAVRNFDLNLMPLPESTAAAGIKRWAEEEEVQSPLPVKKLRMSN

SEQ ID NO: 3937 - protein, 328 aa, Vitis vinifera
MILDHASLEASNLSNHKGKSPNRKLFAQDNNDEISNDGKKKKKKIVHRDVERQRRQDMATLYTSLRSLLPLEYIKGKRAISEHMNGAVNYIKHLQKKIKELGEKRNELKSLANSSSRNSSGNFNTSSSNKKILRRDMERQRRQEMANLNASLRSLLPLEYVKGKRSISDHMHEAVNYINHLQMKIQDLGTKRDELRNQSNMSACDSESGSSYKRSRHCVIVSPCMDGVEILISGGFKEGLLLSKVMEVLLEEGLGVHRCVSTKVNEGLLHTMNCKVLRINIELSVHSFLPRYRVSCKVFTSFVEFHLSRSAIPQVLTYVGCGRNCGML

SEQ ID NO: 3938 - protein, 556 aa, Glycine max
HASGKPKEGFDAVKQRQSQEQARRKKMSRAQDGILKYMLKMMEVCKAQGFVYGIIPEKGKPVTGASDNLREWWKDKVRFDRNGPAAIAKYQADNAIPGKNDGCNPIGPTPHTLQELQDTTLGSLLSALMQHCDPPQRRFPLEKGVCPPWWPTGNEEWWPQIGLPKDQGPPPYKKPHDLKKAWKVGVLTAVIKHMSPDIAKICKLVRQSKCLQDKMTAKESATWLAIINQEEDLARELYPDYCPSLTTSGGSGSMVINDCNEYDVEGGDDEPNFDVEDRKPENLHASNLGMDRMRGRLPVQQPSFPIKGEVVTNFDFIRKRKISGDFNMIMDQKIYTCEQPQCPYSETRHGFADRNSRDNHQLSCPYRGAASDYGASNFQVNEVKPVIFPQSFVQPKPTTQSVNLVPSVIDLTGLGVPEDGQKMISDLMSIYDTNFQSNKNLSSSNHVAAENPSLPQPGIRQQQDNFFRSQGITMEGNFYEEANMPNNHHMFAREESQFDRFKALNAPPFESNHNNNFHLMFGSPCDLASFDFKEDMQGGGGMDALQKQADISIWYQ

SEQ ID NO: 3939 - protein, 437 aa, Arabidopsis thaliana
MTESIDLNRSESESDNNTDDVTPIFAIDDSSKGRVSGPTRRSTKGGWTAEEDQILTNVVKKYQGRNWKRIAECLPGSEENRRNDVQCQHRWLKVLDPSLQKGAWKKEEDELLSELVKDYMENDRPPWSKISKELPGRIGKQCRERWHNHLNPTIIKSPWTREEELILVQAQRGNGNKWAEIAKLLPGRTENNIKNHWNCSVKKRLEQFPSNLFSGVVYGSKPSSGFEYNFFNQRNTMVESCITSQIKEAAKSPQRDFLDLTLGLNWRSISSSTSSLRGEESVSSSVDSVCARLNACLETPQNSNNDTVCVKEVREMKERLRMAARTFDTPSIISKTSSPASGLKRLRQKYDTPFPTDARSHMSSEEDHSVSASPSSKYRFVKRNTCSGSKPLERRLDFDFLLWDEHGRRNGIVNFSVRILPQKSDLKSGLVRPFWLR

SEQ ID NO: 3940 - protein, 203 aa, Decaisnea insignis
DVALIIFSTKGKLAQYSSDSGMDRILDRYESYCYAERELAATDAESQGNWSLEYTKLKARVEVLQKNQRHFMGEDLTSMSFKELQNLEQQLDAALKQIRSRRNQLIYESISELQRKEKALQEQNNQLGKKLKEKEKALAQLRHWEDPNQAQNSPSFLLSQTLPSLNIGGPYRPRSSGGEEEQSRPETRPNTLMPPWMLRHVNQ

SEQ ID NO: 3941 - protein, 140 aa, Triticum aestivum
  misc_feature (98)..(98): Xaa can be any naturally occurring amino acid
  misc_feature (110)..(110): Xaa can be any naturally occurring amino acid
  misc_feature (129)..(129): Xaa can be any naturally occurring amino acid
VSVSHGSRMEIAHEARSGIMVRSAPPTPTMWQDSSTDNKRSRGSRAEGRSSGSSADQDPSSPRSKHSATEQRRRTKINDRLDILRDLLPNCDQKRDKXSFLLEVIEYIRXLQEKCQNYDQGFLNKNNVXANCMQWDKVYY

SEQ ID NO: 3942 - protein, 238 aa, Euptelea pleiosperma
MGRGRVQLKRIENKINRQVTFSKRRSGLLKKAHEISVLCDAEVALIVFSTKGKLFEYSTDSGMDMILDRYERYSSAERELVAHDPESQGSWSLEYAKLKAKLEVLQRNQRHFMGENVDSLSSKELQNLEQQLDSALKHIRTRKNHLMYESIAELQRKEKTLQEQNNQLEKKLKEKELTQQAHWEHQSSTSFLLSQTLPTLNIGGTYQVRGSGSEEEVAQPHARTNTLMPPWMLRHVNE

SEQ ID NO: 3943 - protein, 244 aa, Euptelea pleiosperma
MGRGRVQLKRIENKISRQVTFSKRRSGLLKKAHEISVLCEADVAVIVFSTKGKLFEYSTNSGMEGILERYERYYYAEQEVVATDPESLGNWSMEYAKLKAKVDVLQRTQRHFMGEDLDSLSLKELQHLEQQLDTAMKQIRSRKNQLMYESVVELQRKDKVLQEQNSMLEKKIKEMEKSIAQQRHWEQQNQGQNSPSFLLSQTLPSLTIGGTYQARCTGGEEEEARTQSRFNTHMPPWMLRHLNP

SEQ ID NO: 3944 - protein, 209 aa, Nelumbo nucifera
EVAVIVFSTKGKLFEYATDSGMERILERYERYSYAERELIAADSESQGNWSLEYTKLKNKIEILQRNQRHYVGEDLESLSLKELQNLEQQLDTALKQIRTRKNQLIYDSISELQKKEKALQEQNNILTKKLKEKEKEKEKEKALAQQAHWDQQNQGQSSPSFLLSQPLPSLAISGTYQGRSAACDDEEARSHARTNSLMPPWMLRHLNE

SEQ ID NO: 3945 - protein, 360 aa, Medicago truncatula
MGRAPCCEKNNGLKRGPWTQEEDQKLIDYIQKHGYGNWRLLPKNAVAGLQRCGKSCRLRWTNYLRPDIKRGRFSFEEEETIIQLHSILGNKWSSIASRLPGRTDNEIKNYWNTHIRKRLLRMGIDPVTHNPRFDLLDLSSILNSSLYASTSSSQMNIQRLIGTQSIVNPEILKLASSLFSSQNGQENHQIDHKQQISSHMDQEACTMLLNPPFDNNSMSFIQTHLENIYSSFLPEFGFQQHHENVQLNYLHCNGIASSNVTEDFVHQLPCYNYLSSDYHANDLNVDPHISETSTFHCNNNNQNFNFASVLSTPSSSPTQLNSNSANMNESSSTEDETESYVSNNMFEFHISDILGVNEFM

SEQ ID NO: 3946 - protein, 198 aa, Gossypium arboreum
MAPKKDGVSKRVFNKGSWTAEEDRRLAKYIEIHGAKRWKTIAIKSGLNRCGKSCRLRWLNYLRPNIKRGNISDEEEDLIIRLHKLLGNRWSLIAGRLPGRTDNEIKNYWNSHLSKKIINHDVRTEQTSSSEQIVPHKAWETVQMEEEEVVKGSDEIENSEFSIDVDEFFDFTTEGCFSLDWVNKFLELDDQQDPLAMV

SEQ ID NO: 3947 - protein, 212 aa, Oryza sativa Indica Group
MGFPVCCYSELLLPKQLLHLLLLLGYIRRFLLWAFHAVGLGDLLDLGDEQQAVLQDHAREHRAPAQALPPQQQHRRAEFRTVPAMVIEEVLPVVRFDELVAAAPAVCGGGDCAVCLSGIGGGDEVRRLSNCRHVFHRGCLDRWMEHDDQRTCPLCRAPLIPDEMAGALWAAAGVPDTSDFDFSYFGAPLTPMPTPTLLRPHELLLTGLGGYQ

SEQ ID NO: 3948 - protein, 833 aa, Saccharomyces cerevisiae YJM789
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPNLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHSSPSGNGNPANGSNIPLDNAAGINNSNNNISSSNSFFNNGHLLQGKTLRLMNEANLGDKNDVTAILGELEQIKYNQIAISKDLLRINKDNELLWKENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNSNNNAGSPIRPYKQRYLLKNRANSSTSSENPSLTPFDIESNNDRKISEIPFDDGEEEETDFRPFTSRDPNNQTSENTFDPNRFTMLSDDDLKKDSHTNDNKHNESDLFLDNVHRNIDEQDARLQNLENMVHILSPGYPNKSFNNKTSSTNTNSNMESAVNVNSPGFNLQDYLTGESNSPNCVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRAKK

SEQ ID NO: 3949 - protein, 390 aa, Picea sitchensis
MEIEQNLKETELRLGLPGALSPVREHTKCPSSNEESSSSTSSELCLLSPRRPATEKKLFPEDKLESVAASAAEKYPYWHSAPPAPLLQSGYQFPRDVKSGGGAKRGFAEAMESRKVFSGGKWVFPVVTPGSDAEASKAKFLQQQGQLSSPKSSVVQGSASMWQQPQGDQYLSTATGVNNLNGNAKSIVMNDGGCSSSIGKEAAGQSKVAAQERPSQHGSSQNQSSAAVEAPPASKAQVVGWPPIRSFRKNTLAANSKPADDSEGKPGSNALYVKVSMDGAPYLRKVDLKMYNRYQELSSALEKMFSGFTIGQYGSHGIPGRDGLSESKLMDLLHGSEYVLTYEDKDGDWMLVGDVPWEMFVDSCKRLRIMKGSDAIGLAPRAMEKCKSRS

SEQ ID NO: 3950 - protein, 184 aa, Arabidopsis thaliana
  misc_feature (112)..(112): Xaa can be any naturally occurring amino acid
SLPSLRSQHSRFVTSPDENSDVVYSFSGYSHASEIVDCYLNGKSPPKTTINPESSKFWWEDPNLYGDCDDLSELRIIEDRLMRTKKHLMDCLEKKEKSYSVSKSDQNPKNNXESSSDQFRYLVNEDAGFVDCLFETEEEKNRMIVPQETQTQPMFSEEDQSFWENLDVDDVFGLFNDDTNLEVP

SEQ ID NO: 3951 - protein, 152 aa, Physcomitrella patens subsp. patens
LPPGYRFHPTDEELVAYYLKYKINGKQIEMNPIAVVDLYKCEPWDLPVKSGVGGNDQEWYFYSARDKKYPNGARTNRATQRGYWKSTGKDRVVKCAISTGMKKTLVYYTGRAPRGERTDWVMHEYRMEDRVYENLRGPQEPYVLARVFKKSG

SEQ ID NO: 3952 - protein, 234 aa, Arabidopsis thaliana
MKLVQEEYRKGPWTEQEDILLVNFVHLFGDRRWDFVAKVSGLNRTGKSCRLRWVNYLHPGLKRGKMTPQEERLVLELHAKWGNRWSKIARKLPGRTDNEIKNYWRTHMRKKAQEKKRPMSPTSSSSNCCSSSMTTTTTQDTGGSNGKMNQEGEDGYYSMDDIWREIDQSGHVIKPVKDNYYSEQSCYLNFPPLASPTWESSLESIWNMDADESKMSSFAIDQFPLSFEHGSGRL

SEQ ID NO: 3953 - protein, 278 aa, Brassica napus
  misc_feature (268)..(268): Xaa can be any naturally occurring amino acid
MYPSLDDEDFVSDFFCFDQSNGAELDDYTQFGVDLQPDQAGTFPDFGSYGVNLQNEPQQVFSIGDLTSYEPGQFHNFGGPNDCGTVQEDEVVVNSSSSGGAVKQEQEHVDEECSRKRGRTGSCVRPGGTKACRERLRREKLNEKFMDLSSVLEPGRTPKTDKPAILDDAIRVLNQLRDEAHELEETNQKLLEEIKSLKAEKNELREEKQALKAEKEKTEQQLKSMMVPSTGFMPQIPAPFNQNKMAVYPSYGYMPMWHYLPQSVRDTXRDQELRPPAA

SEQ ID NO: 3954 - protein, 226 aa, Nuphar advena
MGRGKIEIKRIENTTNRQVTFCKRRSGLLKKAYELSVLCDAEVSLIIFSSRGRLYEYSNNSVKATIDRYKKACADSSNSGTVSEANAQYYQQEAYKLRQQISKIQQDNRQMLGEGINEMSVRDLKTLEGKLEKSIGKIRSKKNDLLNSEIQYMQKMGDDLQEENMYLRAKISENERAHQQQHISMMAGPSEYELLPTTFQHVNLLEPSHHHYSHQERTALQLGRDF

SEQ ID NO: 3955 - protein, 256 aa, Arabidopsis thaliana; identical to SEQ ID NO: 151

SEQ ID NO: 3956 - protein, 358 aa, Vitis vinifera
MTRRCSHCSTNGHNSRTCPSRGGGAVAGGIGGVKLFGVRLTDGSIIKKSASMGSLSSAHYHSSSSAAASPNPSSPSSDPLRDAIHEPDGYLSDDPGQATCSSNRRGERKKGVPWTEEEHRLFLFGLQRLGKGDWRGISRNYVISRTPTQVASHAQKYFIRQSNATRRKRRSSLFDMVPDMVTDTPPVPEEQFLVPTSQTGETDNASSVPSLNLSLNMEFEPMETISQETVKEAEEAEETVIPRSELPPVVPAFFPGYLPVPFPFWPPNAASAEEEKESESSHQVLKPIPVLPKEPVNVDELVGMSQLSLGEINNGHIDSSPLSLKLLGAPSRQSAFHTNTSVGGSELGKGKNSVVQAV

SEQ ID NO: 3957 - protein, 176 aa, Glycine max
MATEEVNKPQSLPPYPEMIVKALEALNEPNGSNKSAISKYIETTYGELPDATVLGSHLNKMKDSGELSFKQNNYMKADPNAPPKRGRGRPPKPKTPLPPGTVVSPPRPRGRPPKDPNAPPKSPKAKATPGSGRPRGRPKKVPRSPAVAAPTAVSSGRPRGRPPKVKPQLTEVSVES

SEQ ID NO: 3958 - protein, 322 aa, Arabidopsis thaliana
MGGVKRKISIELIEKKDSRAVAFSKRSRGLYSKASDLCLLSDAQIAIIATPVSSKSNVSFYTFGHSSVDNVVAAFLTNQRPREGLGLDYWWEDERLSKSEDLEELRDAMDSMSKMLKDLKDLQNQRDCEEDVKKKGVLHGTHQKQTFNPESCSVNFDGFNKNTEEFDLDEIFDYVSTAEALSMNLDMDDVSVVTTNQNPVSASETVEDRELVVHKNMDEDNIHVSDMDDKDTMLMISDKNNVLPENLDEFDQELDLDQLLDFETNYESLLKSCEMEDYASMVTTKQNLCSNPEAVEDGGLMIQKDLPEDNLCFSDYFSDLHC

SEQ ID NO: 3959 - protein, 216 aa, Gossypium hirsutum
MDFVVQDYDMVDSGSVSESGTDRPVNFSDEYVMLASSYPKRPAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMEKGFYLDEEALFGTQRFWANMAAGMMMSPPRSGHDGGWEEHEVDDYVPLWSYSI

SEQ ID NO: 3960 - protein, 458 aa, Cryptococcus neoformans var. neoformans B-3501A
MAPATSLSVDDKTKVKKAIPTSSSTNKIITATVARIYQAKPGANSWSYSGVEGALVFCVDKAKGGLWFRVVTLSSGRGVIWEHELPIEIEYNQEKPFFHTWQGDEMQFAFVFASEHEAHDFYKKVANRSKYAMKAKEKKEKKEEKSAPTKKRKGKIDKSMISGPSVDSFRHVAHMGFDSEKGFSSTGVDPSWQKLLEQLTQKGFSEKDIKKNEKFIKDFVDQSGGIEKATAPPPAEAPKKPSRPPAPPTSRRKPAPPPPASRSARPSSVAQPSAPSVPPPPPPPPPPGRPAAPPSAPSAPPPPPPPPPPVRSDGTGVAPPPPPPPPPARPPGGAPPPPPPPPTSAPSAPPLPTASGGRSALLASIQGRGVHSLKKVDPSEQKVSALAGGDTAGTGTGTGAAAVGAGAGAVAGGGAAAAVAATTEDTPDLASSLAAALSKRKADIGSDEEDEDSDDEWD

SEQ ID NO: 3961 - protein, 570 aa, Zea mays
MDLHQLLKYRLTGANVYYEFPTENNLANTPWPASPLKSEFSSSSYTPLSSQLECDNLSALSNTPDNQSSTETISAQPISPLEVDSSFKQAAILRENTQVRPDPLYTTSRHNMQHALREIETVLMAPDADDAATSTKHEIEEHKPAQLMRQRSRTWSHESRQPSPGVVRTQLASGYPTASYEFRPEKRLRELREDPQSMVKQLLTKRAEALSEERIEEFLNLVQQARGVVSITGEPIQRLGAYLLEGLVARHANSGTNIYRALKCREPESNELLSYMKILYNICPYLKFGYMAANGAIAEALRNEDRIHIIDFQIAQGTQWITLIQALAARPGGPPHVRITGIDDPVSEYARGEGLDLVGKMLKSMSEEFRIPLEFTPLPGIYATQVTKEMLDIRSGEALAVNFTLQLHHTPDESVDVNNPRDGLLRMVKGLSPKVTTLVEQESHTNTTPFLMRFTETLDYYSAMFESIDTNLPRDNKERINVEQHCLAKDIVNIIACEGKDRVERHELLGKWRSRLTMAGFRPYPLSSYVNSVIRKLLACYSDKYTLEEKDGAMLLGWKNRKLISASAWH

SEQ ID NO: 3962 - protein, 209 aa, Pachysandra terminalis
EVALIVFSTKGKLYEYSTDSCMDQILERYERYCCEERQLGVADTESQGSWTLEYTKLKSKIEVLQKNLRYLMGEDLESLRLKELQNLEQQLNNSLKHVRSRKNQLMHDSISELQKKEKVLQEQNNMLNKQLKEKEKAKTQQAQWEQQNLGPNSPSLQLSQPLPSLNIGGTYQTRSTRNQEEGGRPRHSNRTDALMPPWMLTHMNNNSDD

SEQ ID NO: 3963 - protein, 206 aa, Platanus x acerifolia
EVALIVFSTRGKLFKYSTDSGMERILERYERYSYAERQHVVTDPQSQGSWSLEYTKLKAKIEILQRNQRHYMGEDLGSLRLKELQNLEQQLDSALKQIRTRKNQLIYDSLSEFQRKEKALQEENNLLSKKLKEKEKEKALAQRGHLEQQNHQGQNSPSFLLPQPLPSLNIGGTYQARGSECEEEGPRPHTRTNTPMPPWMLRHVNL

SEQ ID NO: 3964 - protein, 198 aa, Platanus x acerifolia
EVAVIVFSTKGKLFEYSTDSGMDRILERYEKSTFTERQLVATDPVSQGSWSLEYTKLQAKIESLQRRQRHYMGKDLESLSIKELQNTEQQLDIALKQIRTRKNQLMYDSMSELQRKEKALQEQNNLLLKKLEEKEKELGQQGHLEQCNQGQDSPSFLLSRPLTSLNIGGTYQMRGTGCDEGARTNTLIPPWMLSHVTE

SEQ ID NO: 3965 - protein, 427 aa, Oryza sativa Japonica Group
MPSPLKERPAGRLGRLLAALRPARAGPLPVQTGFPTSLADLVVKNHGRLKKPSASASRRKKRGGPEAPPSPSPSPSPSPPPQPSSPPPPPPSPPPAAAVSVSPPTQPRPRPELPPVEAVLRRQPKGRVFGLGLGFVSLVGVVSLALLVIWSKKVVAAVTVASFSLFLLESVRSSALSRRPRRPAANNKLDLDGRGYVSPIREVEPARASFSDSSRRSELSILTIEERSEVGDDSIVAIEERIAAGGDDSSNAKVKTKKRSWRKLIPRKLQKGMKGKEAEDSSGSFRSSEGNRGDATATDSSDSRRGMRTKAADAFVARSMDSSPSFRGNGGDTDADAYSNATRVEIDAPADVLAGDGDAVGGTRSSVALLVVAVVLVGLVAGKLPAVVFTVLCGVFISSVQRLPAGGDGNGDRSFTWWFRIKPKDVN

SEQ ID NO: 3966 - protein, 204 aa, Sinofranchetia chinensis
EVALIIFSNKGKLSEYSTDSRMERILEQYERCTFAAEEFLTIDPESQGSLPLESRKLKARIEVLQKNQRNLMGEGLDSMSVKEIHNLEQQLDASLKQIRSRKNQLIYESISDLQRKEKALQEQNNQLGKNIKEKEKALTQQQTHWEQPNQGQNSPSFLLSQTLPSLNIGGPYQARSSREEYEGAQPQIRPNTLMPPWMLRHVNS

SEQ ID NO: 3967 - protein, 245 aa, Sinofranchetia chinensis
MGRGRVQLKRIENKINRQVTFSKRKTGLLKKAHEISVLCDADVALIVFSTKGKLYEYSTESGMDRILEKYERYSYAERELVATDSESQGNWPLEYTKLKAKIEVLQKNQRHFMGQELNSMSFKELQNLEQQLDTALKQIRSKRNQLMNESISELQKKEKALQEQNNQLGKKLKEKEKTLAQLAHWEHPNQGQNSPSFLLSQTLPSLNIGGPSQTRGSGCEEERTRRPETRPNTLLPPWMLRHINQ

SEQ ID NO: 3968 - protein, 1196 aa, Oryza sativa Indica Group
MSSQSVVAVKQITAPDKIVETCPSTKHSAHKLFDVKPDFQGLIDDNLSSSSQSSSIKIELIRSSSLPNILPFQKRSSEPEPESPLSHVSHPNVSEPVYSNSSTFCASLFSSSSMETEPCRQLGTLPFLPHPPKCEQQVSAGHSSSSSLLVPGGDGDIGNAHDEPEQSDDLKDFLNLSGGDASDGSFHGENNAMAFAEQMEFQFLSEQLGIAITDNEESPRLDDIYGTPPQLSSLPVSSCSNQSVQKAGSPVKVQLSSPRSSSGSATTNKARLRWTLELHERFVEAVNKLDGPEKATPKGVLKLMKVEGLTIYHVKSHLQKYRLAKYLPETKEDKKASSEDKKSQSGSSGNDSVKKKNLQVAEALRMQMEVQKQLHEQLEVQRQLQLRIEEHARYLQRILEEQHKVSISSNSLSLKPPAESQPESPKPTSEKKEAESEAGAATSAQPSSEDKSPDAECKSSPPVCTTQDTQRRRLAKEKHGKTVDKETQKVSCNYCGKVVRTYNRLEHHLAGIRGNVYPCSLVPDSVRQSIKSSLEARKKDWIARKIGKHKSSELPPVRNLSLTSAHACRPLLQPITSGTDREGSVSGHRCFVHFTNNLVQPGETTQVNAHDVSCNASSSQKGGQTIEVTRPPYQNPCMMNKPPEISSGQRIDPLSFSMENSSSQMQDSESSKEPTNDYLNSQARKSIGKLIFEAGLEPGILHLPSFKDMVDVLAWAQVSIPTYESIMEEQLREIQCHARDLKKHWEMNGCSVILDTWESRCGKSFISVLVHCSKGMLFIKSMDVSDIIDDVDELAVMLFRVVEEVGVLNIVQVITNDESPYMQAAEHAVLKRYGYSFFFTLCADHCINLLLENIAALDHVNEVLIKAREITRFIYSHAVPMELKGKYIQGGEILSSSNLKFVAMFITLGKLVSERINLVEMFSSPEWASSDLASRSSFRHVYEVVKTDNAFWSAAADILKLTDPLITVLYKLEADNCPIGILYDAMDCAKEDIKCNLRDKHGDYWPMVDEIWDHYLHTPVHAAGYILNPRIFYTERFSYDTEIKSGTNACVTRLAKNHYDPKKVAIQMDRYRRKSAPFDSDSAIQQTMEIPQVRWWSAHGTDTPELQTFAIRILSQTCFGASIYNIDRSISEQLHVVKRTYPEQERFRTMEYVHYNLRLAHCEPCVRGASGAQQHSRLTSQLGDWISSGQTTSYYK

SEQ ID NO: 3969 - protein, 440 aa, Hordeum vulgare subsp. vulgare
MVLDLNVESPADSGTSSSSVLNSADAAGAFRFGLLGSPDDDDCSGELAPAAASGFVTRQLFPAPPPAPGVMMGQAPAPPPTAPVWQPRRAEELVVAQRVAPKKKTRRGPRSRSSQYRGVTFYRRTGRWESHIWDCGKQVYLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGRDAVTNFDSSSYNGDATPDVENEAIVDADALDLDLRMSQPTAHDPKRDNIIAGLQLTFDSPESSTTMVSSQPMSSSSQWPVHQHGTAVPPQQHQRLYPSACHGFYPNVQVQVQERPLEPRPPEPSSFPGWGWHAQAVPPGSSHSPLLYAAASSGFSTAAGANPAPPAVVPRPSPPLLLPRPPDN

SEQ ID NO: 3970 - protein, 134 aa, Brassica napus
  misc_feature (12)..(12): Xaa can be any naturally occurring amino acid
  misc_feature (127)..(127): Xaa can be any naturally occurring amino acid
  misc_feature (130)..(130): Xaa can be any naturally occurring amino acid
MDPYKNPNPKGXQRQRPFGSAGEGGSSGGSDMPHDIDDNKKKKKLLHRDIERQRRQEMATLYASLRSHLPLQYIKGKRAVADHVNAAVGFIKDTETRIKELSARRDELSREQTCQRSDPNLARTGFXLGXSSPP

SEQ ID NO: 3971 - protein, 639 aa, Catharanthus roseus
MADGHLFNNITLGGRGGTNPGQLRVHSGGILWKKQGGAKAVEVDKSDMVGLTWMKVPRSNQLGVRIKDGLFYKFTGFRDQDVASLTSYLQSTCGITPEEKQLSVSGKNWGEVDLNGNMLTFLVGSKQAFEVSLADVAQTQLQGKNDVMLEFMWMILLEQMRKNSLMEISFHVPNSNTQFVGDENRPPAQVFRDKIMSMADVGAGGEDAVVTFEGIAILTPRGRYNVELHLSFLRLQGQANDFKIQYSSVVRLFLLPKSNQPHTFVVVTLDPPIRKGQTLYPHIVLQFETDYVVDSSLSISEDLLSTKYKDKLEPTYKGLIHEVFTMILRGLSGAKVTRPGKFRSCQDGYAVKSSLKAEDGVLYPLEKSFFFLPKPPTLILHEEIDYVEFERHAAGGSNMHYFDLLIRLKTEQEHLFRNIQRNEYHNLFDFISSKGLKIMNLGADKAADAITAVLQEDDDDAVDPHLERIKNEAGGDESDEEDEDFVADIDDEGSPTDDSGEGESDGSDSGNEEIPTKKKPKKEASAPKVPLSRKKVGDDDNMKKKKQKKKKDPNAPKSISAFMFFSQTERENVKKDNPGIAFTDVGKVLGDRCNKCQLRKKHLLKQRLVADKKRYTDEISNYKNPQPMNVDSGNDSDSA

SEQ ID NO: 3972 - protein, 455 aa, Vitis vinifera
MMQFTETPPPPLHQITSFSNLPMNNNQIHRTRPWPGFPTSKALGSFGDANCMEQLLVHCANAIESNDATLAQQILWVLNNIAPPDGDSNQRLTCGFLRALIARAANSGTCKMFTAMANAHANLAINTHKFSVIELASFVDLTPWHRFGFAAANAAILEVVEGYSVIHIVDLSLTHCMQIPTLIDALANRPEGPPLVKLTVAGATEDVPPMLDLSYEELGSKLVNFARSRNVMLEFRVIPSTSSDGFSSLIDQLRVQHLVYAESGEALIVNCHMMLHYIPEETLSAIHSTNSSSYSVESSSPSYHRTMFLKALRTLNPTIVILVDEDADFTSNNLVCRLRSAFNYLWIPYDTMDTFLPRGSKQRQWYEADICWKIENVIAHEGPQRVERLEPKGRWVQRMRNANFRSIMFSEDTVSEVKHMLDEHAAGWGLKKEEEDLVLTWKGHNVVFATAWVPA

SEQ ID NO: 3973 - protein, 239 aa, Physcomitrella patens subsp. patens
MAKSKAAKKSLDSYTVKGTNKVVKVGDTVLMRGQDPEKPPYVAKIEKIEADGRNNSNVKVRCRWYYRPEESMGGRRQFHGTKELFLSDHYDIQSADTIEGKCTVHTFKNYTKLESVGAEDYFCRFEYKASTGGFTPDRVAVYCKCEMPYNPDDLMVQCEICKDWFHPSCMSMTPDQVKKMEKFFCPDCISQSGEKKVRQSSPRSSPATDHVKVYILCIILMLLALPYGPSLLALFSVFC

SEQ ID NO: 3974 - protein, 368 aa, Oryza sativa Japonica Group
MRGPLLLRAVVVVAMEHFNDWDLQAVVRSCSFPQSEPPRVGVGVPAAPGAGGAPVVVAPPARAPDGPDQMARASASALYDLEYLDLDHKPFLLPGSSSSSSSSRAVARARGEDDGKGRHEVMISFPAAAAASTSGAQPRSPSGRKPGIRTPRPKRRKFSAYFEVIDYCDFHGVRSSKKSQLKKVVYEVPVADGGVSSDLWAWRKYGQKPIKGSPYPRGYYKCSSMKGCMARKMVERSPAKPGMLVVTYMAEHCHPVPTQLNALAGTTRHKSAPTGDDDKPTSPGPAAGRAAAGEGVVKCEDVDGNELSAMAADGGAEDTAAAADDDGELWPEGMGLELDEFLGPMDDDVFEFDHVLEDDGVLGRRLSL

SEQ ID NO: 3975 - protein, 105 aa, Arabidopsis thaliana
MDNTDRRRRRKQHKIALHDSEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 3976 - protein, 542 aa, Ashbya gossypii ATCC 10895
MSTDFDRIYYNQSKVSGRFRLGEGGLGWKASATGGSAAMQNNEPILLTADELASVQWSRGCRGYELKINTKNKGVVQLDGFSQEDFTLLKNDLQRRFNVQLEHKDHSLRGWNWGTTDLTRNELIFSLNGKPTFEIPYSHISNTNLTSKNEVALEFDLQKDGYNPAGDELVEMRLYVPGVVTQEDRHSSPAEDADVDMEKDNKEEKSIAEAFYEELRAKAEIGEVSGDAIISFQDVFFTTPRGRYDIDIYKNSIRLRGKTYEYKLQHRQIQRIFSLPKADDIHHLMVLSIEPPLRQGQTTYPYLVLQFQKDEETEVQLNVEDDEFERLYKDKLKKQYDAKTHVVLSHVLKGLTDTRVVVPGEYKSKHEQCAVSCSFKANEGHLYPLDNAFMFLTKPTLYIPFQDVSSVNISRAGQATTSSRTFDLEVVLRSNRGSTTFANISKEEQQILESFLKSKNVRVKNEEKETQQRLQTALGSDSEDEDVNMGSAAEDDESVDEDFQAESEDDDVAEEFDSDAGVSESETEAADGADTEDRPSKKAKLA

SEQ ID NO: 3977 - protein, 329 aa, Arabidopsis thaliana
MSTIDESVIRSNGSESTKHATKCFLKILSMATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 3978 - protein, 591 aa, Solanum dulcamara
MGTPKEEATDEVFSENLEQKPDPDPATSKSELKETTSKSISGELQKRLSQCDKGINMSQSNQEAISLSRVQENQSENVQKQLGLKSEADASGSSQLSSLPKDSDAKSRGSESSVKDKVVSVLSGMASDSSDQMQTSNMEVFVSQSDQQRVSYQIKREKALDKLQPRRNPDTSVHGLTSDQGMTLSKAPEKPSEDGYNWRKYGQKLVKGNEFTRSYYKCTYPNCLAKKQVERSHDGHITDIHYIGKHEHPETLSVPQMSPELVLPLQMIQQDIPIITALEAEGEKSTTPRETCEPSKPSEVPLALDVVSACGGVKVTPLKQHKLENEVDKDDVPDSKRQKKDIVATDYTPPVKSHSEPRHIVQTMSEVDIINDGQRWPKYGQKIVKGNPNPRSYYRCSVAGCPVKKHVERASHDPKLVITTYEGHHVHDFPTSKAIGQISAAPDTGTAGVREDSRIESGESKHVVESKSESGENKHIREPKTEAGGNKRVGESIPESGENKHIREPKTEAGENKHIGESRIESGGNKHVEKSKLELGGNKHVGESIPKPGGNKHVGESIPESGGNKHVGESIPESGENKHVGLDMAVHIGAN

SEQ ID NO: 3979 - protein, 311 aa, Vitis aestivalis
MAMDSSNWMAASLDLNANPLRLFDDTPKKEVQDDFTGLGLKVVSLKEEETGVLVEKLNQVNAENRKLTEMLTVMCENYNALRSHVMEYISKNPERESPSSRKRKAESSNNNSNNNGVVGNSESSSSDEDSFKKPREETIKAKISRVYTRTDASDTSLVVKDGYQWRKYGQKVTRDNPSPRAYFKCSFAPSCPVKKKVQRSVEDQSILVATYEGEHNHPHHGRIEPTSGANRSVNLGSVPCASSLSSSGPAITLDLTKPKSNSDAKASKSPELHHFLVEQMASSLTKDPSFKAALAAAISGRILHHNQTEKW

SEQ ID NO: 3980 - protein, 297 aa, Glycine max
MEDKDRAASSDPTADAEFAGDTSWTLAADDSDGAYLFPGDRERSILREFVWNLEPDQPNRIGTDDGLWKPVQSSLTDSIEPVAAAPSRSNNQSISSSSSEDPPEKSTVSDDKPPEIPSKGKNKGQKRIRQPRFAFMTKSEVDHLEDGYRWRKYGQKAVKNSPFPRSYYRCTNSKCTVKKRVERSSEDPTIVITTYEGQHCHHTVGFPRGGIISHEAAFASQLAPTMSQFYYPIQLPRDNNNNNNSFSSISQPCQAYDDAEGGLSAMMPLPADVSSQSQPSTDEGLLGDIVPPGMRIR

SEQ ID NO: 3981 - protein, 539 aa, Schizosaccharomyces pombe 972h-
MPSSNGSSDFVRKLFNMLEEPEYRHILRWSDSGDSFIVLDTNEFTKTILPRHFKHSNFASFVRQLNKYDFHKVRHEEGAPSIYGEGAWEFRHDDFQLHHKDLLDNIKRKAPSKRNLANENTAPVIENLKQQVDSILDFQKLLDRNLSGLATSYQTILLKMFELKRGIESRDLLMSSIISYLCDLEGSTQRQANPGAMFVPSHPLQELLNAYQALAKGQVATTSPQQIPNQIQQASAATTASSKMTVDTNLGTAQPSLYNTPSSDYELANQEKPADSMASAASLNTPLSSNDHSLNPHAHGSYPMYEKFQPIQHPNPGSFTTHLDSNASMAKSFSQISNDSLAKASSVATSMSQMGAAVPTTGLWKRQPRILLVEDDELSRRMTIKFLTSFDCQVDVAVDGIGAVNKANAGGFDLILMDFILPNLDGLSVTCLIRQYDHNTPILAITSNISMNDAVTYFNHGVTDLLVKPFTKLTLLQLLKKQLLNLLQADNSINMSDVPSTKEAKDDKAPVTFYLENDAPMYPQQMLQDPIQADLQHPH

SEQ ID NO: 3982 - protein, 124 aa, Pinus strobus
EIEVHEVDPRAEDRELKDQLLRKYSGYFNSLKQEFLKKKKKGKLPKEARQKLLEWWNVHYKWPYPSETDKVSLAESIGLDQKQINNWFINQRKRHWKPSEDIQFVIMDSLNPHGASFYMDGAEC

SEQ ID NO: 3983 - protein, 328 aa, Zea mays
AYQAIPPHGFFPPTVAANPQAHSYMWGAQPMVPPYGTPPPPYVMYPPGAVYAHPSTPPTMHPFSHYPMPTNGHAETPGTAPSAPEMNGKSEPGRTSAPSANGITSHSESGSESESEGSDANYENDSHSKDNDGKEDGNSQNSISYSASQGVLNQTMAMLPIQPGAMVGGVSSSTANLNIGVDYWAAPGSAAVPAAHGKAPAGSARGDQWEKYILLTTDCDERELKKQKRKQSNRESARRSRLRKQAECEELGQRAEALRSENSSLRAELERIRKEYEQLLSQNASLKEKLGAASSDSLPDMNEQNDGDGDGGYRKQPDSDGHQPGSES

SEQ ID NO: 3984 - protein, 175 aa, Oryza sativa Japonica Group
DNGSEGGNSSEDEQEAGGGDMASAGLPEITSPCAEDKELKSHLLNKYSGYLSSLWRELSKKKKKGKLPRDARQKLLHWWQLHYRWPYPSELEKAALAESTGLDAKQINNWFINQRKRHWKPTPPAMEYRSLQPAGAASYGGASAGASTSGGGSAVVRGMEGQHFTGGGAYPRGDP

SEQ ID NO: 3985 - protein, 495 aa, Triticum aestivum
  misc_feature (463)..(463): Xaa can be any naturally occurring amino acid
MGAMAEEAEHEGCVENRQPLAASSESVSEGSSYGGAGGPARMSPPVSGSVNSISGLRRTSGPIRRAKGGWTSQEDETLRKAVETFNGRSWKKIAEFFPDRTEVQCLHRWQKVLNPELIKGPWTQEEDDKIIDLVKKYGPTKWSVIARSLPGRIGKQCRERWHNHLNPDIRKDAWTAEEEQALINAHREYGNKWAEIAKVLPGRTDNSIKNHWNSSLRKKLDVYGTRNILAIPRLVGHDDFKDKQKPVASEGHLDLNTVPGITSKNLPEIAHHSNFSSHLQSYKLDHAKAGSGFLSISFLPTVQPLTSSEVSSVVNGSAVTLAAQGLESDSVRDKALEIVSVHEKGLKVDSTLDTLREPGSTQLEAVPAKGEESSLKNDAQSSLGPLCYQIPNMNDVAPASSSLFSEHQTVHQTSEHCRNGALSPNGCTTPTKGTMSVQLSVDSILKIAADSFPVTPSILRRRXRERPTPASDLKFGEPNTDSFYTPAGKRPTTDT

SEQ ID NO: 3986 - protein, 352 aa, Arabidopsis thaliana
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 3987 - protein, 427 aa, Glycine max
MTNEMKEASALGARTARACESCLKVRARWYCAADDAFLCHGCDNMVHSANQLASRHERVKLQTASSKVNYSVTPKVAWHSGFTRKARTPRHNNNRHSSLKQQQQKKPLHEERGEEEVFFNNTISLLPLVPELGSEEPLLNDETEEQLLCRVPVFDAELCSIYNEVKDEVVAAGEEALDLENFSSEFLPSDTDLAEFTADVKSFLGNGADEDSPDDDEHVKESELLILDCKEEEGDEEMDECIDGVLIGAKDAMVKVKDEEELDADDDTACHLDSILDMNGEAFNWNIVESESPAQAQEDEVSKVGTKKDIFLRLNYEEVITAWASQGSPWTNGTPPKFFNSDDCWLDFLGSNGGNVQCCYGAVGSLRVHADGGREARVSRYREKRRTRLFAKKIRYEVRKLNAEKRPRMKGRFVKRTPFVGATALPA

SEQ ID NO: 3988 - protein, 278 aa, Vitis aestivalis
MGEEASSLQLIHHLLLSDFDSMETFVSHVSHSLRSSASDSSVSTDDIIQVSEYPKLHEDESNAFLFDYSTSSPSAVFQFQTESPKPSRLSHRRPPVSISLPPPPISHTSSSLDSGERRHYRGVRRRPWGKFAAEIRDPNRRGSRVWLGTFETAIEAARAYDRAAFKMRGSKAVLNFPLEAGNWSDSDPPATSIRKRERESESEEREQPEIKVLKQEEASPDSDSPVVAEAANVLEASPLTPSSWRTVWEERDMDGAFHMPPLTPLSPHPWIGYSRLIS

SEQ ID NO: 3989 - protein, 198 aa, Oryza sativa Indica Group
MEQADESSVNKESSEQQQQQQLTSEQDDDGATWLSLTLATQGSPEEATAEAEETEAANCSESEAPKPSSAPHKVFSCNFCMRKFFSSQALGGHQNAHKRERSAAKRSYHAQRMMMGLPLEAHAAFVHSLRVNQSSVIQKASQQAQIRTAPRFHEGSISWPPIAYEEVPNSTWPGSFRLRSQPSDQPSEQSKIDLNLRL

SEQ ID NO: 3990 - protein, 341 aa, Vitis aestivalis
MATAVEVSALQLIRQHLLGELSPKNIVVTDLTVGEEWSNGLNSEVSTSQSDSSFCFQAASCDSPVTISELFGSTDLSADFFGFVPSSTSEQSQSNFFEFETKPQIIDLTSPKGLNSSHFFEFETKPQIKDTTKTKSLDSSSQSTGKDRKPSLKISVPRPTKEIEWLEFAEPKQAATVEPAQNISHPEEKKHYRGVRQRPWGKFAAEIRDPKRRGSRVWLGTYETAIEAAKAYDRAAFQMRGSKAILNFPLEAGKSAETSTDYGRKRCREAEPEVTEMEANPPAKKEKLPEANTITRVQNDTPLTPSFWDFDLDSVGCLINVPPISPLSPHPKFGFPQLMVI

SEQ ID NO: 3991 - protein, 328 aa, Brassica napus
METIGGFHKEDDEQMDLPPGFRFHPTDEEIITHYLHKKVLDKDFSAKAIGEVDLNKAEPRELPYKAKTGEKEWYFFCARDRKYPTGLRTNRATQAGYWKATGKDKEIFRGKSLVGMKKTLVFYKGRAPKGLKTNWVMHEYRLDGKLSAHNLPNTAKNEWVICRVFQKSAGGKKIPLSALIRIGSYGGDFSPSLMPSLTDASPFTDKTKTEPVYVPCFSNQTDQAQGNPLNCFSSPDIFHRIPLYQTQSLQVSGNLQSPILGQEHSVLHAMIDNNRRQSLKGMSVSQETAVSTHMHTDISSDFEYGKRRAQEDPSSSAGPVDLDPFWNY

SEQ ID NO: 3992 - protein, 251 aa, Helianthus annuus
MGRGKVQLRRIENKINRQVTFSKRRGGLLKKAHEISVLCDAEVALIVFSNKGKLFEFSTDSCMESILERYERYCYSERQLVATDATPRSWTLEYNKLKSRAELLQRNHRHYMGEDIESLSLKEIQNLEQQLDTGLKNIRARKNQLLHESINELQKKGKAIQEQNTTLTKQLKEKEKDKTIPQNTQWEQHNYVDHDTTFFLPQPHPALNIGGDYNQATTSAASGGEGADGRTSQLDLSLQPIYSHHLRCFPS

SEQ ID NO: 3993 - protein, 343 aa, Oryza sativa Japonica Group
MEQHQGQAGMDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 3994 - protein, 1103 aa, Physcomitrella patens subsp. patens
MKWTPVSNDNFYVKEGWTVIRGQSFVSFIPFSSLAQQESPGSAWTVWLKLISNMEMEVLLEVSALRLQVERRSPTSELWHACAGPLVSLPPIGSRVVYFPQGHTEQVAASTQREAETHIPNYPSLPSRLVCLLDNVTLHVSDRYSMSLIDVVIQADLETDEVYAQMTLIPVPPANEKEALMSPDIGIRSRQPTDYFCKTLTASDTSTHGGFSIPRRAAEKVFPPLDYSQTPPAQELKARDLHDQEWHFRHIYRGQPRRHLLTTGWSVFVSAKRLQAGDAVLFIRDDKGQLQLGIRRQNRQQTVMPSSVLSSDSMHIGVLAAANHAAATSSRFTIFYNPRQSPSEFVIPVAKYQKAICNLQVSVGMRFRMVFETEESSVRRYMGTITGMGDLDPIRWPNSHWRSLKVGWDESTAGERQRRVSLWEIEPLTTPFLLCPPPLTFRAKRPWGGRVDEEMDSMLKKASFWSGDSGSHMDALGALNLRNFGMSSWMRTPQQRVEPGLPAQQNEYYRAFAAAALQEIRCSDASKHAMSHAQPSLSTSQIEFRSQSPQSNQHTAQHIPNTAGPVLQLSSSRPESPLDVGMNMAQCSGYSESDTHMTSSAYTPGSYPLHSMLGRTHLGCENGQMTYMMRPTQSAQQSQPESIIHGGSVREPQFSSSWYPSNRDTSEHDVSARMNQLDTSPTSRVSSCFPFPQESQVNGQSGLTGLPVPTSSFVYRENGQEQDSVQSDRHLLFGVSIEQPLVGSNSVTSLQPHAFAKSKDPQSRFSGNTVLQGSYYPSGNADIPTMNGVGLDENGIFMRNASWSAMAPTSRTFTKVHKLGSVGRSIDVQKFQNYSELRVELARLFNLEGLLDDPQRSGWQLVFVDNENDTLLVGDDPWEEFVNCVRSIKILSPNEILQMSQEQLEILNSVPMQQRPTCSNSEDARTQTSPVLACGLLLKHVIRENEIEKLLLKLACPILFCKATPLSQVLIAADSVARRSFGLAANLKRSLHESWAMVISLKPGVHIGSLPKYYVWESYSISELVHRVVDLHPFWSVAERLSGTRSSDYETVVPMSTGLVKLTVQIAPGACAQSVVVQELAAPKRHTQYLTAGLLFQTQRVVV

SEQ ID NO: 3995 - protein, 326 aa, Oryza sativa Indica Group
MTLPPGFRFHPTDDELVGYYLKRKVDSLKIELEVIPVIDLYKFEPWELPEKSFLPKRDLEWFFFCPRDRKYPNGSRTNRATSTGYWKATGKDRKIACAGEVFGLRKTLVFYKGRAPGGERTDWVMHEYRLCQDLAHGVSNFIGAYALCRVIKRHEAGLHGEPPAAKAKGMISKVSSSSSLVTVEHQLSSRGNASPSFTPTNNGSPLVDEMFVGGGGGDPFQLLPSCVPYHGGDACGFDLPPLCMPQTQDPFFSDPGFTQAAPPLYGDVMGSVSEHELKWDTLGGYSGGGGGELWNAAAAPLLCRQASDGDDLTAWFTAADDNMSVF

SEQ ID NO: 3996 - protein, 305 aa, Aspergillus nidulans FGSC A4
MTEPRRRWTAAEDALLWDLYQVQEKAPTGKCQKINWNEIARHIPGRTNKDCRKRYYNRFTGGLRKGSWTQEEDERLFRLVERYQYRWATIAQKMETRNADQCSKRWHHCLNPELERSPWTVDENMLLLSAVNTHGSSWKDIQKCHFPTRSANNIKNQYTILSRKNISLAPAHLHPCCDSPSPSKSSRRPPSTPTSTPQVPGSRQGSSYDPYDYGSLSSTPQLSATDYLPATPEAPAVNFDMAMGAFGDSCGYMPQYQPSPSFYANSPDGSELMMPETMGMRMRYDFRDGLEQEGVRYPGQETFGY

SEQ ID NO: 3997 - protein, 302 aa, Apium graveolens
MAAVEDPIVPMEGVEEEVPVTVTEAPEEAAPPAEDPAPKKGKELKPKKAAAPRKPRSAPAHPPYLEMITDAITSLKERTGSSQQAIQKFLEAKHKDLPAVFRKMLSNNLKKLVAAGKLVKVKASYKLPSAKSSAPAKKKPAAAPAKKKAAAAPAKKKTAAAPKKKAAAAPKKKAPVAKAKPAAKPKAKAVVKPKAKAAVKPKAKPAAKPAAKAKPAAKAKPAAKPKAKAKPAKVARTSTRTTPGKKAPAKPAAAPVKKATPVKKATATPVKKAAPVKKAAPAKGKSVKTPVKRTSARKAGKK

SEQ ID NO: 3998 - protein, 249 aa, Oryza sativa Japonica Group
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 3999 - protein, 242 aa, Zea mays
MVTVREETRKGPWTEQEDLQLVCTVRLFGERRWDFIAKVSGLNRTGKSCRLRWVNYLHPGLKRGRMSPHEERLILELHARWGNRWSRIARRLPGRTDNEIKNYWRTHMRKKAQERKRNMSPSSSSSSLTYQSGYPDTPSTIGVEGQELHGGSGCITSILKGTPPDMDGYPMDQIWMEIEAPQMPSEESFVGGNHNVCSSLATPLPPPTVWEYYPDACWKVDDEIKMATQFQFGYSEGVGPCF

SEQ ID NO: 4000 - protein, 706 aa, Debaryomyces hansenii CBS767
MSKRQETPIKKNAFVHKLYSMLNDPELTNLIWWTRDEDSNTFALSPGKDFANALTRYFKHGNVASFVRQLHMYGFHKVSDPSHTNVTATSTNAELPVWEFKHSSGKFKKNDESSLVYIKRRSSSNNSRNVYNNENDANVVIPTSTPSPEHAQFIQEGGHPYLPQGYYFYNGHQVTHHMSPHMQFPSGGVPPQLHQSKHPQMYYTQKPMPSSIPHAYSQENTLKKPKMPDIQRSISPQSQPGSQHQAPQVPKPHPVTHIPQPPISQAQLQPPLQDATKPSHPQPDAHDSQRPQHYTPNLQFRKIWENDNLHSRPRNPSLLFDPLAPVPVTSQLQPLQQSQNAEQQSQSSFSYLLSRSDSRSSYASARESFTSTRDSFVSNRDSIASGRESLASAKDSISSTKDSFSSARDSFGNSRDSFTLLKDPDNRLSIKLPPPSSIHNPSFYPNNSNSPFSMASDTNSNASTVTSSNLPKAPSNEFPSSSTSMSTIKTKSNSIPETSTTAKRPSIFPSHSVHEKLRPSLIELHFGSSSKASILNPQHDSIGSQSSHNSVFSNNSSLSSTSSFHRTSSFGSISHHPIFANKNSISIAPHEVLPVTLLSRSIAEQEVYSDSKDSTPPLKTPKVLQMNSPIKRSSTTAIPTTNGVPVALKIRSLNSSPLSRLLTNEDLIAVDATNLKSSNTKVSIHSLLDDGQGEEKILLPSKSSRS

SEQ ID NO: 4001 - protein, 299 aa, Oryza sativa
MTTTTTAEGGGGVAPFVAKTYRMVDDPATDGVIAWGRDSNSFVVADPFAFSQTLLPAHFKHSNFSSFVRQLNTYGFRKVDPDRWEFAHVSFLRGQTHLLRRIVRRSSGGGGAKRKEEAGGCGGGGEAAAGDVDEESAVVAMEVARLRREQREIEGRVAAMWRRVQETERRPKQMLAFLVKVVGDPQVLRRLVDRDNTNAAASNADDSAVHHQVKRPRLLLDSSSTTTTHGDRHLVTAAADGFYAGGCGPEAAAAAAFVPDDAVDFTGLYTGGDGFGNAVVDAGVDYPPAYAFPVVDSGY

SEQ ID NO: 4002 - protein, 366 aa, Primula vulgaris
MGYMCDFCGEQRSMVYCRSDSACLCLSCDRNVHSANALSKRHFRTLLCEKCNSQPTFVRCVEEKTSFCQNCDWLGHNVSEEASTHKKQAVNCYSGCPSSAELSMIWSFVLNGENDSNCEKRMSSMNISETQDECTVFDDVKKGDKSKTQMYSKTQMGNSTLSTMHCPGTKAPDICENDDFYKDFDIDEIDLTIENYEELFGVAFNDPQQLFGANGIGSMFRSKDMSTSDLNRQASSGQQGNTAQPTCSNGASADSSMSAKTEPIVCYSRQSNLSFSGVTGESSAGDFHEIGMGEPPPWGSPCSFPSTSRSSAVLRYKEKKKIRKFDKKVRYASRKARADVRRRVKGRFVKAGDVYDYDPLGRTRSY

SEQ ID NO: 4003 - protein, 230 aa, Trochodendron aralioides
KINRQVTFSKRRSGLLKKAHEISVLCDAEVALIVFSTKGKLFEYSTDSSMEMILERYERYSYAERELVATDPESQGNWSLEYTKLKARIDLLQRNQSHFLGEELSSLSLKELQNLEQQLDNSLKHIRSRKNQLMYESISELQKKEKALQQQNNSLAEKLKETKALAQQAHWEQQNQVQNSPSFLLSQSLPSLNIGGTYQARGSGGEEDGPRPQNRTNTLIPPWMLRHMNE

SEQ ID NO: 4004 - protein, 143 aa, Zea mays
MAPRTSERAMTSAAAGLARGAGPHYRGVRKRPWGRYAAEIRDPAKKSRVWLGTFDTPEDAARAYDAAAREYRGAKAKTNFSFPSCLPLAAADVGGACRSGNSSSTTTTVDSFGGDVQATLIFRVKLRTCGLNGSKLTLYGLYS

SEQ ID NO: 4005 - protein, 243 aa, Trochodendron aralioides
MGRGRVQLKRIENKINRQVTFSKRRSGLLKKAHEISVLCDAEVALIVFSTKGKLFEYSTDSSMERILERYERYSYAERELVAIDAESQGSWSLEYTKLKARFEVLQRNQRHFLGEDLGSLSLRELQNFEQQLDSALKLIRSRKSQLMYESISELQRKEKALQQQNNLLAEKLKEKKALAQQAHWEQGNQVQNPSTFLLPQSLPSLNISGTYQARGTGGEDEGSQPHNRTNTLMPPWMLRHMNE

SEQ ID NO: 4006 - protein, 285 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGEGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 4007 - protein, 182 aa, Vitis vinifera
MATEEPNNPPQPPSSIPQYSEMIMAAIEALNDKGGSNKSSISKYIESTYGDLPAAHSTLLAHHLNKMKQSGDLVMVKNNYMKPDPNAPPRRGRGRPPKPKVPLPPGTVLAPPRPRGRPPKPRDPFAPVSPPKKASSGSGKPRGRPPKKPKVGTSSAPAPATGAPRPRGRPPKVKPAVVPVGC

SEQ ID NO: 4008 - protein, 273 aa, Zea mays
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLDSSLKHIRSRKSHLMAESISELQKKERSLQEENKALQKELAERQKAVASRQQQQQQQVQWDQQTHAQAQTSSSSSSFMMRQDQQGLPPPHNICFPPLTMGDRGEELAAAAAAQQQQPLPGQAQPQLRIAGLPPWMLSHLNA

SEQ ID NO: 4009 - protein, 463 aa, Oryza sativa Indica Group
MARFQETKARNDQGPVADHVGHQNLMENLTDPLDSSGMDMMDEARIPKARKPYTITKQREKWTEDEHKLFLEALQLHGRAWRRIQEHIGTKTAVQIRSHAQKFFSKVIKESSGDNCNSLGAAPSIQIPPPRPKRKPVHPYPRKLGSTASKNVPALKQLEKPQLQVQSLYDQDNGSPTSVLTVPQIRADTLGSESGGSPTSTIDIEERCPTPSIATAELAVELPPTNDEEVKGNGDHEEVTCDRSGVPVLRLFGKRVMVNDLHQMSAPDAGNLQTVADMEVDASAETPTSGTGKFSSHGAAEANTWNPWLTNTQQFLYYLPNGQIFSVHSALPCFTYHNEGVTCTQFSNPQVVASDQQHQHQTSEAVDYKGIQREGSWTESNTSSSSVPETATHNSETTESYRNGNRNEDEMVPSPDSRKCVSPGSNCRRGFVPYKRCVVDSEALLKSQAPQEEADGEMTRLCL

SEQ ID NO: 4010 - protein, 312 aa, Solanum tuberosum
MESYKDIKMEDHHPMYFIDNNNFGVTNHSLISDYNINTSSLGFMELLGFHQDFYSSASVFELPKEENYCPAVCVSEEEEVKPSSVAPESQIISSATVATGNVLNTPSTPNCSSISSEGHGDADGEVENHEQQNTKTKQQLKAKKTVSQKKQKEPRFAFMTKSEVDFLEDGYRWRKYGQKAVKNSPFPRNYYRCTNATCNVKKRVERCFSDPSIVVTTYEGKHTHPSPMNMMMSRPNCYPINPLLPSPGAFTLPMQFNINQSFNYLAMNNQLDHAAFVAQGRRFCSNTEMLGDHGIDLQDLMPSAVLKHEYNR

SEQ ID NO: 4011 - protein, 220 aa, Oryza sativa Japonica Group
MTAALQALLDPTALSLGLPTPAINKEEYLAICLAALACTRAGKALVGVGGQQQVQACNKWLCPAPAAPEELRFRCTVCGKAFASYQALGGHKSSHRKPPFPGDHYGAAAAAQQLASAGDSKEDSASSAAGSTGPHRCTICRRSFATGQALGGHKRCHYWDGTSVSVSVSASASAASSAVRNFDLNLMPLPESTAAAGIKRWAEEEEVQSPLPVKKLRMSN

SEQ ID NO: 4012 - protein, 366 aa, Primula vulgaris
MGYLCDFCSEQRSMVYCRSDSACLCLSCDRNVHSANALSKRHSRTLLCEKCNSQPAFVRCVEEKTSFCQNCDWLGHNVSEEASTHKKQAVNCYSGCPSSAELSMIWSFVLNGEDDSNCEKGMSSMNISETQDECTVFDDVKKVDKSKTQMYSKAQMGNSTLSKMYCPGTKAPDICENDDFYKDFDIDEIDLTIENYEELFGVAFNDPQQLFGANGIGSMFRSKDMSTSDVNRQASSGQQRNTAQPTCSNGASADSSMSAKTEPIVCYSRQLNLSFSGVTGESSAGDFHEIGMGEPPPWCSPCSFPSTSRSSAVLRYKEKKKIRKFDKKVRYASRKARADVRRRVKGRFVKAGDVYDYDPLGRTRSY

SEQ ID NO: 4013 - protein, 640 aa, Arabidopsis thaliana
MGCCQSRIDSKEIVSRCKARKRYLKHLVKARQTLSVSHALYLRSLRAVGSSLVHFSSKETPLHLHHNPPSPSPPPPPPPRPPPPPLSPGSETTTWTTTTTSSVLPPPPPPPPPPPPPSSTWDFWDPFIPPPPSSSEEEWEEETTTATRTATGTGSDAAVTTAPTTATPQASSVVSGFSKDTMTTTTTGSELAVVVSRNGKDLMEIIKEVDEYFLKAADSGAPLSSLLEISTSITDFSGHSKSGKMYSSSNYECNLNPTSFWTRGFAPSKLSEYRNAGGVIGGNCIVGSHSSTVDRLYAWEKKLYQEVKYAESIKMDHEKKVEQVRRLEMKRAEYVKTEKAKKDVEKLESQLSVSSQAIQSASNEIIKLRETELYPQLVELVKGLMCMWRSMYESHQVQTHIVQQLKYLNTIPSTEPTSELHRQSTLQLELEVQQWHHSFCNLVKAQRDYIQSLTGWLRLSLFQFSKNPLVRSSYESKIYSFCEEWHLAIDRIPDKVASEGIKSFLTAVHGIVAQQADEHKQKKRTESMLKDFEKKSASLRALESKYSPYSVPESRKKNPVIEKRVKVEMLKGKAEEEKSKHEKSVSVTRAMTLNNLQMGFPHVFQAMVGFSSVCMQAFESVYNQAKSIGEDQEEVKRLLP

SEQ ID NO: 4014 - protein, 205 aa, Oryza sativa Indica Group
MASTSGSAAAVEERGNSERKRKRGATGESEGSEAQPSKWRTRRAHEIYSSKLLDAIRLVRSGSPSSSAEAPPRSRAVRESADRALAVSARGRTRWSRAILASHRRRIQAARRARLREAISPPSRHPSSSSGKGPKAPALARKAKVLGRLVPGCRKLPFPALLAEASDYIAALEMQVRAMTALAEVLSTVSGSGSASSSGGSSSPA

SEQ ID NO: 4015 - protein, 366 aa, Primula vulgaris
MGYLCDFCSEQRSMVYCRSDSACLCLSCDRNVHSANALSKRHSRTLLCEKCNSQPAFVRCVEEKTSFCQNCDWLGHNVSEEASTHKKQAVNCYSGCPSSAELSMIWSFVLNGEDDSNCEKGMSSMNISETQDECTVFDDVKKVDKSKTQMYSKAQMGNSTLSKMYCPGTKAPDICENDDFYKDFDIDEIDLTIENYEELFGVAFNDPQQLFGANGIGNMFRSKDMSTSDVDRQASSGQQRNTAPPTCSNGASADSSMSAKTEPIVCYSRQLNLSFSGVTGESSAGDFHEIGMGEPPPWCSPCSFPSTSRSSAVLRYKEKKKIRKFDKKVRYASRKARADVGRRVKGRFVKAGDVYDYDPLGRTRSY

SEQ ID NO: 4016 - protein, 640 aa, Oryza sativa Japonica Group
MTDGHHFNNISLGGRGGNNPGQFKLYSGGLAWKRQGGGKTIEVEKSDITSVTWMAIPRSYQLGVSTKEGLFYRFFGFREQDISSLTNFMEKNMRITPEEKQLSVGGHNWGGIEINGNMLSFNVGSKEAFEVSLADVAQTQMQGKTDVVLEFHVDDTTGGNEKDSLMDLSFHVPTSNTQFPGDENRPSAQVLWQAILNKADVGSSEEAVVTFDGIAILTPRGRYSVELHLSFLRLQGQANDFKIQYSSILRLFVLPKSNNPHTFVVITLDPPIRKGQTLYPHIVIQFETEAVVQRDLTLSDEVLAEKYKDRLENSYQGLIHEVFSKVLRGLSGAKVTRPSTFRSCQDGYAVKSSLKAEDGLLYPLEKGFFFLPKPPTLILHEEIEYVEFERHGAGGASISSHYFDLLVKLKNDQEHLFRNIQRNEYHNLFNFISGKHLKILNLGEAQGRAGGVTAVLQSTDDDAVDPHLERIRNQTGDDESDEEDEDFVADKDDSGSPTDDSGEEGSDASLSGGEKEKSSKKEASSSKAPLKKRKPKGGDAAEGSEKRKPKKKKDPNAPKRAIAPFMYFSKAERANLKNSNPELATTEIAKKLGERWQKMTAEEKQPYVEQSQVDKKRYAEESAAYRGAAAMDVDSGPASD

SEQ ID NO: 4017 - protein, 603 aa, Oryza sativa
MSSAAGGGGGYGGGGGEHQHQQQQHHLLLGQAAGQLYHVPQHSRREKLRFPPDHPAESPPPPPPGSWPLPPAFYSYASSSSSYSPHSPTLAHAQLVAHGMPPGAATSGGAQIPSQNFALSLSSASSNPPPTPRRQFGGGGGGGGAAGPYGPFTGYAAVLGRSRFLGPAQKLLEEICDVGGRPAQLDRGSDEGLLDVDAMDAAGSVDHEMDGSDRAVADAVTVSGAEQQWRKTRLISLMEDFKALLSSLLKLAGGDPQFIYNQKVCKRYRQYYQQLQAVVSSFETVAGLSNAAPFASMALRTMSKHFKYLKGIILNQLRNTGKGATKDGLGKEDTTNFGLMGGGAGLLRGNNVNSFSQPHNIWRPQRGLPERAVSVLRAWLFEHFLHPYPTDSDKQMLAKQTGLTRNQVSNWFINARVRLWKPMVEEIHNLEMRQLQKNPSLDKNQLSMQHTQHSSDSSGKPCDPSNSLQGQSSSMTRNHSISASRHIEDGLSQMPHDISGQVSFAYNGLAAHHSIAMAHHHQPDLIGTGGAANAGGVSLTLGLHQNNNRAYIAEPLPAALPLNLAHRFGLEDVSDAYVMSSFGGQDRHFTKEIGGHLLHDFVG

SEQ ID NO: 4018 - protein, 246 aa, Helianthus annuus
SYMSSCPFKKNEIFFANKTIYEAALSSSTLHIVDFGIAYGFQWPILIKHLGDRPGGPPKLRITGIEFPQPGFRPAEWVEETGRRLATYCERFKVPFEYNAIAIQNWEMINIDDLKLQRNEFLAVNALARFENLLDETMVTGSSPRDAVLKLVRDMKPDIFVHSIVNGSYSAPFFVTRFREALFHYSALFDMLDATIERENEQRQSYEGEFHGRQVMNVIACEGPQRVERPETYKQWQVRITRAGSN

SEQ ID NO: 4019 - protein, 335 aa, Zea mays
MAGAGGGGDWPFTADDDAYGADSSAMFAELAAGCWAAAGGTAAEELMMSMLLPPPEDHHHHQAAVLATTPAAVSSRSSSTDDDDGAPAAAATTEAASKPPAAGKTTMTKSSSAGQKRARQPRFAFMTKSDVDHLEDGYRWRKYGQKAVKNSPFPRSYYRCTNSKCTVKKRVERSSDDPSVVITTYEGQHCHHTAVACFPRANHAADGRHHLPFVEFSAASSAHHHYHSNPYSGTASCVNDHHLPPLLPTTTTLAPRHNALDNGQQELQAAMSMPVASVPTTSLLPPPTTALAAPPVASVSMTSSSSLPPASSSAAPAAVDKGLLDDMVPPAMRHG

SEQ ID NO: 4020 - protein, 148 aa, Oryza sativa Japonica Group
AAGAPGKPPRADKVSILSDAARLLSQLRAEAQKLKSSNESLQDSIKSLKAEKSELRDEKTRLKAERERLEQMLKGVGAATPAAPAPFVPHHAAAVAAAPAYHPAAFAQAGGKYVPYATSYAPPAAFWQWIPPTSLDTSKDPVMWPPVA

SEQ ID NO: 4021 - protein, 327 aa, Glycine max
MPNTTEEFHNNNCFESLHVSLRNLSQLSTRMDSLQSFLSHSIQSHTLLTHHQMSTVSNEILTAIRHVITNSAALVAASGNVLPLSETPTLDSPNLNNNNSNDNVVELDAMELLAKHLHFCEVCGKGFTRDANLRMHMRAHGDEFKTPEALANKARGETRLKAARFSCPLEGCNRNKTHKKFRPLKSVFCLRNHFKRSHCPKTLSCQRCRKKSFAVLSDLRSHVKQCRGEATWKCSCGTTFSRKDKLLGHVALFEGHSPMLEEEAPVAVAVKESEGGLDGLPEGFFDGLDEFGFGSIQNNCSHAGASLALGLPSNNLYAWELSFSNLI

SEQ ID NO: 4022 - protein, 230 aa, Trochodendron aralioides
KINRQVTFAKRRNGMLKKAYELSVLCDAEVALIIFSNRGKLYEFCSTSSMLKTLERYQKCSYGALEASQPAIETQNSYQEYLKLKGRVEVLQRSQRNLLGEDLGPLNTKELEQLEQQLEMSLKQIRSTKTQFMLDQLSDLQRKEQMLQEANRALGRKLGESSAENTLRLSWEAGGQSIPYSRQPAEPEGFFQPLECNSSMHIGYNPVGPDQITVAAPGQNVNGFIPGWML

SEQ ID NO: 4023 - protein, 303 aa, Arabidopsis thaliana
MHAAASDSSDRSKDKLDQKTLRRLAQNREAARKSRLRKKAYVQQLENSRLKLTQLEQELQRARQQGVFISSSGDQAHSTGGNGALAFDAEHSRWLEEKNRQMNELRSALNAHAGDTELRIIVDGVMAHYEELFRIKSNAAKNDVFHLLSGMWKTPAERCFLWLGGFRSSELLKLLANQLEPMTERQVMGINSLQQTSQQAEDALSQGMESLQQSLADTLSSGTLGSSSSDNVASYMGQMAMAMGQLGTLEGFIRQADNLRLQTLQQMLRVLTTRQSARALLAIHDYSSRLRALSSLWLARPRE

SEQ ID NO: 4024 - protein, 467 aa, Picea sitchensis
MDPDFGVERQAFEAVPDSKSLVSLHSSLSCSFNTMDTIFCDESRYSQKCTGEFGEIASQNAFGGAPESIISNAGGAFFADPSFAAKYLQKSSFSPVMAKETSNADGSGSIGGPNVPILANSVQFHTPSVKNSVNARRWRNLEASHLGSEVSKFGIGSVPSALVQFPSDPGFVEQAAKFSPFNNIDRNSSENVVCGASNLPPIVGGVQQGGGENMSVFSEPTKCVDDGNGKKRRAKSLTSAENSKEPEEAKAKRCRLGESSEIDDDDNNDETSDSNSKKGKEKNSNVSQKDDNYIHVRARRGQATDSHSLAERVRREKINQRMKFLQDLVPTCNKVTGKAVMLDEIINYVQSLQHQVEFLSMKLATVNPKLDFNIDNFFAKEMSGSFSSKGMSPTYFHLDQLKQASLQTVPSPGSDIPSTMSSVDSAEMFDGTNFQRQEGWDSELQNMYNMGLLQSRLQQHQHQQRPL

SEQ ID NO: 4025 - protein, 414 aa, Zea mays
MTSAGAATGAALGARTARSCDGCMRRRARWHCPADDAFLCQTCDVSVHSANPLARRHHRVRLPSASCSSPPRDPDAPTWLHGLKRRPRTPRSKPGGSKSNKHEATPSFIAAAASSAAVPDLEAEESGSGILGGNDDHHGFLQDDDEDLLYRVPVFDPMLAEFYNPVADEGEQKPACSLLMPSLAETSPEFASGGSAEADGLSVSFHVPDMELASFAADMESLLMGVDDDGFDCLGFLDEEKPQVNADLDAIVAPAPEPEDKKRKRPEMILKLNYEGVIASWVRDGGSPWFHGERPHLDCHELWSDDFTTGSRELLGGAVTPVTGGEREARVSRYREKRRTRLFAKKIRYEVRKLNAEKRPRMKGRFVKRTTLPPLPRPPPPSQQQQKKKQLPRSLPHVGMVLAPPPGADGRFRF

SEQ ID NO: 4026 - protein, 310 aa, Lilium longiflorum
MVNATPRPHRPFPILRSPFKTYSSESNMFSNQDTQISCHNELSFLFSPIYTDSFEDLLPYMPPAEPSPPRKQTGGLSRKRPLRKDRHSKICTAQGPRDRRMRLSLDVARKFFGLQDMLGFDKASKTVQWLLTMSDTAIKELTRTSRPISEASTSDGENNSTVSDYRRKSTMTAGNAKKQPRRKATLHRIATTASRANARARARKRTMEKKRIGQANKVEDESVLHDLRSSVELNDQCRGSTISEGVYEFLMSAEVGLNDDNMFDYSQDPIRLLQEQCGMNFVVGGGERDLMGEVQFPIRSWELFNENPTL

SEQ ID NO: 4027 - protein, 244 aa, Triticum aestivum
  misc_feature (234)..(234): Xaa can be any naturally occurring amino acid
MGMAAVKVEGRDGCAESRQHLALSSPSASEGGSYGGGHPWASPLVPSPADSGSSRRRISGPVRRAKGGWTPEEDETLRKAVTVFKGKNWKRVAEFFPDRTEVQCLHRWQKVLDPELIKGPWTQEEDDTIIQKVKEHGPTKWSVIARSLHGRIGKQCRERWHNHLDPQIRKEAWTFEEEQVLVDAHRMHGNKWAEIAKLLPGRTDNSIKNHWNSSVRKRLDEYDTGAAHPVPVHXSHNDLKQVAM

SEQ ID NO: 4028 - protein, 298 aa, Zea mays
MVEEGATAAASRSGPAPFLSKTHQMVEERGTDEVISWAEQGRSFVVWKPVELARDLLPLHFKHCNFSSFVRQLNTYGFRKVVPDRWEFANENFRRGEQGLLSGIRRRKSTTPQPSKYGGGSVVNTAFPPPLPFPPPASVTTSGGGGGAGAGNERSSSSASSPPRTDDLTSENEQLKKDNRTLSTELAQARRHCEELLGFLSRFLDVRQLDLGLLMQEDVRAGAGDDAAPRRAMVSQLERGGEEGKSVKLFGVLLTDAARKRARCEEAAASERPIKMIRIGEPWIGVPSSGPGRCGGGN

SEQ ID NO: 4029 - protein, 120 aa, Physcomitrella patens subsp. patens
YCECFAAGLYCVGSCACRDCFNKPEYIETVINTRQQIESRNPLAFAPKIVQGAESSPVPGVSSNQKLDEVLDTPASARHKRGCNCKKSLCLKKYCECYQAGVGCSEGCRCEGCMNKYGRK

SEQ ID NO: 4030 - protein, 673 aa, Gossypium barbadense
MAFPASDIPSAEQQADDPLYRELWHACAGPLVTLPRVGERVYYFPQGHMEQLEASMHQGLEHQMPSFDLPSKILCKVASVQRKAEPDTDEVYAQITLVPEVDQSEVMSPDDPLQEPERCIVHSFCKTLTASDTSTHGGFSVLRRHADDCLPPLDMTQQPPWQELIATDLHGNEWHFRHIFRGQPRRHLLTTGWSVFVSSKKLVAGDAFIFLRGANGDLRVGVRRLMRQQANMPSSVISSHSMHLGVLATASYALSTRSMFSIFYKPRTSLSEFIVSVNKYLEARSHKLSVGMRFKMRFEGEEVPERRFSGTIVGVEADKSSGWADSEWRSLKVQWDEPSSIIRPDRVSPWELEPLVATSNSSISQPAQRNKRARPPVLPSPSSDLSSLGIWKSPVESPFSYCDAQRGQPSPKLSSTAKPNSVGFSGNSSLAAVSSSSKYWPNRVENVTESVAPVVNKESSERKQGTGNGCRLFGIQLIDNINMEENSPLATISGTGVNDQPLHSLDANSDQQSDPSNLNQSDLPSISCEPEKCLRSPQESQSKQIRSCTKVHMQGMAVGRAVDLTRFDCYEDLLKKLEYMFDIKGQLCGSTKNWQVVYTDDEDDMMMVGDDPWNEFCSMVRKIFIYTSEEVRKLSPKIKLPVNDDDDDSKATKAGVDTVINPEDRSSIVGQGC

SEQ ID NO: 4031 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 4032 - protein, 223 aa, Pyrococcus horikoshii OT3
MIYKACIRKRCGGVCVGEELKPEKIQEIRLGDCPICGGKGTLKAIQFIHRIPYFGEVMESTVVCERCGYRNSDVIILEEREPRLYEVKVEEEKDLFIRVVRSKSGTIELEELGIKIEPGPAAEGFVSNIEGVLERAKEVLLMARDFKEQENDREAVRRIDELLKYIEEVKEGKKPLTVRIMDPFGNSALIGEKVKSRKLTKEEIRKLSKGPYIVIEPDEVPQQ

SEQ ID NO: 4033 - protein, 189 aa, Physcomitrella patens subsp. patens
MTKKRTTKSRLDYYRIANTQKIIKPGDTVTLRPPDLTTPPYVARIELIELDAAEKITLKVRWYYRPEESAGGRRQFHGSKELFLSDHYDVCSPEAVENKCTIHTFKDYTRLEDVGTDDYFCRFDYNARSGTFSPDRVAVYCKCEMPYNPDDLMVQCENCKDWFHPKCVMLSSEDIKNVKNFHCPDCINS

SEQ ID NO: 4034 - protein, 1099 aa, Gossypium arboreum
MGKSELTDGCLSDDAGEAPERRHINPELWQACAGPLVNLPAAGTHVVYFPQGHSEQVAASMKRDVDAQIPNYPNLPSKLLCLLHNVTLHADPETDEVYAQMTLQPVSSFDKEALLRSDLSLKSNKPQPEFFCKTLTASDTSTHGGFSVPRRAAEKIFPPLDFSMQTPAQELVARDLHENVWKFRHIYRGKPKRHLLTTGWSLFVSGKRLFAGDSVLFIRDETQQLLLGIRRANRQPANLSSSVLSSDSMHIGILAAAAHAAANNSPFTVFYNPRASLSEFVIPLAKYYKAVYNHQISPGMRFRMMFETEESGTRRYMGTITGISDIDPVRWKNSQWRNLQVGWDESTAGERRNRVSIWEIEPVTAPFFICPSPLFRSKRPRQPGMLADEYSDLDNLFKRPMPWLGDDICLKDSDAHPGLSLVQWMNMQQNPLLANSMQPNFMQSLAGSTMQNFDGADLSHQMGLSAPQMPQPNNLQFNAHRLPQKVQQLDQVPKLPSTMNSLGSIIQPQQLNDMTQQSRQNLVAQTLPSSQVLQPQALVRSNNILHQQQTSNPTHQLPLSLPQNLQQQQQYLVGPNHPQNLMHSQLPDPLNQHLQVPDNQVQFQLMQKLQQQQQLLLAQQSALQQPGLLAQPQDQQRQLLDASQSFSSSVTASQVLEMPQNIPTLLPQSNVAPQQMPKNNSQANVWFSQPPLQSKVQQQQTGMLPEVPGLVGPFQTTATNQFSTAVSSVMTSAAVAAPSVITDDNPSCSTSPSTNCPSVLQPMIDSRVHRSAGLGDDISQSAATVLNPNALETMSTKANMVKEQQQKSVKPLLNISKSQNQGSFAPQNCINGATAHADCLDTSSSTTSVCLSQSDAHLHQNTLSYNPQTMLLRDTSQEGEVRAYPRNNVSYGNNMDSQIEMPMNSDTLSAKGMMGLGKDFSNHLSSGGILASYENPKDAQQELSSSMVSQPYRVPDMAFNSIDPTINHSSFINRNAWTPPSQFQRLRTYTKVYKRGAVGRSIDITRYSGYDELKQDLARRFGIEGQLEDRGRVGWKLVYVDHENDVLLVGDDPWEEFINCVRCIKILSPQEVQQMSMDGEFGNSVLPNQDCSSSGNGNA

SEQ ID NO: 4035 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPEPDVNTNWSMEYNRLRAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMPSHQPSPFLNMGGLYQEDDPMAMRRNDLELTLEPVYNCNL

SEQ ID NO: 4036 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMVMRRNDLELTLEPVYNCNL

SEQ ID NO: 4037 - protein, 158 aa, Prunus domestica
VRKRPWGRYAAEIRDPWKKTRVWLGTFDTPEEAALAYDGAARSLRGAKAKTNFPAPVPGGLSLDLNIPSAAHWASHSGRLVEFLHTGVLNDMSCGDATPDTTTLVSKREQPQAPVGVVGNVGGVAGGTVAEGSSTASYLGLVRRGLPIDLNEPPPLWL

SEQ ID NO: 4038 - protein, 210 aa, Capsicum chinense
MSPPLLGVGEEEGQSNVTLLGSSSSLGSICQKGLALKERNYMGLSDCSSVDSCNISTSSEDNNGVGLNLKATELRLGLPGSQSPERGTAPCPLGSTKVDEKLLFPLHPAKDTAFSVSQKTVVTGNKRGFSDAMDGFSEGKFLSNSGVKAGDAKETSRVQPPKLKDANTQGTVLEKPSAVNEASNRAGSGAPATKAQLWVGHPFDLLERTH

SEQ ID NO: 4039 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAVSPKELQNLEQQLDTALKHIRTRKNQLMYESINELQKKEKAIQEQNGMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 4040 - protein, 359 aa, Triticum aestivum
MSDVTAVMDLEVEEPRLSLPPGFRFHPTDEEVVTHYLTPKAVNNAFSCLVIADVDLNKTEPWDLPGKAKMGEKEWYFFVHKDRKYPTGTRTNRATEKGYWKATGKDKEIFRGKGRDAVLVGMKKTLVFYTGRAPRGDKTPYVMHEYRLEGQLPHRLPRSAKNDWAVCRVFDKDLAAKNAPPPMAPAAVGVMEDPYAFLDVDDFLNNPDLLNNADLPMLMDSPSGADDFAGASSSTSSAAVPLEPDMEHLSIKTEPPVPQQQMQSPNYFFMPAATPNGNHGGGGYSPYQAMGDQQTAIRRHCKPEAASSSALLSPSLGFDAGALAGADTSFLMPSSRSYLDLEELCRGEPPMDYSNMWKI

SEQ ID NO: 4041 - protein, 395 aa, Zea mays
  misc_feature (122)..(122): Xaa can be any naturally occurring amino acid
MDSGSSLVDDTSGGGACTDKLRALAAAAASASGPPPERMGSGASAVVDAAEPGAEADSGSAPASVAAVAAGVGGKLPSSRYKGVVPQPNGRWGAQIYERHLRVWLGTFAGEADAARAYDVAXAQRFRGRDAVTNFRPLADADPDAAAELRFLASRSRAEVVDMLRKHTYFDELAQNKRAFAAASAATASSLANNPSSYASLSPATATAAAAAAAREHLFDKTVTPSDVGKLNRLVIPKQHAEKHFPLQLPSAGGGSKGVLLNLEDAAGKVWRFRYSYWNSSQSYVLTKGWSRFVKEKGLQAGDVVGFYRSAAGPDTKLFIDCKLRPNSVVAASTAAPSPPAPVAKAVRLFGVDLLTAPPPAPPPAEAVAGCKRARDLGSPPQAAFKKQLVELALV

SEQ ID NO: 4042 - protein, 246 aa, Helianthus annuus
SYMSSCPFKKNEIFFANKTIYEAALSSSTLHIVDFGIAYGFQWPILIKHLGDRPGGPPKLRITGIEFPQPGFRPAEWVEETGRRLATYCERFKVPFEYNAIAIQNWEMINIDDLKLQRNEFLAVNALARFENLLDETMVTGSSPRDAVLKLIRDMKPDILVHSIVNGSYSAPFFVTRFREALFHYSALFDMLDATIERENEQRQSYEGEFHGRQVMNVIACEGHQRVERPETYKQWQVRITRAGSN

SEQ ID NO: 4043 - protein, 309 aa, Cymbidium insigne
MAAAIDMYKNMLDMSYDNLLSEELTEALGPFINGVSSPSPSFPFFPSSSTTKVISFDPSPASLPPLPSSLSSYQFSYPSQNLTFDCSVPSIWNHHDSFSSDRPIGLTQLGSNQIQQIQAQLHRHHNRNPLAPRTQPMKLFSEAAAKPPKLYRGVRQRHWGKWVAEIRLPKNRTRLWLGTFDTAEEAAMAYDKAAFRLRGEFARLNFPHLRYSNAGSDPHSSVDAKLEAICESLASSQKQESASSLTPSIAVGVKSEPEVSSEAEISSEGSSPVSEMESLDFTEVPWDESEQFVLRKYPSWEIDWDSVLS

SEQ ID NO: 4044 - protein, 340 aa, Paraboea crassifolia
MGRAPCCDKTGLLMKKGPWSQEEDQKLLDYIQKYGYGNWRTLPTNAGLQRCGKSCRLRWTNYLRPDIKRGRFSFEEEETIIRLHSILGNKWSLIAARLPGRTDNEIKNYWNTNIRKRLLRMGIDPVTHSPRLQLLDLSTILNSSLCNNSPTQMNFSRLQPRFNPELLRFAASLFSSNCQSQDFPMQNQITSNNQIPPPFMQTSVQDVAVLPDLCADTNLGTSFSVHDEVQEFQQNPAGYGMPSALTGEYVPVLNDGYYGSGDQPFVDPTPSSVTSNFQSYCSNSLGFQSIFSTPPSSPTPLNSNSTYVNSCSSTEDETESYYNSMWKFEIPDNLRINDFM

SEQ ID NO: 4045 - protein, 327 aa, Arabidopsis thaliana
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 4046 - protein, 160 aa, Hordeum vulgare subsp. vulgare
MKGAKSKGAAKADTKLAVKSKGAEKPAAKGKKGKAGKDPNKPKRAPSAFFVFMGEFREEFKQKNPKNKSVAAVGKAAGERWKSLSESEKAPFVAKANKLKGEYNKAIASYNKGESTTAAPKKASSKEVEEEDEEESDKSKSEINDDDDDEGSDEAEDAAE

SEQ ID NO: 4047 - protein, 406 aa, Oryza sativa Indica Group
MGSKKRSPQHPAAAAPPPAVGGGGGGEVSGDGGASTANGPVVPKPSEVAPFLTKVYDMVSDPATDNVISWAEGGGSFVIWDSHAFERDLHRHFKHSNFTSFIRQLNTYGFRKVHPDRWEWANEGFIMGQKHLLKTIKRRKKSSQEAPSEIQKAPVKTAPGTENIEIGKYGGLEKEVETLKRDKALLMQQLVDLRHYQQTSNLEVQNLIERLQVMEQNQQQMMALLAIVVQNPSFLNQLVQQQQQQRRSNWWSPDGSKKRRFHALEQGPVTDQETSGRGAHIVEYLPPVPETSGQVNPVEGAICSANSQPVPSPAVATPMDMQTSNVADTLGSSEEPFADNSTLHEWDDNDMQLLFDDNLDPILPPFENDGQMGPPLSVQDYDFPQLEQDCLMEAQYNSNNPQYGND

SEQ ID NO: 4048 - protein, 339 aa, Zea mays
  misc_feature (210)..(210): Xaa can be any naturally occurring amino acid
MCGGAILAELIPPTRRVASKPVTEGHLWSASSKKAGSGRDKRHQHEYADDDFEAAFEDFDDDFDVHEDDEDGHFVFSSKSALSPALHDGRAASQKKQRGRQFRGIRQRPWGKWAAEIRDPHKGTRVWLGTFSTAEDAARAYDVEARRLRGSKAKVNFPAASGRARGRARPRRGDDGNPRTAPETQHPAQPALLPRGEIVWRRGRKGSPPXKPEATQSFDVGGLFFDMAFPTFPASPPPQAVEASFTGSTATSETGSPAKRPRCDDNSSEGSGGSGSALELADELAFDPFMLLQMPYSGGYDSLDGLFAAEAVQQDVGNGMDGVSLWSFDEFPAVDGCVF

SEQ ID NO: 4049 - protein, 313 aa, Gossypium hirsutum
MESTWVDTTLDLNINSSHNTIQVLKRESSGKLADSDVKVPVKQETGALVEELNRIIAENKKLTEMLTVLCERYSSLQNQYMELVSRNSGSDATAATSKKRKAECEDYVPMIGFSGKAESSFSDEDSCKKPKDCIKAKISRAYVRPNPSDNSLIVRDGYQWRKYGQKVTRDNPSPRAYFKCSFAPSCPVKKKVQRSAEDPSILVATYEGEHNHEQHSPPALSSLSPNGGTSNPRSAPVSSSSSAPAKSSPPTVTLELMKPTGLGNDTQNPTQQVDEPAIQQILVQQMAASLTRDPNFTAALASAISGKVLDHKW

SEQ ID NO: 4050 - protein, 139 aa, Arabidopsis lyrata subsp. petraea
STGKRSEREEDTDPQGSRGISDDEDGDNSRKKLRLSKDQSVILEETFKDHSTLNPKQKQALAKQLGLRARQVEVWFQNRRARTKLKQTEVDCEFLRRCCENLTEENRRLQKEVTELRALKLSPQFYMHMSPPTTLTMCP

SEQ ID NO: 4051 - protein, 1288 aa, Physcomitrella patens subsp. patens
MKANRDEEREKGRRIKINGELLEKSFKKNSARSTFCQGQTSKSGQTSKSGQPRQKEKRRKERKIARQAKCWRANSDVVDDVVEDDGNARALLPGVEEGRRFQTTTFDVIECKCDCVRSLGEAQPPSRGAEGTLKPPKISTGGVFVNYIDSVAVVLEVVVEDWKKDGVVRCQGKIRGVRGKWCDALAAPGYGCSLLSTFGFLGKLFVEDVRVDSGGTEGSLHFESLHMDPSEPLRAYGADSDKNLQTDSYNGSLMASDSYNFLTGAGVLDVPLKEQNESTHAHKSSKEGAAQNSSGPSIETLYTNHEPSPSSGSFPGRSSPAPECNSWDNINGGGLYGNSNMQNILISGSGMMAAPTSTTTAQLLIGGLHGGSFNDGSESDQGSIYYTSSNHHDDSMAQLYYVNAAAGFSNPGFHSDGRQAGLVTTSLYPSQHGGTSAQQSSTDQSQQQFGVPFISHASLAHGSVRQRALESTGAVPILSLHEHSGSHDGNHHYNWRNGGNEHPFLPMNAESNQNHQSQFDTDLPQYAMSRASHADLSHMQRTDHLQSEISLHMDRSHGSSTTGQVLSLSLSSHQSQFNSSGGQLSESEHMNAVAAQAAAMAKTKELASRYLTGANADLSRFRTPSRDDVVGIGARFLQKHNSGGGRKHLESSNYSGPSGTAGSSNHISASKFERSAQAILNEVCSVTPLKRPPKPIRSPDQQHWSVAGGRSIGADANLTYTGRDDRSAMLAGEVDSVRDPALFVTASSLVTVSQLPLDSETVQELADAARCENRVDLELKKQKLNLMLDEVETRYRRYCEHLQLVITGFNSQAGPSTATPYTILALQAMSRHFRCLKDAIGSQLKIVKRSFGEDERTGQGETSRIRYVDQQIRQQRTLQQLGMLQQHAWRPQRGLPERAVSVLRAWLFEHFLHPYPKDVDKMSLAKQTGLTRSQVSNWFINARVRLWKPMVEEMYVEEQKEYPGDHTAALAQSERMARDQVDIESHTYEQYKGGRGHTGLLQEISAGAQSSRLPNGLKRNEDREHDTGASVSEAGGISSDTNAELYSQLIPRSHHLDIGAAGNYNQEGREAKKPRTSGSDAFNMTSSTTLMHPGMDVEASESCARTQNFSSGGELDLQRKSDVDFGTQCQVLNQINQDENGYTISQQGTTIVDQIEPSVASGTFAAYNSNIGHRYGNEDYSSRTISAALTTSTGVSLTLGLCHCDTNQLRSSLVSPILVKSTYNMDVNDQMNQLNGVEHFESRTKSVSNNCQSSATMSNGHYNQISAVQDDSDNSTQQLSPHHEFVTS

SEQ ID NO: 4052 - protein, 359 aa, Zea mays
MDSPLYQQLQLSPPSPKPDQSSSFYCYPCSPPFAAADASFHLSYHIGSSATDTHPQTVVNSPEIPVFPLMEQTPAPATEQGAGACGAQGAGVSLDRAYAAPRKDWHSKICTAGAMRDRRMRLSLDVARKFFELQDMLGFDKASKTVQWLINTSKAAIQEIMADDASSECVEDGSSSLSVDGKYNPAELGGGNEKSNGNACSEWKKPAMVRKAATTTKPPRKSGNNAHPVPDKETRAKARERARERTKEKHRMRWVKLASAIDVEVAAASVASDRPSSNNLSHHSLSSMNIPRAAAAELEERERSLLAPNNRGRMQEITGASDVVGFGNGGGYGCDDGNYYCQEQWELGGVVFQQNSGFY

SEQ ID NO: 4053 - protein, 783 aa, Oryza sativa
  misc_feature (733)..(733): Xaa can be any naturally occurring amino acid
MDTPDRAAAAARAEDSPLFSFIDSLSPIEPLKSAYSASSIQAYQSLNITSISSIFTSPHDNAQKESKLSKSSFAEFSESEVCADESDKNKPSKSSNAVRLFACTSTLTQATHKITSSVSEGTVGPPEGSNDLPQPGQFDSGSPDHNTTPCHGVRSDLKQGKCRKLQAFQTAKTNTSEKRKCLFSTEVQLMDGCQPEKLNDEILGCDWDDLISATSGELIAYDEDHKGVQLAVSNAESCGFLLSKLTGDGDISDRTHPSSSTQTYYRELLMDEDQTENAQLVPDGEKNISTEEIQDNLYEANGSIPTGYKVETQQQRGMRRRCLVFEAAGYSNRIVQKESVMDLSVSTCKGKSPVQNHSNPGKTPSPRVLRGIGLHLNALALTSKDKMICQDPMSSLVPSSATQQEAHGKMLSAGENFIHPGGELLELQMDDDCSAGVFLGNDHDSSQSNSPQKKRRKSDNGDDGEACKRCSCKKSKCLKLYCECFAAGVYCSEPCSCQGCLNKPIHEEIVLSTRKQIEFRNPLAFAPKVIRMSDAGQDITGEDPNNTPASARHKRGCNCKKSSCLKKYCECYQGGVGCSSNCRCEGCKNTFGKRDAAVSTEAEEMKQGGEEAENCGKEKENDLQKANAQSEDHPFLELVPITPPFDVSSSLLKPPNFSSAKPPRPTKARSNSSRSSSKAPGAVHSQKFSKIANSGLNEEMPDILRDDASPGNCVKTSSPNGKRVSPPHNALSXVSPSRKGGRKLILKSIPSFPSLIGDASSGSSMNSSESAFNTASPLALGPS

SEQ ID NO: 4054 - protein, 380 aa, Zea mays
  misc_feature (283)..(283): Xaa can be any naturally occurring amino acid
TSLYKKAGWYRSGIPGIARAGFLAPVPGFLPQGLAHFPVDSGFIERAARASCFGGGGGGGVMAAFGAAADHQPMNSAFSGSSEALLDHQRTKDGSDKGEPELGRNGHDGVLSSEAAAAGDCSSKGTSDSKKRRRPNEVMGGDQVQSSNLPADSANESVHSKDKGEESSLATTTTGPGKSKGKGARETSESQKEDYIHVRARRGQATNSHSLAERLRREKISERMKLLQDLVPGCSKVTGKAVMLDEIIHYVQSLQRPVEFLSMKLATVNPRLDLNIEGLLSKXIFSRFPGVPSSSLGFSPEMMHPQLQLSQPGLIQGGAAGMANPDVFRRIMQAQLSAKDGSQMPPHALNGAFSDVAQQQMAYPSSQDLSIGPSQDGFQM

SEQ ID NO: 4055 - protein, 182 aa, Oryza sativa
  misc_feature (164)..(164): Xaa can be any naturally occurring amino acid
FRTRGLEEDECSDPSKTVKPLDGAQHDSAREKHQSCPDGTKNIQSKQQNGSSRSCKKVHKQGIALGRSIDLTKFTCYDELIAELDQMFDFNGELNSSSKNWMVVYTDNEGDMMLVGDDPWNEFCNMVHKIFIYTREEVQKMNPGALNSRSEDSRSTSVERGLVXGEGLQGGLSTPSLNSENC

SEQ ID NO: 4056 - protein, 292 aa, Zea mays
MSAGRQAYWCYQCRQRVRPRGREMVCPYCDSGFVAEMDDVDALMSHFVGTDPDFHRDPRFGIMEAISAVMRHGMAGMNREVDVRGRPNFFSDLEMEFGSGPWLLFRGQLPGHLTEDNGFDVFVNGRRGGGGGGGGMRRANIADYFVGPGLDDLIEQLTQNDRRGPPPAAQSSIDAMPTVKITQRHLSGDSHCPICKEKFEMGSEEAREMPCKHLYHSDCIVPWLEQHNSCPVCRYELPPQGSATGASCSRARSTDQSQSSSSSSSSGRTSGRQRRRNPFSFLWPFRSSSSSR

SEQ ID NO: 4057 - protein, 331 aa, Primula vulgaris
MGYLCDFCSEQRSMVYCRSDSACLCLSCDRNVHSANALSKRHSRTLLCEKCNSQPAFVRCVEEKTSFCQNCDWLGHNVSEEASTHKKQAVNCYSGCPSSAELSMIWSFVLNGEDDSNCEKGMSSMNISETQDECTVFDDVKKVDKSKTQMYSKAQMGNSTLSKMYCPGTKAPDICENDDFYKDFDIDEIDLTIENYEELFGVAFNDPQQLFGANGIGSMFRSKDMSTSDVNRQASSGQQRNTAQPTCSAGDFHEIGMGEPPPWCSPCSFPSTSRSSAVLRYKEKKKIRKFDKKVRYASRKARADVRRRVKGRFVKAGDVYDYDPLGRTRSY

SEQ ID NO: 4058 - protein, 423 aa, Zea mays
MDGNARSAATNQKKPVVADDDLVELLWHNGSVVAQPQAHQRPAPTYDPDRPGTSGLTGEETAAWFPDTLDDALEKDLYTQLWYSTIADAAPQHEGTLPGPTSQPSPSPPVGSSGVESSWAGDICSTFCGSNQVLRTPARIRGKDAALQSELPSNTGAHDGTSSSGGSGSNYGGSGLPSDSVHVQKRKGRCRDDSDSPSEDAECEEASEETKPSRRYGTKRRTRAAEVHNLSERRRRDRINEKMRALQELIPHCNKTDKASILDETIEYLKSLQMQVQIMWMTSGMAPMMFPGVHQFIPQMALGMNPGCIPAAQGLSQMPRLPYMNHTLPNHIPLNSSPAMNLMNPLNAANQVQIGHLRDAGSHVLHLDGGRAAVVPQVPGPGPHVVHGHQIAQAEEHNKILEVAASTVIPTSKAGQPPTFHGV

SEQ ID NO: 4059 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSTEYNRLKAKIELLERNQRHYLGEDLQAMSPKEPQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 4060 - protein, 366 aa, Primula vulgaris
MGYLCDFCSEQRSMVYCRSDSACLCLSCDRNAHSANALSKRHSRTLLCEKCNSQPAFVRCVEEKTSFCQNCDWLGHNVSEEASTHKKQAVNCYSGCPSSAELSMIWSFVLNGEDDSNCEKGMSSMNISETQDECTVFDDVKKVDKSKTQMYSKAQMGNSTLSKMYCPGTKAPDICENDDFCKDFDIDEIDLTIENYEELFGVAFNDPQQLFGANGIGSMFRTKDMSTSDVNRQASSGQQRNTAQPTCSNGASADSSMSAKTEPIVCYSRQLNLSFSGVTGESSAGDFHEIGMGEPPPWCSPCSFPSTSRSSAVLRYKEKKKIRKFDKKVRYASRKARADVRRRVKGRFVKAGDVYDYDPLGRTRSY

SEQ ID NO: 4061 - protein, 151 aa, Triticum aestivum
IDMFDDREGREHTHPSTSGMTDSSSGSASSHPTFKKNPARPLKDKSSPALTVKATYNGDTVRFKFLPSMGWYNLLEEIAKRFKLSMGVFQLKYKDDEDEWVIMANDSDLQECVDVMDSMGTRNVKLQVRDLPCLISSSGSSSCLQLEGHNS

SEQ ID NO: 4062 - protein, 249 aa, Kalanchoe daigremontiana
MSHPHYHRLVAAYVNCQKVGAPPEVVEKLERACAGLSSITTGSGRLGEDPGLDQFMEAYCEMLTKYELELSKPFKEAMAFLSRIESQFKALTLSSSSDSPAYGQSSDGNGSSDEDVDVHNDLIDPQAEDRELKGQLLRKYSGYPGSLKQEFMKRRKKGKLPKEARQQLLDWWTRHYKWPYPSESQKLALAESTGLDQKQINNWFINQRKRHWKPSEDMQFVVMEAAHPHYYMDNVMGNPYPMDTSPGYL

SEQ ID NO: 4063 - protein, 366 aa, Primula vulgaris
MGYLCDFCSEQRSMVYCRSDSACLCLSCDRNVHSANALSKRHSRTLLCEKCNSQPAFVRCVEEKTSFCQNCDWLGHNVSEEASTHKKQAVNCYSGCPSSAELSMIWSFVLNGEDDSNCEKGMSSMNISETQDECTVFDDVKKVDKSKTQMYSKAQMGNSTLSKMYCPGTKAPDICENDDFYKDFDIDEIDLTIENYEELFGVAFNDPQQLFGANGIGSMFRSKDMSTSDVNRQASSGQQRNTAPPTCSNGASADSSMSAKTEPIVCYSRQLNLSFSGVTGESSAGDFHEIGMGEPPPWCSPCSFPSTSRSSAVLRYKEKKKIRKFDKKVRYASRKARADVRRRVKGRFVKAGDVYDYDPLGRTRSY

SEQ ID NO: 4064 - protein, 246 aa, Helianthus annuus
SYMSSCPFKKNEIFFANKTIYEAALSSSTLHIVDFGIAYGFQWPILIKHLGDRPGGPPKLRITGIEFPQPGFRPAEWVEETGRRLATYCERFKVPFEYNAIAIQNWEMINIDDLKLQRNEFLAVNALARFENLLDETMVTGSSPRDAVLKLVRNMKPDIFVHSIVNGSYSAPFFVTRFREALFHYSALFDMLDATIERENEQRQSYEGEFHGRQVMNVIACEGHQRVERPETYKQWQVRITRAGSN

SEQ ID NO: 4065 - protein, 234 aa, Ipomoea nil
MARDKIQIRKIDNVTARQVTFSKRRRGLFKKAEELSVLCDADVALIVFSSSAKLFHYSNSSMREILEKRNLHSKNLQKMGLQPSVELQLVENSNHSRSSKEIAEKTQRLRQMRVEELQELSIEELQQLERSLQIGLDHVINKKGEKIMKEINQLQEKGVHLMEENDRLRQQVVETSKGQRSMAVAPRDSENLLNEEGGLSSESVTNACKYPGTPQDYYEDCSDTSLKLGLPYTG

SEQ ID NO: 4066 - protein, 246 aa, Helianthus annuus
SYMSSCPFKKNEIFFANKTIYEAALSSSTLHIVDFGIAYGFQWPILIKHLGDRPGGPPKLRITGIEFPQPGFRPAEWVEETGRRLATYCERFKVPFEYNAIAIQNWEMINIDDLKLQRNEFLAVNALARFENLLDETMVTGSSPRDAVLKLVRDMKPDIFVHSIVNGSYSAPFFVTRFREALFHYSALFDMLDATIERENEQRQSYEGEFHGRQVMNVIACEGHQRVERPETYKQWQVRITLAGSN

SEQ ID NO: 4067 - protein, 380 aa, Cucurbita maxima
MNPEVLSTDENDKLATRKTEKEQNDAPNSKEKLKKPDKILPCPRCNSMETKFCYYNNYNVNQPRHFCKACQRYWTEGGTIRNVPVGAGRRKNKNSASHYRHITISEALRAAQIDVPIEVNHLASKGNGRVLNFSVSPPVCESMVNVSHPAERKVLNGTRNEFEGAKGPCEGGETGDDCSSASSVTMSSSMKNGARRFPQEPHMQNINGFPSQIPCLPGVPWPCSWTAPIPPPALCPPGVPLSFYPATYWSCSASGSWNIPWVTPQPCPPIPGPNSPTLGKHSRDGDELQADNSEMKDPPKQKNGSVLVPKTLRIDDPNEAAKSSIWETLGIKNDSIKAVDLSNVFQSKGDLKSNVSEVLSPVLQANPAALSRSLTFHERS

SEQ ID NO: 4068 - protein, 857 aa, Oryza sativa
MATAEVGGGGGEGDAAAAAVARAGGGGGGGGGGEDALFTELWSACAGPLVTVPRVGEKEFYFPQGHIEQVEASTNQVGEQRMQLYNLPWKILCEVMNVELKAEPDTDEVYAQLTLLPELKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKRNYSIGMRFKMRFESEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQTPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGLMMPNSHMDDTQPRLIKPKPLVVAHGDVQKAKGASCKLFGIHLDSPAKSEPSKSPSSVVYDGTPQTPGATEWRRPDVTEVEKCSDPSKAMKPLDTPQPDSVPEKPSSQQASSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 4069 - protein, 264 aa, Physcomitrella patens subsp. patens
MQDGEETSDEEMDVDELEKRMWRDKIRLKRIKELRKDREMRGGQHKQSQEQARRKKMSRAQDGILKYMLKMMEVCQAQGFVYGIIPEKGKPVSGASDNIRAWWKEKVRFDRNGPAAIAKYQADHALPGKPKGNVSTAPTPHTLQELQDTTLGSLLSALMQHCDPPQRRYPLEKGVPPPWWPSGEEEWWPQLGLPKGQGAPPYKKPHDLKKAWKVGVLTAVIKHMSPDIAKIRKLVRQSKCLQDKMTAKESATWLSVLNQEEGLA

SEQ ID NO: 4070 - protein, 363 aa, Prunus persica
MESTDSSTASQQQQQQQPQPPPQPNLPPGFRFHPTDEELVVHYLKKKVTSAPLPVAIIAEIELYKFDPWELPAKATFGEQEWYFFSPRDRKYPNGARPNRAATSGYWKATGTDKPVLTSGGTQKVGVKKALVFYGGKPPKGIKTNWIMHEYRLADSKTSNKPPGCDLGNKKNSLRLDDWVLCRIYKKNNSHRPMDLEREDSMEDMMGPLMPPSISHVGHHQNMNLHLPKSNTNYGPPFIENDQIIFDGIMSSTDGSASLSNGTSQLPLKRSIVPSLYRNDQEDDQTAGASSSKRVVQLHQLDSGTNNSVAANNNSTSIANLLSQLPQTPPLHQHAMLGSLGDGLFRTPYQLPGMNWFSESNLG

SEQ ID NO: 4071 - protein, 63 aa, Physcomitrella patens subsp. patens
DEREVKRQRRKQSNRESARRSRLRKQAECEELGMRVDSLTVENVSLRTELSRMTEECKRLQAE

SEQ ID NO: 4072 - protein, 302 aa, Zea mays
  misc_feature (148)..(148): Xaa can be any naturally occurring amino acid
MEDLYSIHPGISRVVGGAASEASVAGAGAGGPSPSDLTELMKAQIASHPRYPSLLSAYIECRKVGAHPHVTSLLEEVSRERRPDPGAGAGAGEIGVDPELDEFMDAYCRVLVRYKEELTRPFDEAASFLSSIQAQLSDLCSGGSSPAXPPRTPVRKDDMMGSSEDEQCSGDTDVPDMGQEHSSHLGDHELKEMLLKKYSGCLSRLRSEFLKKRKKGKLPKDARTVLLEWWNTHYRWPYPTEEDKVRLAAMTGLDPKQINNWFINQRKRHWKPSEDMRFALMEGVAGGSSGTTLYFDTGTIGP

SEQ ID NO: 4073 - protein, 193 aa, Brassica oleracea
MQDQLVCHGCRNTLMYPRGATNVRCALCHIVNMVPLHPHPPPPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNRPNGTAAPGTMPSTSTSTPPSQTQTVVVENPMSVNESGKLVSNVVVGVTTGQK

SEQ ID NO: 4074 - protein, 286 aa, Ostreococcus tauri
MLAKPTPFAGRDGTAKARAGQGATNGARTERKKGVAWTEEEHKNFLIGLQKLGKGDWRGISRHFVTTRTPTQVASHAQKYFIRQTNVSKRKRRSSLFDIVAEPTENGDGHTIVHRSTADAANASTHTKAVGARATNGVHKKTQHHTGGMYVNPRESTNATRSVDVQQHRVTGSALTTSLSNLADVASREAHYVASHHITQPVGAIWMHNATARAQNQQEMGTSAAIKIDEEVHPTFPMIHGAIHGAVASFRTAYGRRRDWPAEPHQPDESDGLDGATEHGLSDGGA

SEQ ID NO: 4075 - protein, 276 aa, Oryza sativa Japonica Group
MGRAPCCEKEGLRRGAWSPEEDDRLVAYIRRHGHPNWRALPKQAGLLRCGKSCRLRWINYLRPDIKRGNFTADEEDLIVRLHNSLGNRWSAIAAQMPGRTDNEIKNVWHTHLKKRLDDERKLAAAGGGGGRRPHTRKQPKAAKSAAAVKREATPSVSVDTSSGVTCSTVTESSPSSADGDHRRQQQQTQHAAVKEESFSSGGELPAAAAAPTAAADMDESFWSSTEVTGMMAGLGDMDEELAIAGTSSAAAARSDDMEFWLKMLLESGDMRDLAVL

SEQ ID NO: 4076 - protein, 346 aa, Triticum aestivum
MAPLSEHQMRLTRALAKRPKTKMLTGFGVKPTAAFSKPAQLQAQALLPGAQPPRRRVRVLYEDPDATDSDTDDEEAVAAPASSKRCFELFLGKAPPAKVFAKPVTPTAAASAVAACTTSSAEGHRGVRLRKWGKWAAEIRNPFSGKREWLGTFDTADLASAAYQAASRSFIEEKRRRRGQSVAAASPARSAASTTPTSSSTTPTASSSSSTSAAPFAHPSPSSVLEATKPAAESLSPEPTPVPVMLSTTAETAQLPDDPEFYQDLLRGLQLPDIDPMDFRAGLDALDVSEASAYLDGEQDLLLGDLADEDLELDMDLDIGDDFLEMPGCDFGRGMDDFLQTVDFCV

SEQ ID NO: 4077 - protein, 149 aa, Triticum aestivum
  misc_feature (123)..(123): Xaa can be any naturally occurring amino acid
GDDDGPEWMMEVGGAGATGKGKGGALDKNKKRFSEEQIKSLESMFATQTKLEPRQKLQLARELGLQPRQVAIWFQNKRARWKSKQLERDYSALRDDYDALLCSYESLKKEKHTLLKQLEKLAXMLHEPRGKYSGNADAAGAGDARASAA

SEQ ID NO: 4078 - protein, 410 aa, Vitis vinifera
  misc_feature (357)..(390): Xaa can be any naturally occurring amino acid
MASPSELSLDCKPHSYSLLLKSFGDQPDQTQKLEDFLARLEEERLKIEVFKRELPLCMQLLTDAVEASRQQLQSYRANQGARPFLEEFIPLKHSTPKGSEKTSNMSDKANWMTSAQLWSPAGDETKQQSTLTSSKEPDIGFTVSPKLGFDNKQRNGGAFLPFSKERNSCPSPNLRVVNGGATMEQVKAAITPSEAQTTAAAPTANTQTHRKARRCWSPDLHRRFVNALQMLGGSQVATPKQIRELMKVDGLTNDEVKSHLQKYRLHTRRPSPSPQATGAAAPQLVVVGLGGIWVPPEYATAAHTGGTTLYGAHPPSHTSPHYCGPPVPQDFYAAPAQPHHHSLHHQLHMYKASPQTXXXXXXXXXXXXXXXXXXXXXXXXXXXXXXXXXXQTQSSPDFRHEGGRRPFGEH

SEQ ID NO: 4079 - protein, 135 aa, Brassica napus
  misc_feature (19)..(19): Xaa can be any naturally occurring amino acid
NNLSSSQIHQIQSQIHHSXPLLRAKPLLMKQPGVAGSWFPAKPTKLYRGVRQRHWGKWVAEIRLPRNRTRLWLGTFDTAEEAALAYDKAAYKLRGDHARLNFPNLRHNGSYIGGEFGEYKPLHSTVDAKLEAICQ

SEQ ID NO: 4080 - protein, 396 aa, Zea mays
MDSASSLVDDTSGSGGGACTDKLRALAAAAASASGPPPERMGSGASAVVDAAEPGAEADSGSAPASVAAVAAGVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASAATASSLANNPSSYASLSPATATAAAAAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVVAASTAGPSPPAPVAKAVRLFGVDLLTAPAAAAAPAEAVAGCKRARDLGSPPQAAFKNQLVELALV

SEQ ID NO: 4081 - protein, 949 aa, Oryza sativa Japonica Group
MAIGVMMTSDNGKAPEKGGEASGPSSAPQEGEISNEPQRRRPLSGRTTGPTRRSTKGNWTPEEEDDIIVQMVNKLGPKKWSTIAQALPGRIGKQCRERWHNHLNPGINKEAWTQEEEITLIHAHRMYGNKWAELTKFLPGRTDNAIKNHWNSSVKKKVDSYMSSGLLTQVSCLPLNEYSAHCNSSPALTQQNSEDSGSYAVREVENSSVCSQSSLAKVSCSQVHNANVALGCDLQVNANVDNNEAHDSQSSVGHEACYTSVGAVATAIPEVHYHVSSSNFDPDQHLQEEFAQGLNLHMSMDEVPSNSSFADNPTICSIENHERSLEPYDVAMEMPLSMLPSDSGAEQKLHFMSEADFNSPNCLKSELWQDISLQSLLSGPDAVETDSFSRSNHQSDVYSSQADNEFLAPPYLLQTSNSSSVMEATYGQSPQMSVPPSLICSNVMTDVPSDNRSEPKEMTVSQAEMVTQSSSSSGDAEMSANPGSSNGSDIPSMMERIPECADQHVTNAEEPEASIEKEPSVTPSATADEKQDEGALFYEPPRFPSMDVPFVSCDLVTSGDLQEYSPLGIRQLMRSTMNVCTPMRLWGSPTHDESPDILLKSAAKSFICTPSILKKRHRDLVSPIPDKRIEKKSGTEKDCGVSDTSSIGIQTCFINATKDDAVITKSVLRIERSASSKPLEKKLEFSDENKENLDNTIEQAKDGQSAGNYKHIDEQARGERRTATNITTTYDDLPGNLQPAGILIEHNGDDLVSPDYGKNTMKQKQNTNMESLSVCKEGVSAKKPAELIVEKSSACINVDYEYVNILADTPGIKRGLESPSAWKSPWFVDMQFQGSYFVSPANGSYDALGLVKQINVQTAAALAEAREVLASGGQSENINSDKENLENPDAKKEPGATTKLQAKIKTEGKILDFNECATPIRSSDKKAGSSLGRSLSSPIPSSHLLKSFR

SEQ ID NO: 4082 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQGQWDQQNQGHNMPPPLPPQQHQIQHPYMLSHQPSPFLNMGGLYQEDDPMAMRRNDLELTLEPVYNCNL

SEQ ID NO: 4083 - protein, 194 aa, Vigna radiata var. radiata
MAKEGLGLEITELRLGLPDAEHVAVANKNGEKKNKRVFSEIDDVGDENSSSGGGGDRKMENKNQVVGWPPVCSYRKKNSVNEASKMYVKVSMDGAPFLRKMDLGMHKGYSDLAFALEKLFGCYGMVEALKNVENGEHVPIYEDKDGDWMLVGDVPWEMFMESCKRLRIMKRADAKGFGLQPKGSLKGFIESVGK

SEQ ID NO: 4084 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKTKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 4085 - protein, 174 aa, Arabidopsis thaliana
MEKMMHRETERQRRQEMASLYASLRSLLPLHFIKGKRSTSDQVNEAVNYIKYLQRKIKELSVRRDDLMVLSRGSLLGSSNGDFKEDVEMISGKNHVVVRQCLVGVEIMLSSRCCGGQPRFSSVLQVLSEYGLCLLNSISSIVDDRLVYTIQAEVNDMALMIDLAELEKRLIRMK

SEQ ID NO: 4086 - protein, 317 aa, Arabidopsis thaliana
MPTLYKKAGCQFQLTTMATPNEVSALFLIKKYLLDELSPLPTTATTNRWMNDFTSFHQTGFEFSEFETKPEIIDLVTPKPEISDFEVKSEISIESNDSFTFQSNPPRVTVQSNRKPPLKIAPPNRTKWIQFATGNPKPELPEPVVAAEEKRHYRGVRMRPWGKFAAEIRDPTRRGTRVWLGTFETAIEAARAYDKEAFRLRGSKAILNFPLEVDKWNPRAEDGRGLYKRKRDSEEEEVKVVKKVLKKEESYAVSDGENVESGLTAIDDWDYRYRRPRGGARYPIRPIARALVSIPSTSRGGPLESCFNEICETPMIA

SEQ ID NO: 4087 - protein, 209 aa, Arabidopsis thaliana
MNPSNNPKKTRHQSHMPQERDETKKEKKLLHRNIERQRRQEMAILFASLRSQLPLKYIKALSSQGKRAMSDHVNGAVSFIKDTQTRIKDLSARRDELKREIGDPTSLTGSGSGSGSSRSEPASVMVQPCVSGFEVVVSSLASGLEAWPLSRVLEVLHGQGLEVISSLTARVNERLMYTIQVEVNSFDCFDLAWLQQKLIEQLVLSTTRH

SEQ ID NO: 4088 - protein, 246 aa, Helianthus annuus
SYMSSCPFKKNEIFFANKTIYEAALSSSTLHIVDFGIAYGFQWPILIKHLGDRPGGPPKLRITGIEFPQPGFRPAEWVEETGRRLATYCERFKVPFEYNAIAIQSWEMINIDDLKLQRNEFLAVNALARFENLLDETMVTGSSPRDAVLKLVRDMKPDIFVHSIVNGSYSAPFFVTRFREALFHYSALFDMLDATIERENEQRQSYEGEFHGRQVMNVIACEGHQRVERPETYKQWQVRITRAGSN

SEQ ID NO: 4089 - protein, 805 aa, Zea mays
MAWAFVLVTSHEQRNHQLLSNPPVNLKQPKRRAEMVFQKRSSSELEASGGGQVAEMPRVPKSARGKRSVRKKEAQNPPQMSAFDLLATVAGKLLDEGVGSLGNMSAGAPALTACAKDVRVKKEQCDEEMKQFKHEVTDQDSCNESAILPHIVFQRAVNNARNEDPKAKSEAQDKESSMISCTKAELGCNFGVIADRWSPESVESGAFTGDAVASLMPPAPAGFHKNAPEMYNLLDSMDVDVKPPPLVSSDSTGEMPLYGDKVHRSTSLPRVSKGVGFFAVDRDDDDDKSSGCTHPSTTTNKDFRSNCTAEYSRVRKLLTSKYRKVAPARVYKSDLSYSDVDRKPSFRNKKMHYTRQRTQRSTFKRRKLFDRHSVLASEFGTAHGKGNTKKVTGRDSHAVSLEANKGTSSTPFQKSRGSNDCHVKLKIKSFKVPELLVEIPESATVGSLKKTVLEAVTAILGGGLRVGVLHHGKKVRDDNKTLIQAGIGQEDMLDNLGFSLEPNCTQNPQVQAPEDISFLETIDTAEPLARIAPADSSSKHGEVDLSQEFALTPLAMNYQGSDHDSVHSPGGVSSPDKVSTNSRALVPVPAADPNAGAIVPANKSKRSPEQGQRRIRRPFSVAEVEALVLAVEKLGTGRWRDVKLRAFDNAKHRTYVDLKLVLFPRISFVVWLGHVSFSTRMLHLETKETHSCTSTNPIRTLEKKQVQLRDQITFPLLDWKLLGCFALYIAAFSGNGLTVSKLWCEQDKWKTLVHTASISPQQRRGEPVPQELLDRVLAAQAYWSQQQAKLQPKTPPLLAEARLLT

SEQ ID NO: 4090 - protein, 782 aa, Oryza sativa Japonica Group
MDTPDRAAAAARAEDSPLFSFIDSLSPIEPLKSAYSASSIQAYQSLNITSISSIFTSPHDNAQKESKLSKSSFAEFSESEVCADESDKNKPSKSSNAVRLFACTSTLTQATHKITSSVSEGTVGPPEGSNDLPQPGQFDSGSPDHNTTPCHGVRSDLKQGKCRKLQAFQTAKTNTSEKRKCLFSTEVQLMDGCQPEKLNDEILGCDWDDLISATSGELIAYDEDHKGVQLAVSNAESCGFLLSKLTGDGDISDRTHPSSSTQTYYRELLMDEDQTENAQLVPDGEKNISTEEIQDNLYEANGSIPTGYKVETQQQRGMRRRCLVFEAAGYSNRIVQKESVMDLSVSTCKGKSPVQNHSNPGKTPSPRVLRGIGLHLNALALTSKDKMICQDPMSSLVPSSATQQEAHGKMLSAGENFIHPGGELLELQMDDDCSAGVFLGNDHDSSQSNSPQKKRRKSDNGDDGEACKRCSCKKSKCLKLYCECFAAGVYCSEPCSCQGCLNKPIHEEIVLSTRKQIEFRNPLAFAPKVIRMSDAGQDITGEDPNNTPASARHKRGCNCKKSSCLKKYCECYQGGVGCSSNCRCEGCKNTFGKRDAAVSTEAEEMKQGGEEAENCGKEKENDLQKANAQSEDHPFLELVPITPPFDVSSSLLKPPNFSSAKPPRPTKARSNSSRSSSKAPGAVHSQKFSKIANSGLNEEMPDILRDDASPGNCVKTSSPNGKRVSPPHNALSVSPSRKGGRKLILKSIPSFPSLIGDASSGSSMNSSESAFNTASPLALGPS

SEQ ID NO: 4091 - protein, 302 aa, Arabidopsis thaliana
MNHNSKMIRSMFTTSDFSNHRDLFSSSPSFSCYQNSHVSSSSFGFNNSQVMRRNIDYVSSTDYLPIKDNPHLTRVSFTQTITNRYSSIVPTNSLDAVQYDIELVKRAMDSKPNIWNPVFYPPNFLGKQCEILNPEPLNVIFPHQNSGDRQYLNMFSLSSKHNHDQNVFHEGRSSTKIPKPTMSIEKTTEYIDCEENEKSDDAQYDGRIHSLPYKKYGPYTCPKCNSIFDTSQKFAAHMSSHYKSETNKERAQRFRARNKRKYRKLNLEVYGESQKIKQEDGVHNDGRSDDKPIQHHKILFRG

SEQ ID NO: 4092 - protein, 194 aa, Solanum demissum
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEEEELEAQNPLFVNPTFQSQ

SEQ ID NO: 4093 - protein, 656 aa, Physcomitrella patens subsp. patens
MAFMSPAPDQATVFGGLVKKSMSIPSSFNTAAMSPTDSMNSLYSLEKQLVGQPRSNAALSGVPGVSGFSRSATNYWGHATSTDMQQILGDSASVSPQEALGSGMVSSDWQQLLDAKSSAYKYPPGVSAAATPARGGIMENARIREMLTGRVGGSPVPHKSWSPLDTVAAGIAVDQSKGGLALHGVDLATSHCLAQFTSDPAFAERAAKFSSFGNGKYPQIALSLPVNDAHCKPRSRSSESGCKSSRTTCNPNSAKKSTATVAAGMEENTAAAPAAASVLAAPAAADRSCDMDVDGVGNNDKSPTRTASVPELEAIEGASLVTMDRTHELAEVAAGLEPNNSSSVTEQQQASAASPARSPTGSDDSDRRKRKSSSADKLDVDSKAADVADSQPKRCKGDNDDLVKAKAERSSSENSGDSGSPRAHKENNSSKDHAKQDYIHVRARRGQATDSHSLAERVRREKISERMKYLQDLVPGCSKVTGKAVMLDEIINYVQSLQRQVENLSMKLASVNPGPSSTRIDHNFETTMNKDMLQSQMSGSLGGSESTTTFGMMQQHQHQPQPQGHMMNGHCGLDFRAMGTSMDGYLRRSNSAPIRVQSGITSLDSFGDDVSQSIGWDGELQSIVNQMGFSFQGRYGSSPLDSLQCQLPVGHMKVEM

SEQ ID NO: 4094 - protein, 131 aa, Picea sitchensis
MKTVTGTGAINNYQSSASQQQPRRCTHCLSQRTPQWRLGPLGPKTLCNACGVRFKSGRLFPEYRPAKSPTFIRYIHSNSHKKVLEMRNQEADDLESLVFDPQLSDGKQQDQGLLKVKIKLTGLDNLSFQSN

SEQ ID NO: 4095 - protein, 504 aa, Oryza sativa Indica Group
MASNATRNTDPDQQGVRFSSTDQPPCFARPGQSFPAFPPLFGVQSSSLYLPDDIEAKIGNQFESNPSPNNPTMDWDPQAMLSNLSFLEQKIKQVKDIVQSMSNRESQVAGGSSEAQAKQQLVTADLTCIIIQLISTAGSLLPSMKNPISSNPALRHLSNTLCAPMILGTNCNLRPSANDEATIPDISKTHDYEELMNSLNTTQAESDEMMNCQNPCGGEGSEPIPMEDHDVKESDDGGERENLPPGSYVVLQLEKEEILAPHTHFCLICGKGFKRDANLRMHMRGHGDEYKTAAALAKPSKDSSSESAPVTRYSCPYVGCKRNKEHKKFQPLKTILCVKNHYKRSHCDKSYTCSRCNTKKFSVIADLKTHEKHCGRDKWLCSCGTTFSRKDKLFGHVALFQGHTPALPMDDIKVTGASEQPQGSEAMNTMVGSAGYNFPGSSSDDIPNLDMKMADDPRYFSPLSFDPCFGGLDDFTRPGFDISENPFSFLPSGSCSFGQQNGDS

SEQ ID NO: 4096 - protein, 324 aa, Arabidopsis thaliana
MVAIRKEQSLSGVSSEIKKRAKRNTLSSLPQETQPLRKVRIIVNDPYATDDSSSDEEELKVPKPRKMKRIVREINFPSMEVSEQPSESSSQDSTKTDGKIAVSASPAVPRKKPVGVRQRKWGKWAAEIRDPIKKTRTWLGTFDTLEEAAKAYDAKKLEFDAIVAGNVSTTKRDVSSSETSQCSRSSPVVPVEQDDTSASALTCVNNPDDVSTVAPTAPTPNVPAGGNKETLFDFDFTNLQIPDFGFLAEEQQDLDFDCFLADDQFDDFGLLDDIQGFEDNGPSALPDFDFADVEDLQLADSSFGFLDQLAPINISCPLKSFAAS

SEQ ID NO: 4097 - protein, 1043 aa, Arabidopsis thaliana
MTNQQEQHIAIFTTASIPWLTGTAVNPLFRAAYLANDGERRVTLVIPWLTLKHQKLVYPNSITFSSPSEQEAYVRQWLEERVSFRLAFEIRFYPGKFAIDKRSILPVGDISDAIPDEEADIAVLEEPEHLTWFHHGQKWKTKFNYVIGIVHTNYLEYVKREKQGRVKAFFLKYLNSWVVGIYCHKVIRLSAATQEYPKSIVCNVHGVNPKFLEIGLRKLEQQKLQEQPFTKGAYYIGKMVWSKGYKELLKLLEKHQKELAELEVDLYGDGEDSEEIKEAARKLDLTVNVYPGRDHADSLFHNYKVFLNPSTTDVVCTTTAEALAMGKIVVCANHISNKFFKQFPNCRTYDDGQGFVRATLKALGEQPSQLTEQQRHELSWEAATQRFIKVSDLNRLSRADSNLSKRSVFASSSISVGKNLEDMSAYIHFLASGFEASRTAFGAIPGSLQPDEELCRDLESESDNNTDDVTPIFAIDDSSKGYRRVSGPTRRSTKGGWTAEEDQILTNVVKKYQGRNWKRIAECLPGSEENRRNDVQCQHRWLKVLDPSLQKGAWKKEEDELLSELVKDYMENDRPPWSKISKELPGRIGKQCRERWHNHLNPTIIKSPWTREEELILVQAQRGNGNKWAEIAKLLPGRTENNIKNHWNCSVKKRLEQFPSNLFSGVVYGSKPSSGFEYNFFNQRNTMVESCITSQIKEAAKSPQRDFLDLTLGLNWRSISSSTSSLRGEESVSSSVDSVCARLNGKAEILSHWIRSTIDHHMLTSLYVKVSACLETPQNSNNDTVCVKEVREMKERLRMAARTFDTPSIISKTSSPASGLKRLRQKYDTPFPTDARSHMSSEEDHSVSASPSSKYRFVKRNTCSGSKPLERRLDFDFLKKEAQSLYLESILCVMSRKIQITAVSAENLVDGRKPVNKNAFVVFDMAGNYWKQPMRTSVDEVGGNCPMWEDELETEFSSEEKATSVMYVQVLCRSSGKDKRVGTARVPVKDFTGEYAPEGFMHCLSYRLWDEHGRRNGIVNFSVRILPQKSDLKSGLVRPFWLR

SEQ ID NO: 4098 - protein, 299 aa, Oryza sativa Japonica Group
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERSRADPTMLVVTYTSDHNHPWPTHRNALAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 4099 - protein, 942 aa, Oryza sativa Japonica Group
MEQKPSPPPPPRSDEEEDGLMGCGMGGTGDIAGGDLDLMEEFLLATPGFDLSEFWHPGAASPFSPLFDIGSSVTTLTTPAPAAGEDDRDEAEMPSRGGGGLEVSPAHRGWTFQTAPQEVAVEPTVKERLRRALERIASQSQSQAQRGDGELLVQVWVPTRIGDRQVLTTCGQPFWLDRRNQRLANYRTVSMKYQFSADESARADLGLPGRVFVGRVPEWTPDVRYFSTEEYPRVQHAQYFDIRGSVALPVFEPRSRACLGVVELVMTTQKVNYSAEIENICNALKEVDLRSSDVSSDPRSKVVDASYRAIIPEIMDVLRAVCDTHNLPLAQTWIPCICQAKRGSRHSDESYKHCVSTVDEACYVRDCSVLGFHQACSEHHLFRGEGVVGRAFGTNEPCFSPDITTYSKTQYPLSHHAKLFGLRAAVAIQLRSVKTGSLDFVLEFFLPMKCINTEEQRAMLNSLSNTIQQVCYTLRVVKPKELVNDGPFEISQPTRPEFYAKSVHEDLDELCSGINVPGRTTSLEASEEVSSWIASLVDAQNKGGKGEIDVDLPFGFSKQDDEGFSVTAGWHTSPVMAPDGSMFSGFKRHEDYDVKENTCSSDPSNSNSDKAVEKRRTKTEKTVSLQDLRKHFAGSLKEAAKNLGVCPTTLKRICRQHGINRWPSRKIKKVGHSLKKLQMVIDSVHGPEGTVQLSSLYENFTKTTWSERELQGDVHFPASEQNFQLEPSVPDRPCEGRFTSHTSGSNSISPSCSQSSNSSLGCSSVPKTQQQHGSAPQLAVKEEISMDENQCSTLIKSASHAEAELQMFVEERPTMLFRSQSQVLLSEHKPIENMSNVQKARSDSLKIKAIYGEERCIFRLQPSWGFQRLKEEIVKRFGISQDTHVDLKYLDDESEWVLLTCDADLLECIDVYKSSSNQTVRILVNPSIQPLLNASFGQTGLS

SEQ ID NO: 4100 - protein, 808 aa, Oryza sativa Japonica Group
MPPAAMAPPPPPQGSSTGDPLYDELWHACAGPLVTVPRVGDLVFYFPQGHIEQVEASMNQVADSQMRLYDLPSKLLCRVLNVELKAEQDTDEVYAQVMLMPEPEQNEMAVEKTTPTSGPVQARPPVRSFCKTLTASDTSTHGGFSVLRRHADECLPPLDMTQSPPTQELVAKDLHSMDWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSVGMRFRMRFEGEEAPEQRFTGTIIGSENLDPVWPESSWRSLKVRWDEPSTIPRPDRVSPWKIEPASSPPVNPLPLSRVKRPRPNAPPASPESPILTKEAATKVDTDPAQAQRSQNSTVLQGQEQMTLRSNLTESNDSDVTAHKPMMWSPSPNAAKAHPLTFQQRPPMDNWMQLGRRETDFKDVRSGSQSFGDSPGFFMQNFDEAPNRLTSFKNQFQDQGSARHFSDPYYYVSPQPSLTVESSTQMHTDSKELHFWNGQSTVYGNSRDRPQNFRFEQNSSSWLNQSFARPEQPRVIRPHASIAPVELEKTEGSGFKIFGFKVDTTNAPNNHLSSPMAATHEPMLQTPSSLNQLQPVQTDCIPEVSVSTAGTATENEKSGQQAQQSSKDVQSKTQVASTRSCTKVHKQGVALGRSVDLSKFSNYDELKAELDKMFEFDGELVSSNKNWQIVYTDNEGDMMLVGDDPWEEFCSIVRKIYIYTKEEVQKMNSKSNAPRKDDSSENEKGHLPMPNKSDN

SEQ ID NO: 4101 - protein, 137 aa, Mycobacterium sp. JLS
MLGRAGRDQTRRNRSPNPAMTHYWRVRRMLSIPGACAVALVFAAGLTPIIPTANATVCGSVGGRHVDISGCSDPFAYLNEALPPPPPPPPPPPPGAPPPPPPPPPPPPPPVYVPPPPVGNIDACVNVGRRISVSGCI

SEQ ID NO: 4102 - protein, 244 aa, Triticum aestivum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAAATSIHPAAAGERAGDAAVQPQAPPRTGLPLWMVSHING

SEQ ID NO: 4103 - protein, 251 aa, Arabidopsis lyrata
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLNAMSPKELQNLEQQLDTALKNIRTRKNQLMYESINELQRKEKAIQEQNSMLSKQIKEREKILRAQQEQWDQQNHGHNMPPPPPPQQHQIQHPYMLSHQPSPFLNMGGLYQEEDPMAMRRNELELTLEPVYNCNL

SEQ ID NO: 4104 - protein, 618 aa, Nicotiana tabacum
MMMFEEMGFCGDLDFFPAPLKEVETAASQIEQEQEQEPVMDDDYSDEEIDVDELERRMWRDKMKLKRLKEMTKGGKEGVDAVKQRQSQEQARRKKMSRAQDGILKYMLKMMEVCKAQGFVYGIIPEKGKPVTGASDNLREWWKDKVRFDRNGPAAIAKYQADNAIPGKNEGSNPIGPTPHTLQELQDTTLGSLLSALMQHCDPPQRRFPLEKGVPPPWWPTGQEDWWPQLGLSKDQGPPPYKKPHDLKKAWKVGVLTAVIKHMSPDIAKIRKLVRQSKCLQDKMTAKESATWLAIINQEEVLARELYPDRCPPLSSAGGSGTFTMNDSSEYDVDGVVDEPNFDVQEQKPNHLGLLNVNVDRFKERLPMQQQSLPIKDEIMIANLDFTRKRKPADELTFLMDQKIYTCECLQCPHSELRNGFQDRSSRDNHQLTCPFRNSPQFGVSNFHVDEVKPVVFPQQYVQPKPASLPINQAPPSFDLSGIGVPEDGQRMINELMSFYDNNIQGNKSSMAGNVVMSKEQPRQQPSIQQNNYLHNQGIILDGNIFGDTNISANHSMFPQGDRFDQSKVLTSPFNAGSNDNFHFMFGSPFNLQSTDYTEALSGITQDNMPKQDVPVWY

SEQ ID NO: 4105 - protein, 616 aa, Nicotiana tabacum
MMMFEEMGFCGDLDFFPAPLKEVETAASQIEQESEPVMDDDYSDEEIDVDELERRMWRDKMKLKRLKEMTKGGKEGVDAVKQRQSQEQARRKKMSRAQDGILKYMLKMMEVCKAQGFVYGIIPEKGKPVTGASDNLREWWKDKVRFDRNGPAAIAKYQADNAIPGKNEGSNPIGPTPHTLQELQDTTLGSLLSALMQHCDPPQRRFPLEKGVPPPWWPTGQEDWWPQLGLSKDQGPPPYKKPHDLKKAWKVGVLTAVIKHMSPDIAKIRKLVRQSKCLQDKMTAKESATWLTIINQEEVLARELYPDRCPPLSSAGGSGTFTMNDSSEYDVDGVIDEPNFDVQEQKPNHLGLLNVNVDRFKERLTMRQQSLPIKDEIIIANLDFTRKRKPADELSFLMDQKIYTCECLQCPHSELRNGFQDRSSRDNHQLTCPFRNSPQFGVSNFHVDEVKPVVFPQQYVQPKPASLPINQAPPSFDLSGLGVPEDGQRMINELMSFYDSNIQGNKNSMAGNVVMSKEQPRQQPSIQQNNYLHNQGIVLDGNIFGDTNISANHSVFPQGDRFDQSKVLTSPFNAGSNDNFHFMFGSPFNLQSTDYTEALSGITQDNMPKQDVPVWY

SEQ ID NO: 4106 - protein, 300 aa, Nicotiana tabacum
MMMFDDMRFCGDLDFFSAPLKEVEAAAPQTEPEPEPVVDDDYSDEEIDVDELERRMWRDKMKLKRLKEMTKSKEGVDPAKHRQSQEQARRKKMSRAQDGILKYMLKMMEVCKAQGFVYGIIPEKGKPVGGASDNLREWWKDKVRFDRNGPAAIAKYQADHAIPGMNEGSNPVGPTPHTLQELQDTTLGSLLSALMQHCDPPQRRFPLEKGVSPPWWPTGQEDWWPQLGLQKEQGPPPYKKPHDLKKAWKVGVLTAVIKHMFPDIAKIRKLVRQSKCLQDKMAAKESATWLAIISQEEALA

SEQ ID NO: 4107 - protein, 629 aa, Vitis vinifera
MEVASDPQYHHQTQPAAAAVSSAVPTSFFLSPHLNSSAIYYGVGENGAFHSHLSVMPLKSDGSLCIMEALSRSQQEGMVPTSSPKLEDFLGSATMATHQYGGHEREAMALSLDSMYYHQNAEPETSRQHSLNLLQESFRQQGQQQIPVQHHPYFTGLACNGIYQNPLEEETKETQLADCHTQIPPMGEDGMPCLKNWVARHYSTHHALEQQMNNSIVDDGGAPGSIGAMGCGDLQSLSLSMSPGSQSSCVTAPRQISPTGAECVAMETKKRGSGKVAQKQPVHRKSIDTFGQRTSQYRGVTRHRWTGRYEAHLWDNSCKKEGQTRKGRQGGYDMEEKAARAYDLAALKYWGPSTHINFPLENYQEELEEMKNMSRQEYVAHLRRHHQHGRWQARIGRVAGNKDLYLGTFSTQEEAAEAYDVAAIKFRGVNAVTNFDITRYDVERITASNTLIAGELAKRSKGKEPSREAIDYNPPQNSGEAIQSESNNGNGTDWKMALYQSPQQQPSSCVESLEQKPMSIGGYRTTSFSMALQDLIGIDSVNTSQPIGDESTKLGTHFSNPSSLVTSLSSSREASPDKTGPAMLFAKPPLASKLMGPASALSSWIPTSQLRTAAVSMAHLPLFAAWNDT

SEQ ID NO: 4108 - protein, 277 aa, Vitis vinifera
  misc_feature (117)..(117): Xaa can be any naturally occurring amino acid
  misc_feature (151)..(151): Xaa can be any naturally occurring amino acid
MDATMDDEQVVLPGFRFHPTDEELVSFYLRRKIEKKPISFELIKQTDIYKYDPWDLPKNSSVTDKEWYFFCKRGRKYRNSIRPNRVTGSGFWKATGIDKPIYSVQGRAHDCIGLKKXLVYYRGSAGKGTKTDWMMHEFRLPADQKNTTPHXATAADEEVEIWTLCRIFKRNVSYRKSTPDWRETSAKRKPTNSRPKTGNMDSENWEGYISFGAPEALDNEKKLFVGHNMNERNQFHVVSEPESCSSVLSDEAREFLVHGNWDEIVPAMDCAFDPYYF

SEQ ID NO: 4109 - protein, 662 aa, Dianthus caryophyllus
MSFFENMGYYPNFEFPPQATVVREEEPVAEVEQEGNDEDYSDDDVDVDELERRMWRDKMLLKRLKEQNKDRCREGIDNVKKRQSQEQARRKKMSRAQDGILKYMLKMMEVCKAQGFVYGIIPEKGKPVSGASDNLRAWWKDKVRFDRNGPAAIAKYQADHLVQGMDEDCTAMGSTPHTLQELQDTTLGSLLSALMQHCDPPQRRFPLEKGHPPPWWPVGNEIRLPGLGIPNDQGPPPYKKPHDLKKAWKVSVLTAVIKHMSPDIEKIRKLVRQSKCLQDKMTAKESATWLAIVNQEESLARKLFPDRCPPPAPGGGGSLVISDTSDYDVDGAGPDSSSDVEDCKPQNINVFNFREKFMGHPVNMITPAIKGEVVETGFDFPVKRKQPSSGSQTVIDQKVFLCENPQCPYNDPCLGFPDRILRHDHQLNCPFRSRGVEVTNTQTTLEKHPSSESTNFTSSFAQQEKFSLQSAMQSPATFNPCTGTVLETGDQLQQNMQRKTTDGRFVGQGSALYGNSTYLGQQSQFQIDNVGFFASHGGNGSQGMFVNGKNNNQVKQKPSLQMSNGFNGVSPSRQQMQAPMDGGFRGLSNMSGNIPQRTKTSAGHPVFSSGGMQQQQQLDQCRTFDSSFPMHLNDDITDFGFNSPFNIDFEPLLRPDNPIWNI

SEQ ID NO: 4110 - protein, 307 aa, Raphanus sativus
MASRLCDSCRSAAATLYCRADAAFLCGECDGKIHTANKLASRHERVLLCQICEQAPAHVTCEADAAALCVTCDRDIHSANPLSRRHERVSVTPFYDAPAQGGSPATTKSAASSNLFGEDADVSMEAVSWLLPNPSVKEGVVVEIPNLFADLDYSAVDPKMEASENSSGNDGVVPVQTKALFLNEDYFNFDVSASKTTFPHGYSCINQTVSSTSLEVPLVPEGGAVTTTNATPAVQLSPAEREARVLRYREKRKNRKFEKTIRYASRKAYAEVRPRIKGRFAKRTDSRVNDGGGDVGVYGGFGVVPSF

SEQ ID NO: 4111 - protein, 221 aa, Oryza sativa Indica Group
MEVGNGKCGGGGAGCELCGGVAAVHCAADSAFLCLVCDDKVHGANFLASRHRRRRLGVEVVDEEDDARSTASSSCVSTADSASSTAAAAALESEDVRRRGRRGRRAPRAEAVLEGWAKRMGLSSGAARRRAAAAGAALRAVGRGVAASRVPIRVAMAAALWSEVASSSSRRRRRPGAGQAALLLRLEASAHVPARLLLTVASWMARASTPPAAEEGWAECS

SEQ ID NO: 4112 - protein, 597 aa, Zea mays
MTNENNGNGTNPASASGWLGFSLSPHMASAMDEHQHQHQHHNGLFFPSVTAAYGLGGGDGVVAASASPYYTPQLASMPLKSDGSLCIMEALRRSDQQDHHGPKLEDFLGAAAQSQAMALSLDNPAAAASSFYYYGGGGGPGHQHGFLQPCGDLYGGTSAASLVSADDEAAAATAMASWVAAARAESGVLSAAAAAGHHHALALSMSSGSLSSCVTAHPAAPEYGAAAAALDGGRKRGGAAGQKQPVHHRKSIDTFGQRTSQYRGVTRHRWTGRYEAHLWDNSCKKEGQTRKGRQVYLGGYDVEEKAARAYDLAALKYWGPSTHINFPLEDYQEELEEMKNMTRQEYVAHLRRKSRGASRRASWRRGASRHHQHGRWQARIGRVSGNKDLYLGTFGTQEEAAEAYDVAAIKFRGLNAVTNFDLTRYDADRIMASSTLLPPDLARRRKDDDPDCGVTAAAAALVQQAAAAAAAAAPPPPPRDGSQHQHHHDVLSGEACFSVLHDLVATAADGGHHHSNAAQHVPVSSAASSLLTSIGNGNYREGSPDRGLSMLFSKPPPAHAASAKPVSPLGSWASTAASARAAVSIAHMPVFAAWTDA

SEQ ID NO: 4113 - protein, 219 aa, Pyrus x bretschneideri
FSKRRTGLLKKAHEISVLCDAQVALIVFSNKGKLFEYATDSCMEQILERYERYSYAERQLVEPDFESQGNWTFEYSRLKAKVEVLQRNHRHYLGEDLDSLNLKEIQNLEQQLDTALKQIRLRKNQLMHESISELQRKRKAIQEENNLLAKKIKEKEKAAAQPQVQNWEQQNHGLDLLPQPLPCLNNGGTQQDEFLQVRRNQLDLTLEPLYECHLGCFAA

SEQ ID NO: 4114 - protein, 287 aa, Zea mays
MDAEWSGDESKAGAAGGVSSADCPSSPPPVSPAPPSTSPAATGAGRRRSANKRVVTVPLADVSGPRPKGVGEGNTPTDAWAWRKYGQKPIKGSPFPRAYYRCSSSKGCPARKQVERSRAEPDKVIVTYSFEHSHSEAMAAARAQNRQAPKPKPAQPQPVPPESPSSGSHDVAAAATVVCAPAAAETEAGAAAVEVHDEFRWLYDGVSVTSSASPPDVEAADEMLYGAMFFGAPPAPLPDEFGDVGGLFDGEGGEEDAMFAGLGELPECAMVFRRHAGDGISVAGRVK

SEQ ID NO: 4115 - protein, 532 aa, Solanum demissum
MEVNLRGLSNSFSFSFSRAPWDAIDGRKPVPWVFLVALYFILIEFTLDYILMKYAFFTIPQNQVEGAQQGASSMISSKLETVATQGKAPTCLANENVLKARKPYTITKQREKWTEEEHQRFLEALKLYGRAWRQIEEYVGSKTAIQIRSHAQKFFAKIARDSGNDGDESLNAIDIPPPRPKKKPLHPYPRKIADSSVANKAVSSQPERSPSPNASGRDSCSPDSVLPAIGLGAAEYSAAEQQNSRFSPVSCTTDAHTANVISAENDGESMSSNSNTVEEIHVALKPVAASTCPITNSEFMCYLGCTRMTYLRCVCAFFQECDIVHMENSCNGEKLAVEPPSASIKLFGKTVFVPDANNLAPPALYNTEKEIEISNEDVLHAFQANQANSPFILAMVPGNMIPPASWLSQNMLENNPESTAAFPAATISWWSWYQDLIYRSISSCGQTAVGTAAHCQGPKDEEPQREGSSTGSSIGSASEVDDGNRSSETVESKCTTKSKGFVPYKRCLAERDGKSSGAVLEERESRRVRVCS

SEQ ID NO: 4116 - protein, 411 aa, Oryza sativa
MYHQHQGRSDLFTTRTSFPMERHLFLHGGNTQGDSGLVLSTDAKPRLKWTPELHQRFVDAVNQLGGAEKATPKTVMRLMGIPGLTLYHLKSHLQKYRLSKNLQGQANVGTTKNALGCTGVADRIPGTSALAMASASAIPQAEKTIQIGEALQMQIEVQRQLIEQLEVQRHLQLRIEAQGKYLQAVLEQAQETLGKQNLAPASLEDAKIKISELVSQVSNECLSNAVTEIRESSSIHRLEPRQIQFVESSANNCLTAAEGFKEHRLQNHGVLKAYDDSTLFCRKQSQDQESQYSLNRSLSERRMGHLYSGKQYHKSEGSDSDTEVLHEYITPQKNGGGSTTSSTSGSKEINVEKLYLDEPSCKRQTVDYQRESKLLDFDQQSSGKNLDLNTHNIDDNDQGYRHFDLNGFSWS

SEQ ID NO: 4117 - protein, 281 aa, Triticum aestivum
  misc_feature (130)..(130): Xaa can be any naturally occurring amino acid
  misc_feature (180)..(180): Xaa can be any naturally occurring amino acid
MGRAPCCEKMGLKRGPWTPEEDKILVAHIHSHGHGNWRALPKQAGLLRCGKSCRLRWINYLRPDIKRGNFTDEEEQSIIQLHQLLGNRWSAIAARLPGRTDNEIKNVWHTHLKKRLDLSAQEQHEEAKKXRKKPAAAARKRDGKVKMRKLDALTAKAAPVLSSPERSVSSTVTESTSKAXSGGGDSTENSGSSASASASVKEECFTSSEESEEFQIDESFWSETLSMPLDDINDVCMEPHDAFGKPAGADGGDMDYWLKVFMEGGGDDDDNNDGALDLPQV

SEQ ID NO: 4118 - protein, 201 aa, Picea sitchensis
MVRGKTQMKRIENASRRQVTFSKRRNGLLKKAYELSVLCDAEVGLMIFSSSGKLHEFASPSMQKMVERHHSTHNTTNEQDNKGLNRKITNMEEKIRILELTQRKMSGEDLRTCSMKELNQLEVQIERGLRHIRARKTEILLGQVEELKRKECLLLEENTFLRKQVLAMNAIGFGSVQYFEVEVETQLDIRPPVCTRSPSCK

SEQ ID NO: 4119 - protein, 257 aa, Picea glauca
MGRSPCCEKAHTNKGAWTKEEDDRLIAHIRAHGEGCWRSLPKAAGLMRCGKSCRLRWINYLRPDLKRGNFSEEEDELIIKLHSLLGNKWSLIAGRLPGRTDNEIKNYWNTHIKRKLLNKGLDPQSHRPLGQVHSSNTTCSSLPAPEHEILAFQSPRTPEIADFFQYERSESSPIEPAASKDEEYPDLNLELCISLPVHSAPAASRASSVDRTVDSKPNSGSELCCPMGLQVNYGAQCENRYSEENASGFSSHYRLVL

SEQ ID NO: 4120 - protein, 259 aa, Vitis vinifera
MAAAIDIYSSSRTVFSEREELMKALEPFMKGFSGYDQMGLEQTRSIGLNHITPAQILQIQAQIHQWQQQHNLNFLGPKAIPMKQVGTPPKPAKLYRGVRQRHWGKWVAEIRLPKNRTRLWLGTFDTAEEAALAYDKAAFKLRGEFARLNFPNLRHQGRIRGLQASPLLTICQNLAISQKQGNSGKPGLVADAKIESSTHQAEMISSSSSSPSPSDESSAGSSSPESDISFLDFTDSQWNDSECLTLEKFPSVEIDWASI

SEQ ID NO: 4121 - protein, 338 aa, Brassica napus
  misc_feature (104)..(104): Xaa can be any naturally occurring amino acid
  misc_feature (260)..(260): Xaa can be any naturally occurring amino acid
MLEKGKNQNLIGHISKFGLASLHICSLEFSGSEIGSPLPHLPNRSFLALNWIWVSKSHLLFFFASSPLEKSDMQDQLVCHGCRNTLMYPRGATNVRCALCHIVXNMVPLHPHPPPPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNRPNGTAAPGTMPSTSTQSTPPSQTQTVVVENPMSVNESGKLVSNVVXVGVTTGQKITQELSDLKEIISSVLVCAYYIYISLTTFLTQGKGLLRITCLSFLLGFFLIKVDAHKGFTFCPMIWHLYL

SEQ ID NO: 4122 - protein, 166 aa, Picea sitchensis
MAREKIEIKRIANASARQVTFSKRRRGLFKKAQELSILCEADVALVVFSSTGKLYDYSSSSMEVILDKYVLYPSTIQKDGQQILEFEGQDPKRIKQQFEDASQDLREELEGLTLKDLEKLEEQFEMELSCIRSQKVEHLVKKINELQQKVIQMIEENTKLRGQFNS

SEQ ID NO: 4123 - protein, 251 aa, Hordeum vulgare subsp. vulgare
MGRSPCCEKEHTNKGAWTKEEDQRLIAYIRANGEGCWRSLPKAAGLLRCGKSCRLRWMNYLRPDLKRGNFTDDEDELIIRLHSLLGNKWSLIAGQLPGRTDNEIKNYWNTHIKRKLLSRGMDPHTHRPLTAVIDAAAPTRPAQIAVPARAAPTTMFALPTKQQQPPVPVESSDDDGSSGATSTGEPRCPDLNLDLSVGPPAADTPTSHPVCLCRHLGFRGGEACSCRQADSAGSQGGGFRYFRPLEEGQYI

SEQ ID NO: 4124 - protein, 350 aa, Picea glauca
MKGKSSGHDEPDRIKGPWSPEEDAALQHFVQKCWPRNWSLISKAIPGRSGKSCRLRWCNQLSPQVEHRPFTPEEDATIIRAHAQHGNKWATIARMLSGRTDNAIKNHWNSTLRRRCQGGGALVIDDEITSGADGFRKRSLSEDADASRKLKKLSLGTTATTTTTEPCSSSASDRSDSSLALGSPPVYRPVPRAAPLSLTNEANLNPSHHEASCSSTDPPTSLCLSLPGTDAPARPTVALSALPLPGSSSPLAPPGYIKAEEAMEWMNSAINTTLTQVLSPFVAPARSHGIMPETLGSSGLLAVMQEMVAKEVRDYMSSMQHRNNNNTEFRGCVASPPPMGMRVSNSNALG

SEQ ID NO: 4125 - protein, 396 aa, Oryza sativa Japonica Group
MSISVNGQSVVPPGFRFHPTEEELLTYYLKKKVASERIDLDVIRDVDLNKLEPWDIQERCRIGSGPQNDWYFFSHKDKKYPTGTRTNRATAAGFWKATGRDKAIYSSSNRIGMRKTLVFYKGRAPHGQKSDWIMHEYRLDDPSSASASVSVNLPSYYSSSSSSSSPMHGVAGDQGAQEEGWVICRVFKKKNLVHHGGGSAAASHHAAAKLAAAAMEGSPSNCSTVTVSDHVKAQMLHSSASDDALDHILQYMGRSGLQAGDQAGGDVGVVGGSGGGAGAAPQYASVRQVHEASAARGPSPAAWASWAAAGGGGEYCSAADASGIADWDTLDRLAASYELNGALSDVASGKNMAGFFDVVDQPAGAAAFSSGDGDLWSLARSVSSSLHADLTTMNNV

SEQ ID NO: 4126 - protein, 104 aa, Hordeum vulgare subsp. vulgare
MGRSPCCEKEHTNKGAWTKEEDQRLIAYIRANGEGCWRSLPKAAGLLRCGKSCRLRWMNYLRPDLKRGNFTDDEDELIIRLHSLLGNKWSLIAGQLPGRTDNEI

SEQ ID NO: 4127 - protein, 373 aa, Picea glauca
MALSNGRSLEDLDRIKGPWSPEEDASLQRLVQKYGPRNWTQISKGIQGRSGKSCRLRWCNQLSPQVEHRPFTPSEDAAILQAHAQHGNKWATIARSLPGRTDNAIKNHWNSTLRRRCRDSDKGILVHLDDEISSLDAARKRSSDGFSHDGSSALEDNCCSSWEVDSKRLKRLGELGAEQGPDVEVELEVSDRSDSNPGRVLYRPVPVASFFGSFGKTVANLQETASGSVGVDPPTSLSLSPPGLDPAIHSPKPPSQKDFHNNSTDNNKIPTPPVVGYMRADEAVERLSTAVKATVASMLTPVLSSSPRGFNPPAVSSDVLALMRDMVAKEVHKYMSSHQPPGMYTPLSPHPEFLGAAGLVRNVVLGGALHLNK

SEQ ID NO: 4128 - protein, 302 aa, Hordeum vulgare subsp. vulgare
MGRPSSGAVGQPKVRKGLWSPEEDEKLYNHIIRHGVGCWSSVPRLAALNRCGKSCRLRWINYLRPDLKRGCFSQQEEDHIVALHQILGNRWSQIASHLPGRTDNEIKNFWNSCIKKKLRQQGIDPATHKPMASADTATAAAALPDAEEEDRKPLCPAVDGSLVPKQPAVFDPFPLCVDYGAGFAEELGAANAAALYGQLCGGKEVADDDAGFGAADYSCVLDVSENLGYGESSSNSSNWNYGGEVGSVLDGEVPHWAKPEPAFAEMERQQQHSPAEQKLSLPCQEQSLLASFDFNLELEPYF

SEQ ID NO: 4129 - protein, 416 aa, Picea glauca
MGVPKDEAAVTMAVAERIKGPWSPEEDATLHRLVEKYGPRNWSQISRGIPGRSGKSCRLRWCNQLSPQVEHRPFSPHEDATIIQAHARHGNKWATIARLLPGRTDNAIKNHWNSTLRRRYHGEKDHSNGLVVNLESAAEDKEAMISLTAPAMVPALVFAAAADSSRKRSNSSCSANDNPGDAEVESRRLKRLNFSESPTSSDNNNNNNEEDTISGHCNSVAPGSSPVQQLHRPVPRQSAFNCYEAVKMHEEASASVSASGSAGAFDPPTSLSLSLPGSGSFSENNSSGECSPIEQSFETKSAKFQAYQQQTGYSFADPFPVSGYLKTEEAMAMMSTAVKIAIGQALPLIFQLSSGNSHGGCSGDSSNFGGSLLSIMREMIAKEVQNYTNGSQCSNQGPGLNSVAPVFREVGLMLKK

SEQ ID NO: 4130 - protein, 179 aa, Zea mays
MEPRFRGVRKRPWGRFAAEIRDPARKARVWLGTFDTAEAAARAYDAAALHFRGPKAKTNFPVAFAALPPPPPPKKPAAVTARVSVPAGPVARPQPSGTPAMVAAQPFLFLDPRLAVTVAVPAPVPYRPTAVAAGANKHAAASCREEEQSDTGSSSSVVDASPAVGVGFDLNMPPPAEVA

SEQ ID NO: 4131 - protein, 416 aa, Zea mays
ATLLLPLSRRDQHTLLLVPGPREGSVERASGGLGVPSVKHMFPFCDSSSPMDLPLYQQLQLSPSSPKTDQSSSFYCYPCSPPFAAADASFPLSYQIGSAAAADATPPQAVINSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAASVPSDRPSSNNLSHHSSLSMNMPCAAAELEERERCSSALSNRSAGRMQEITGASDVVLGFGNGGGGYGDGGGNYYCQEQWELGGVVFQQNSRFY

SEQ ID NO: 4132 - protein, 233 aa, Solanum lycopersicum
MKIQCDVCEKAQATVICCADEAALCAKCDIEVHAANKLASKHQRLHLQCLSNKLPPCDICQDKAAFIFCVEDRALFCKDCDEAIHSASSLAKNHQRFLATGIRVALSSSCNKESVKNQLQPQPPQQNSQQVGLKMPPQQLSCITSPSWPVDDLLGFPDYESSDKKDLLELGEFEWLGGIDLFGEQTAAEVPELSVPQSSNTNIYRTTKYQMPYKKSRIEIPDDDEYFTVPDLG

SEQ ID NO: 4133 - protein, 277 aa, Vitis vinifera
MDATMDDEQVVLPGFRFHPTDEELVSFYLRRKIEKKPISFELIKQTDIYKYDPWDLPKNSSVTDKEWYFFCKRGRKYRNSIRPNRVTGSGFWKATGIDKPIYSVQGRAHDCIGLKKSLVYYRGSAGKGTKTDWMMHEFRLPADQKNTTPHSATAADEEVEIWTLCRIFKRNVSYRKSTPDWRETSAKRKPTNSRPKTGNMDSENWEGYISFGAPEALDNEKKLFVGHNMNERNQFHVVSEPESCSSVLSDEAREFLVHGNWDEIVPAMDCAFDPYYF

SEQ ID NO: 4134 - protein, 243 aa, Ipomoea batatas
MGRGRVELKRIENKISRQVTFSKRRSGPLKKAHEISVLCDAEVGLIVFSTKGKLFEYSTDSSMENILDRYERYSYAEQRMTTNVSEQQQNWPCQYPKLVSRIELLQRSTRNFLGDDLEPLGLRELQSLEQQLDTGLKRIRTRKNQLMHESISELQKKERALQVQNNILAKQVELEQQKLVLNSASTSMPSQPLVSPLPLPNLTIGSIARATEAAKNSENRGQALPCSTSLVPPWMLRHPNNKD

SEQ ID NO: 4135 - protein, 340 aa, Arabidopsis thaliana
MENPVGLRFRPTDKEIVVDYLRPKNSDRDTSHVDRVISTVTIRSFDPWELPCKIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGDVREISSSSASYGSEIEQSRDSLIPLLVNDSEEEAQIEDAIPIEEWETWLTDDGVDEQVNHIMNMKDDRNNHRPQKPLTGVLIDDSSDDDDDSDLLSPTTNSIENSSTCDSFGSSDQINLVSLTQEVSQALITSIDTPEKIKSPYDDAQGTGAGGQKLGQETREKKRAGFFHRMIQIFVKKIHQCSSISRT

SEQ ID NO: 4136 - protein, 246 aa, Helianthus annuus
SYMSSCPFKKNEIFFANKTIYEAALSSSTLHIVDFGIAYGFQWPILIKHLGDRPGGPPKLRITGIEFPQPGFRPAEWVEETGRRLATYCERFKVPFEYNAIAIQNWEMINIDDLKLQRNEFLAVNALARFENLLDETMVTGSSPRDAVLKLVRDMKPDIFVHSIVNGSYSAPFFVTRFREALFHYSALFDMLDATIERENEQRQSYEGEFHGRQVMNVIACEGHQRVERPETYKQWQVRITRAGSN

SEQ ID NO: 4137 - protein, 276 aa, Vitis vinifera
MDATMDDEQVVLPGFRFHPTDEELVSFYLRRKIEKKPISFELIKQMDIYKYDPWDLPTNSSVTDKEWYFFCKRGRKYRNSIRPNRVTGSGFWKATGIDKPIYSVQGRGHDCVGLKKSLVYYRGSAGKGTKTDWMMHEFRLPADQKNTTHNATTADDEVEIWTLCRIFKQNVSYRKSTPDWRETSAKRKPTKSRPKTGNMDSENWEGYISFGAPEALDNEKKLFVGHNMNERNQFHVVSDPESCFSVLSEEAREFFTNRNWDEILSAMDYDFDPYHF

SEQ ID NO: 4138 - protein, 225 aa, Vitis vinifera
MESRGCSAEEAGEEGEQLTRKKSRNKKRFSDEQVQYLESIFESDSKLEARKKEELAVELGMQPRQVAIWFQNKRARWKSKQIEHDYKALRASYDALTSRFESLKEEKQSLLTQLQKLGDLMEKPGDGVGSGFGGNSSTDGGSDTGDDAKLSYLEGGLDHRLVKCSDDDKSRSAGYFGHQEGPELLDKCENADISLESTGKWFGFASGGFHDQSCTISQLWDFWSS

SEQ ID NO: 4139 - protein, 100 aa, Physcomitrella patens subsp. patens
MKILKCFHVSLVSFRSHKARRKGPKRVREPRYAIQTRSDVEIMEDGYKWRKYGQKAVKNSPHPRYYYRCTNPKCPVRKKVERSADDSESVITTYEGTHTH

SEQ ID NO: 4140 - protein, 361 aa, Arabidopsis thaliana
MEYSCVDDSSTTSESLSISTTPKPTTTTEKKLSSPPATSMRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 4141 - protein, 284 aa, Vitis vinifera
MIKSSMDATKDDDQVVLPGFRFHPTDEELVSFYLQRKIEKKLISIEFIKQIDIYKYEPWDLAKNINTLTDKEWYFFCKRGRKYRNSIRPNRVTRSGFWKATGIDKPIYSNNGEGHDCIGLKKSLVYYRGSAGKGTKTDWMMHEFRLPANQKNTNLPNAKAADQEAEIWTLCRIFKRDVSYRKYTPDWRESSARHNPVNARTKTCDADSENLEYYNISFGASAALDDEKKPVVGHSMDGRIQLHVGSEPESCSTVLSEEAREFFTNGNWDEIVSAMDFAFDPYHL

SEQ ID NO: 4142 - protein, 505 aa, Yarrowia lipolytica CLIB122
MADNTNTNVPVHDDKRQKTEEDAEMFQSVGDHASNVDNQVDSQGLRKTGAEDAEGHPVQEIESFCVNCEKTGITRLLLTRIPYFREIVLMSFECPHCHLKNSEIQPAAQVSEKGSKYMLRVEKKEDLARQVVKSDSGNVKFVELDVEIPAKRGQLTNVEGLLTQLAEDLESDQPVRQHVDPETHAKIEEFLAKIRGTIEGDEQRYPFTVQVDDPAGNSWIEYVPGEPSSKWSHVEYFRTKAMAKALGLSVQEDDTPARNQSVAQAVNDAAPSITAASDTITTADGSEIENMHSEVQTFESSCPSCFSKNCPTNMKVVNIPHFKDVIIMATVCEDCGYKSNEVKTGGEVPEKGKRTTLLCDDPEDLTRDILKSESCRLHIPELDLDLTAGTLGGRFTTIEGLLNQVHDELDERVFTQTSDSMTVETEQRWRTFLARLKSAAEGKIPFTLVMEDPLAASYIQNPFAPDADPNMNHEDFERTDEQNDDLGLKDMNVESYQEQPKEEAN

SEQ ID NO: 4143 - protein, 161 aa, Oryza sativa Indica Group
MEKEIISARSTTTTTTTTAAAGDVNLDLRLVHSTAAGRQHTAATRNPAPPLAAAGDDRAFSCTYCRRRFYSSQALGGHQNAHKLERSLAKRSRELSAGVTTAAAPPPPHPELGWAYPPQGGGGAAAAVVSWIADGGRRYGYRVHAVAAGGDAEDIDLSLKL

SEQ ID NO: 4144 - protein, 250 aa, Zea mays
MASSSPSCRGSGGKSDVDRIKGPWSPEEDEALQRLVARHGARNWSLISRSIPGRSGKSCRLRWCNQLSPQVEHRPFTAEEDDTILRAHARFGNKWATIARLLSGRTDNAIKNHWNSTLKRKYYAASDAVVADADDERPLKRTSSDGHPGLCFSPGSPSGSDLSDSSNHSLPSVMPSAASAAAVTSHQQQQHVYRPVPRAGGVVMLPVAPLAPPPPPQPPATSLSLSLSLPGEDAQKPEASKRMMGMAKIE

SEQ ID NO: 4145 - protein, 588 aa, Oryza sativa Japonica Group
MGAMPAVKVEEEEEERNPVASSPSVSEGSAHAAALASPTAADSIFGRRRKSGPVRRAKGGWTPEEDEKLRKAVDIYNGKNWKKIEVQCLHRWQKVLDPELIKGPWTQEEDDVIINMVKKHGPKKWSVIARSLNGRIGKQCRERWHNHLDPQIRKEAWTVEEERVLARAHCMYGNKWAEIAKLLPGRTDNSIKNHWNSSLRKKIDDYNTRDILPVHPPVVGDGLKQLPKRPPADNHFDLNKEPIICSRDRLGVVHSDPTSHQRASNLKDFKGCADYLSLGQPVTSCEASAADDSAFDLATQGMRMDSVHDKGTGNNFVCGKVQGINFLGDKGLKINQISDKMGCSRQAKREGEAAINGGGSSLQSEAHSVGSLCYQIPKMEDIAPAQSPVFTANYVPEHSRNVMHSPNGYTTPPTHGKGSDQLSVESILRSAAEKFHGTPSILRRRKRDKPTPAEDNDLKIGRLSSDDFHTPIGKCTTDSPQSFKTAALLSLGPMDEQGSLDVSPPYRLRSKRLAVLKTVQNHLDFSSDEMSICDTTMKSACGNSDCANASSGVSSIQGKKLDEHMIGLETLTMNFAHTTKLDATQPNL

SEQ ID NO: 4146 - protein, 299 aa, Oryza sativa Japonica Group
MMAEALREVLPLPYFPGQPCWYLQERRGAEAWSAEENKVFERALAQVDLDSPNRWEMVAAMLPRKTVIDVMNHYRDLENDVGSIEAGLVPFPHYSSSLSPASSGFTLQDWDGSDGGFRRGCYLKRGRAPDQERKKGVPWTEEEHKSFLMGLKKYGRGDWRNISRYFVTSRTPTQVASHAQKYFIRLNSGGKDKRRSSIHDITTVNLPEEDTSNPSPSPPSVLTTASDQLGSLVDTKPVPPPPSLGAQRHFMSPLPGALGVSHHPYGNVKLEPNASFLAGGGTGPGLDDAILLQMQCGHL

SEQ ID NO: 4147 - protein, 372 aa, Oryza sativa Japonica Group
MDDPMLNAVKEEESHGDGGGLEVVAGEDGAAAVAAGVAPRPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLLKNIKRRKPPSHTASNQQSLGPYLEVGHFGYDAEIDRLKRDKQLLMAEVVKLRQEQQNTKANLKAMEDRLQGTEQRQQQMMAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGASEQQQIGPQGELNDNFWEELLNEGLVGEENDNPVVEDDMNVLSEKMGYLNSNGPTAGE

SEQ ID NO: 4148 - protein, 383 aa, Oryza sativa Japonica Group
RHPSLSRLKPPNPNAQRTPALSITVPFRLRLPNRRLTAAAVFQDQTNPRNPASKGGDDDEAYGEVDRIVSSRTIKNPVFAEDGSATTVTATEYLVEWKDGHEPSWIPAEAIAADVVAEYETPWWTAAKKADAAEITALLADETLRRDPDAEDAQGRTAMHFAAGLGSEECVRALAEAGADVGRPERAGGGLTPLHIAVGYGRPAAVRALLELGAEPEAPDGQGRTPLELVQDVLAKTPKGNPATFERRLALEAAAKELEKAVYEWGEVEKVVDGRGEGKWREYLVEWRDGGDREWVRAAWVAEDLVKDFDAGLEYAVAEAVVNKREAAEGEGKWEYLVKWVDIEEATWEPAENVDAELLQEFEQRQSGVAAGGDAPPPPPVAG

SEQ ID NO: 4149 - protein, 403 aa, Zea mays
  misc_feature (300)..(300): Xaa can be any naturally occurring amino acid
  misc_feature (386)..(386): Xaa can be any naturally occurring amino acid
MASSPSDLTLDYKPNGNGAAYAVTTPKPPQETLVVDGHHHHHHLTAAEQTTQKLREFLARLEEERLKIDAFKRELPLCMQLLNHAMESYRQQLEAYQMGSLQGAPARPLVLEEFMPLKNIGIDAAADKMGNPTSEKASWMESAQLWNGPAATADVAARGPQTPKESAECAHGAAGAGHGQRNGGGGGAFLPFAKDKTASVAEGAAAALPELALAPADKDAADADRKPYLDAAAAGSNNGGVLGARRDVVQSGVVKPAPEGQQAAPPQTHRKARRCWSPELHRRFVNALQILGGAQGTDKXVATPKQIRELMKVDGLTNDEVKSHLQKYRLHTRRPMPAPPAPATAAPQLVVLGGIWVPPEYASQAAGQAIYGAHPATQPHYTAAAXQEYYPSPAAVHHLQHHP

SEQ ID NO: 4150 - protein, 142 aa, Physcomitrella patens subsp. patens
MTPSSSAAGYREHEGAGEEGTYWPSVSPGVPLSTSGDEGASTKVRKPYTITKQRERWTEEEHQKFLEALKLYGRAWRRIEEHIGTKTAVQIRSHAQKFFSKIERDVTAGQGTETGVAQVIDIPPPRPKRKPTHPYPRKAGRS

SEQ ID NO: 4151 - protein, 127 aa, Brassica napus
QVEFLSMKLATVNPQMDFNREGLLAKDALQLRAGTSSATPFPPNMPMVYPPLPHGFMQQTLSCMGRTVSSPLSPPINGGYKRQEANGWEGDLQNVIQINYGAGDVPPDSQAAATDASLPSSNMKVEP

SEQ ID NO: 4152 - protein, 541 aa, Glycine max
  misc_feature (431)..(431): Xaa can be any naturally occurring amino acid
MMSEETFSVPPNSTIRATSLVHHVHVQPPSPNPNSNPAKRRRSLPGTPDPDAEVVALSPKSLMATNRFLCEVCNKGFQRDQNLQLHRRGHNLPWKLKKRTNNDQVRKKVYVCPEKSCVHHDPSRALGDLTGIKKHYSRKHGEKKWKCDKCSKKYAVQSDWKAHSKICGTREYKCDCGTLFSRKDSFITHRAFCDALAEESARVTTIPAALSNLRSDHHHHLTNAQASRIPQIFSGFHSSDQFGGGSSEALLANHHHQQKLRLPLWLDHHQVNNTQVLHHTLDNFSTEPSAFTSGTNSVPHDLVQTMDMFGPQTQFVNYRYPEASFGGGNANLSVLPPHGLKQEQEENKQHLSHSGASSNNLYLSNSIQNPPHHHYMSATTLLQKAVQMGSTRISDNVFGSIVGTTNRNNNNDNNTNLEVQKLNELVSMEAXCNNNLGGGGDGYLLYDSFGVVNGTDKGLEHMVMPVDEETQQESIVGNSLCSNNKNQLGLTRDFLGVGDNNNNLNPIRRPFFQQDLVEFNAMGSASASVMNLQSQYGGHYC

SEQ ID NO: 4153 - protein, 210 aa, Picea glauca
MGRSPCCEKSHTNKGAWTKEEDDRLIAHIRAHGEGGWRSLPKAAGLLRCGKSCRLRWINYLRPDLKRGNFSEEEDELIIKLHSILGNKWSLIAARLPGRTDNEIKNYWNSHIKRKLLSRGLDPGSHRPLCFPHHNNTTSPSRPAPDHEFPAFQNLKTPEITDFFQQYRSESSPIVPEASDAEEHPDLNLNLCISLPSNSPPRREQSFQRP

SEQ ID NO: 4154 - protein, 499 aa, Picea glauca
MGRAPCCDKDGLKKGPWTPEEDQKLTDYIQRHGHGSWRTLPKHAGLLRCGKSCRLRWTNYLRPDIKRGKFSFEEEQTIVQLHGVLGNKWSAIASHLPGRTDNEIKNYWNTHLKKRLLQMGIDPVTHRPRIDLFNFSNMTQLLAPASLSHMAAQWERARLEAVTTDYLRVLAAYRSAAMMQQASHSQSSTMDADHLMSYLRNQLGDAAFCNMPDNMNSAMAQANWALNSENLGSSDSNALATQIIMEQLQVPAAQIMRNLQIQTQNTAELSACSLPLNGTSMTQHSSPTSTLSSLDGFHTLKAEQRNNNSNKNNVPNSHDSTKINNQALLQDQGYDNLMNASASLVQQHSRSQDNNSLSTDQLVTSPILWPEGQFLGISKNNNSESVPALVSTTSSPNIFNDTSDMFHDASPVQNSQNCMRSDCISTNGYGLPADLFLDFGLETTKQQNVETMAPATSTTHVISGSSSWSEMQNSHEDGGDYWSNMLKYVGESSISNSTL

SEQ ID NO: 4155 - protein, 354 aa, Lupinus texensis
STYTSSGPYPYFPSSSSSYHPFAFFNPENASSNNTFSHDLLSFPYNTPTTRHYHAPIPETLSNFADCAASAAMFKNDVSGSNFGFSNFLAKKPASKKDRHSKIHTSQGLRDRRVRLSIEIARKFFDLQDMLGFDKASNTLEWLFNKSKKAMKELARSKNSSSGVVANSFSSSDSECEVVSMINQDSIDAIPEDKKLKRAKIKESREKARARARERTNKKMFNTSSMKKKCPATENPQMFNQLRPPFHHPENSAKSHNNKLVPPHHHHPHLVCNETPRDDFNLFEESIVIKRKLKQSLMSSPHNQNHVIPKESNFNNNTEHHSFPILSPNLDANNGANGRSNFCAVTNMNLSTGK

SEQ ID NO: 4156 - protein, 369 aa, Picea glauca
MGRAPCCDKMGVKKGPWTLDEDQILVSYINKHGHGNWRALPKQAGLLRCGKSCRLRWTNYLKPDIKRGNFSPEEEDHIIKLNQLIGNRWSTIASHLPGRTDNEIKNVWNTHLKKRLARMKAEAEAESVAVHAQPAPSSSLDSSTAKMAYHGSNPLSSQILCNSDARAPSAWEICDPVYVLPELSEDIISSSYNVCRSTIDDQSTSTDSILDVLHSDCIDSLELEIDHSRLSINTPDELQWQPLSRDLQIFIGNDRNNFEDPAGVPAISQDDKAEMVTSSSQGMRSDCDGEIVISEESSMNLRVDSLVQQLDGAEVDWFLDHLDNMSPAMDSNHLSKNTINLCRTDLEAGDGMDYWLNLLRQVQPLPLFS

SEQ ID NO: 4157 - protein, 196 aa, Picea glauca
MGRSPCCENVHTNNKGAWTKEEDERLIAHIEAHGEGSWRSLPKAAGLLRCGKSCRLRWINYLRPDLKRGSFAEEEDDLIIKLHSLLGNKWSLIAGRLPGRTDNEIKNYWNTHMKRKLLSRGLDPQSHRPLGQPCKTTLSSPHVLEHEIQAFQSPRTAEVADFFQYDRPESSAIERADSDAEERPDLNLDLCIWHMQ

SEQ ID NO: 4158 - protein, 267 aa, Hordeum vulgare
MGRSPCCEKAHTNKGAWTKEEDDRLTAYIKAHGEGCWRSLPKAAGLLRCGKSCRLRWINYLRPDLKRGNFSHEEDELIIKLHSLLGNKWSLIAGRLPGRTDNEIKNYWNTHIRRKLTSRGIDPVTHRAINSDHAASNITISFESAQRDDKGAVFRRDAEPAKAAAAAAAISHHVDHHHRSNPQLDWGQGKPLKCPDLNLDLCISPPIHEDPMVDTKPVVKREAGVGVGVVGLCFSCSMGLPRSSDCKCSSFMGLRTAMLDFRSIEMK

SEQ ID NO: 4159 - protein, 183 aa, Vitis vinifera
  misc_feature (3)..(3): Xaa can be any naturally occurring amino acid
  misc_feature (101)..(101): Xaa can be any naturally occurring amino acid
MAXQKIQIKKIDNTAARQVTFSKRRRGLFKKAQELSTLCDAEIALIVFSAAGKLFEYSSSSVSQVIERHNQHPQTPEKPEPPSLELQLENSTCAALSKEIXQQTQRLRQMKGEELQGLKIEELIELEELLEAGLCSVVEEKAERIRTEISDLQRKVKNLTFKFSKAFHMQIFRVKEKTKENGD

SEQ ID NO: 4160 - protein, 612 aa, Oryza sativa Japonica Group
MSSAAGGGGYGGGQGGGAEHHHHHHGHAGHLLLHHHPQHVAGAAVAAAAAAAGGQMYHVPQHSRREKLRFPPDAGDSPPPHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGGNGGVSLTLGLHQNNRVCIAEPLPAALPANLAHRFGLEEVSDAYVMSSFGGQDRHFGKEIGGHLLHDFVG

SEQ ID NO: 4161 - protein, 243 aa, Populus tomentosa
MGRGRVQLKRIENKINRQVTFAKRRNGLLKKAYELSVLCEAEVALIIFSNRGKLYEFCSGSSMLKTLERYQKCNYGAPEPNVSAREALELSSQQEYLKLKARYEGLQRTQRNLLGEELGPLSSKDLESLERQLDMSLKQIRSTRTQYMLDQLNDLQHKEHMLTAANKSLKERLMEGYQLNSLQMNPSAEDVEYARQQAQPQPGDGFFHALECEPTLQIGYQPENITMVTAGPSMTTYMPGWLA

SEQ ID NO: 4162 - protein, 402 aa, Arabidopsis thaliana
MYYHNQHQGKSILSSSRMPISSERHPFLRGNGTGDSGLILSTDAKPRLKWTPDLHERFVEAVNQLGGGDKATPKTIMKVMGIPGLTLYHLKSHLQKYRLSKNLNGQANSSLNKTSVMTMVEENPPEVDESHSESLSIGPQPSMNLPISDALQMQIEVQRRLHEQLEVQRHLQLRIEAQGKYLQSILEKAQETLGRQNLGAAGIEATKAQLSELVSKVSADYPDSSFLEPKELQNLHHQQMQKTYPPNSSLDSCLTSSEGTQKAPKMLDNRLGLRTYIGDSTSEQKEIMEEPFFHRMELTWAEEESLRENHNRPYLSTMVNNAEPRISSSRRSPGRLSIGVGLHEHRGRSSNNSEYTEERFNENNEDCKLETHTRTAIDLNTHDENYGTTRPKQFDLNGFSWN

SEQ ID NO: 4163 - protein, 253 aa, Vitis vinifera
MVRAPCCDKVGLKKGPWTTQEDQILTAYVLQHGHGNWRALPKQAGLLRCGKSCRLRWINYLRPDIKRGNFSREEEDTIIELHEKLGNKWSAIAASLPGRTDNEIKNVWHTHLKKRLKKKLATPDSKGHFTAAASTCDSDSFNSSGKMSPQPSSSEFSSFTDSSTRTMETHSTGVKNEQMEEYSTESFPEIDESFWSDALSSDNSSMASDFPAVADELQLQTPELAYGQISNMMDDGMEFWYDVFIRSGGLQEL

SEQ ID NO: 4164 - protein, 311 aa, Ostreococcus tauri
MTSGSIDGLDLLFDHGLDAREGEGAPGLAVDVLAWDDVLNAFDAYCADGADGRFDDLDAVFATTWAREGCDARRRAAGEAREYIASVVRDALGDGEDDDGGDARETTRREAEDSATAIKYVQSRANGRLRASCIETGRKNPSSVCAARRGARATSKGRRSENRRLLLRREFKSSLANVLDAFDSAMEHIAPRTAKTKSASSRDSERSNATVEITQSVAAIQGRHDERARKVLSQWLWDHFYPTEERLKPIPTRAEKEELARLSGLTTTQVGDWFVNARARLWKPYIEGLIRGVYNDAMVKKALDLQADASA

SEQ ID NO: 4165 - protein, 637 aa, Musa acuminata AAA Group
  misc_feature (477)..(477): Xaa can be any naturally occurring amino acid
MGGLLMEGMVYPGGPNYVQLFPSNDEKNLCYGSLHQPSMGECIMGEGDLVDPPPEKFAEVGDEESDEDIDIEELERRMWRDRVRLKRLKEQQQNKNKEQGDAAKQWQSQEQARRKKMSRAQDGILKYMLKMMEVCKAQGFVYGIIPEKGKPVSGASDNLRGWWKEKVRFDRNGPAAIAKYQADNTIPGSNNEVVSSTVSPHSLQELQDTTLGSLLSALMQHCDPPQRRFPLEKGVAPPWWPTGREEWWPQSGIPNEQGPPPYKKPHDLKKAWKVSVLTAVIKHISPDIEKIRRLVRQSKCLQDKMTAKEIATWLAVVKQEEDMYMKLHPDTCLPPSSGSGLTGAISFNTSCGDYDVEGVDEDKSEDVILHNPPADGNTFSLSATVGNEKFVLSVPMKDETDCAFIQKRTAAEPELLLNQRIYTCDNAKCPHHDFCHGFTDRNARNSHQYLCKYQDTFPQSIGALSAENFPVNENKPXFLSMSSTAQPTPTSLGPSLNPISVSDLGIPSDGQKSINELMGFYDNNISGDKSLTLGSASVLEGSNSFQSRIQMEDTFFGQETGMGGSLFEEVGSLVQQPQFFVREDMMPFGQQFSNQPNESSGGFRFTSGLNIPAVDYSNAASQRGMLQKKHDGSNWFY

SEQ ID NO: 4166 - protein, 439 aa, Solanum chilense
RMSVDVGAPSPRSIQMDEQVNPGEEYAPKIRKPYTISKQRERWSEEEHKKFLEALKLHGRAWRRIEEHVATKTAVQIRSHAQKFFSKVVRESSNGDASSVKSIEIPPPRPKRKPMHPYPRKMATPLKSGTLASEKLNRSGSPDLCLSELENQSPTSVLSTLGSDAFGTVDSTKPSEQSSPVAENSGDLVLSEPFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGVATHLPWGSSCAVPCTQVHSPIPMKGRPLFNDRDLEGKGTQKEGSSTGSNAESVDAEYLEIEAQSSPNVVEELVRVRASIPSLFEQRANSTKRVKGFVPYKRCLAERGMSSSTLTGEEREEQRTRLCL

SEQ ID NO: 4167 - protein, 592 aa, Musa acuminata AAA Group
MMGGLLMEGMVYPGGPNYAQLFASNDEKNLSYGSLLHQPSLGECIVGEGDLVDPPPENFAEAGDEESDEDIDVEELERRMWRDRMRLKRLREQQQNKNKEQGDTAKQHQSQEQARRKKMSRAQDGILKYMLKMMEVCQAQGFVYGIIPEKGKPVSGASDNLRGWWKEKVRFDRNGPAAIAKYQADNAIPGSSSETIPGTVSPHSLQELQDTTLGSLLSALMQHCDPPQRRFPLEKGVAPPWWPTGREEWWPELGFPKDQGPPPYKKPHDLKKAWKVSVLTAVIKHMSPDIEKIRRLVRQSKCLQDKMTAKEIATWLAVVKQEEDVYLKLHPNTCPPPSSGSAISFNSSCSDYDIEGADEGKSEDAVIQNPAADGNTFSLSATVGNEKFVISVPLKEEINCDFIQKRTAAEPQLMLNQRVYTCDNAKCPHHDFRQGFTDRNARNRHQYLCKYQNTFPQSLTMLSDNFQVNESKPPVVPMSSNAQPNATRLGSSLNPVHVSDLGIQMEDNFFRQGTGTGGSLFEQVGSLVQQPQFFLREDMMPFGQQFTNQPNELSGGFRFRSGLNIPAMDYSDVSQRGMGGSLQKHDGSSWFY

SEQ ID NO: 4168 - protein, 175 aa, Betula platyphylla
MNLGKVDGSCYQKMVKKEAEEDQVSDEELVESGVEEEKKKKGVVGSGGKRCCQAEKCTADLSDGKQYHKRHKVCEHHAKAQVVLVGGMRQRFCQQCSRFHELSEFDETKRSCRRRLAGHNERRRENTAESHAEGSSRKGTGTHQLKDIVCGQVDDRGRIQITIHENSTYKHFQIR

SEQ ID NO: 4169 - protein, 605 aa, Ostreococcus tauri
MRCRANRTWTGGGGPSPVSPGTLKRLNADAPVKVWGREVRMSELGLLMTLSGGALFAYVAFTMTQEGVFRRATKDFKYGGVVSLCTSLVYCGLAQCERASNGDAPWSRRGDIRDYALLSVMTSGSMYLTNAALSYINYTTRIVAKCSKVIPVMIVGTLMQGRRYGVEDYGMCILLVVGITLFTMGDVDSFPNFDYRGVAYITIALFLESTAGNFEERRFFNLPKPISHCEVVFYVNAIGSVWIALGLFASGELFVSLAHISREPTMLVAICLAAAFGYISVTCILLCLRHYGATNTEVIKAVRKMLSLALSLLVYPKPMGWKYIVGTTATCVALFGLYKIKMRRLRAAGFSMEAAKPTDSLLRGLPSHRTRRRARPDAPGRTSKWAPRGSTACSETPDAVELITIQPLSYDAWLAAWSGNEGEDPLRGQRASEEELERVVTSVRAHAREETCCICLNSIAAGERESALPCGHGFHENCVGEWLRRSKRCPQCRRSLAGEHVENAAAVGGAGVEITEENAPTPEDIPWSATSDHEASEESEQMRRERYRSVMMVLHELRRDFEEVLRREVVERGNAEEGAERVRAALRALDESDDIVPTNPQHSSL

SEQ ID NO: 4170 - protein, 220 aa, Zea mays
MDDAQEPPSPPSPSQSSSSSSSSSSVAPNPKKRARKDGSRHPTYRGVRMRSWGKWVSEIREPRKKSRIWLGTFATAEMAARAHDVAALAIKGARDAHLNFPGLAHLLPRPATAAPKDVQAAAALAAAADFPLPPSPGGANAKSPESSSSGSASASASDDASAASPAAPQDAEPNPDDALFDLPDLLLDLRCCGPSSWAVDDDVAGGGAFRIIEEPLLWEY

SEQ ID NO: 4171 - protein, 353 aa, Glycine max
MIQEDQGQCSSQAINNYHQAYQEQLLLQQQMQQQQQNNDIFGGGGGLNMYPGAEVSPIMNHHHQPWSMTMPHHHHHHQVHDPFLVPPQPSPYASLFNRRGPSLHQFAYDHHGSSSDHLRIISESLVGPVVQPGSAVPFGLQTELAKMTAQEIMEAKALAASKSHSEAERRRRERINNHLAKLRSLLPSTTKTDKASLLAEVIQHVKELKRQTSVIAETSPVPTEADELTVVDEADEDGNSVIKASLCCEDRSDLFPELIKTLKALRLRTLKAEITTLGGRVKNVLFITGEEADSSSGSTEDHSHHHHQQQQQQYCINSIQEALKAVMEKSVGDHHESASANIKRQRTNIISMS

SEQ ID NO: 4172 - protein, 530 aa, Arabidopsis thaliana
MELPQPRPFKTQGRKPTHDFLSLCSHSTVHPDPKPTPPPSSQGSHLKTHDFLQPLECVGAKEDVSRINSTTTASEKPPPPAPPPPLQHVLPGGIGTYTISPIPYFHHHHQRIPKPELSPPMMFNANERNVLDENSNSNCSSYAAASSGFTLWDESASGKKGQTRKENSVGERVNMRADVAATVGQWPVAERRSQSLTNNHMSGFSSLSSSQGSVLKSQSFMDMIRSAKGSSQEDDLDDEEDFIMKKESSSTSQSHRVDLRVKADVRGSPNDQKLNTPRSKHSATEQRRRSKINDRFQMLRQLIPNSDQKRDKASFLLEVIEYIQFLQEKADKYVTSYQGWNHEPAKLLNWQSNNNQQLVPEGVAFAPKLEEEKNNIPVSVLATAQGVVIDHPTTATTSPFPLSIQSNSFFSPVIAGNPVPQFHARVASSEAVEPSPSSRSQKEEEDEEVLEGNIRISSVYSQGRLVKTLREALENSGVDLTKASISVEIELAKQSSSSSFKDHEVREPVSRTRNDNVKQTRKPKRLKTGQ

SEQ ID NO: 4173 - protein, 229 aa, Arabidopsis thaliana
LPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGFHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 4174 - protein, 622 aa, Musa acuminata AAA Group
MMGGLLMEGMVYPGEPNYVQNISYGSLHQPLVGECNGQGHLIDPPQDNFAEVCDEESDDEDVDIEELERRLWRDRVRLKHLKEQQQQQSKSKSKSKEQGDSAKQRPCHDQALRKKMSRAQDGILKYMLKMMEVCNAQGFVYGIIPEKGKPVSGASDNLRGWWKEKVRFDRNGPVAIAKYQVDNAIVGSNSEMSSGTASLHSLQELQDTTLGSLLSALMQHCDPPQRRFPLEKGVAPPWWPTGKEEWWPQLGIPNDQRPPPYKKPHDLKKARKVSVLTCVIKHMSPDINKIRRLVRQSKCLQDKMTAKESATWLAVIKQEEDMYMKLHPEAYFPPSSGSCISGSISFVSSCSEYDAEGVDEGKCEDVVNHKLHAEGNPFDLSGTARKEKTVKEEMNMEFTRKRNVAEPESVLNQCIYTCDNVQCPHHDPRHGFLDRNARNSHRYVCLYQGTGVAFNSFPVKENKLLSFSVPYDTQPNPTTLESGPIPANTSDLSIPSDGQRSIDELMSLYDKNLNANKSFNSRGIGMSEGRTPLQPRTRVEDNFFPQGTKAIGGMLEEVSNLVQQQQQFPVRENVMPFQQQFGNPSDEMSGDLCYGSAFSMPSMDYSDTLHRLQKAEAANWFY

SEQ ID NO: 4175 - protein, 213 aa, Arabidopsis thaliana
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQTVRSRS

SEQ ID NO: 4176 - protein, 446 aa, Solanum chilense
RMSVDVGAPSPRSIQVDEQVNPGEEYAPKIRKPYTISKQRERWSDEEHKKFLEALKLHGRAWRRIEEHVATKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEAFDFAVEESRSSPARAYATSNPANQACVKLELFPEDNDFAKEGSDEASSTQCLKLFGKTVLVTDAHMPPTDETLTRSSFPAKYLPWDSECPQSTFSIVPPTPSYYFPTPNGSPGPNQSGAATHLPWGSSCAVPCTQVHSPIPMKGRPLFNDRDLEGKETQKEGSSTGSNAESVDAELSGDKNMEIEAQSSRNVVEESVRASVPSLFERRANSTKRVKGFVPYKRCLAERGMSSSILTGEEREEQRTRLCL

SEQ ID NO: 4177 - protein, 217 aa, Vitis vinifera
MEEVNQYKKGLWTLEEDKILMDYVKEHGKGQWNRIAKKTGLRRCGKSCRLRWINYLSPNVKRGDFTAEEEDLIIRLHKLLGNRWSLIAGRVPGRTDNQVKNYWNTHLSKKLGIKKKNNGANVSSTLTNTREMQKGSEPLMNSSSSPSCGSSRGAAEAKANEGTLQQSLEAPDWHDQLVIGEGYLDSFWAINDDLELTTDSIMEFLNGCSLDLGRHGF

SEQ ID NO: 4178 - protein, 679 aa, Physcomitrella patens subsp. patens
MAIMAPAPDQAFMNLYSNMSGAVPILHPSSDSNELSSNLEKIVEHSACGIYPYSGPSTASALQYPSWHPIQEMPITSNSNFGYGVPEIQRSTLSNDRPNPSHSRFSSTLPPSSRGLSASRGIMEEVRMRDVIGKPGRNLGAQRPSLWSSMETGGITVDPFRGGLALHGVPSEVDNLAQITSDSAFVERAAKFSTFGTRTGEYVPEMLQRPAAGFVAATTKSVPGDVREESKCIAIDTIPGKQSVLEAVEGASKVTVDAISNIKVEAAAFHENTNISSCAELQPGSQGEISPDTISPARSTPPQDEPASRNKRKKPSTIDNDLASPDPKVGDVENSKAKRCKGEDTKSDCKGERSSSEISSESAGSPKVPQKENNQKAKEFSKQDYIHVRARRGQATDSHSLAERVRREKISERMKYLQDLVPGCRKVTGKAVMLDEIINYVQSLQRQVESLSMKVASVNPTHSGRLTLESRLSNEDIIQSQLSSIHGSSDSSINAAAFGSHHLQQQSELLLNVYCGFDHLQANLGNCFDISSHHTTNPPIGRLAEMQSMVRSFDNNLVSQSSGWDGSPQSVNVHELFEVHEQFETCLEIGRLAPQDSLQRKRRMSMSLMIALTDEDMKPSSTRGYRSVVSSRSEIPQKRNFNANQGPSMSKEASLYSRSFGNVGWDESRASLQGRAALK

SEQ ID NO: 4179 - protein, 136 aa, Arabidopsis thaliana
MESKLTSVDAIEEHSSSSSNEAISNEKKSCAICGTSKTPLWRGGPAGPKSLCNACGIRNRKKRRTLISNRSEDKKKKSHNRNPKFGDSLKQRLMELGREVMMQRSTAENQRRNKLGEEEQAAVLLMALSYASSVYA

SEQ ID NO: 4180 - protein, 282 aa, Picea glauca
MEHMNTTAQSSSSLYGVHMVEYGGDVGVGSMMALMTEHQPESESIMTSIPIPSSYSSYSHGHGHGHGHGHGQSECLLSAAAMFQTSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 4181 - protein, 268 aa, Oryza sativa Japonica Group
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKITTKAVLEVKPFCLHSSEQLMETEKEKNNAIINTNREEQNGATPSTSSPTPVTAPDPIPTTNNSQSQPRGSGESEAQPSPAQAGNSKLPPWMLRTSHT

SEQ ID NO: 4182 - protein, 321 aa, Tulipa gesneriana
MAAFSYKQQQHQSNLLLDSTDHHHLSFQFQDLMTNSTSPFLYYPMPTSATNSTLDSASDNQKDCSSSVAEPQSSTEIRKRKDKSDGSCMTSVQSKGTKRETKSRKSQKKPKANESDEMKERTQEEEEAPVGYIHVRARRGQATDSHSLAERVRREKISERMKLLQALVPGCDKVTGKAVMLDEIINYVQSLQNQVEFLSMKLATVSPMLYEFGLDIEGQMNDLERVGSFPQDSQLLVPKTIPFQHRVCEEDTRSYSIGETSAPFLLHDQGPLSFSGVPFSVEMGTKHKAFSVNFCSTTSHLPTIENRRADKGRWGYGRKST

SEQ ID NO: 4183 - protein, 340 aa, Zea mays
MGRGRAPCCAKVGLNRGSWTPQEDMRLIAYIQKHGHTNWRALPKQAGLLRCGKSCRLRWINYLRPDLKRGNFTDEEEEAIIRLHGLLGNKWSKIAACLPGRTDNEIKNVWNTHLKKKVAQREKKKAGAGSGDAGTPATAPLSSATSSTTTHNSSGGSDSGDQCGTSREPDATDVCTLQPEDMDVSDMLVDGAPPAAQPMPSPSSSSSLTTCVGGVEELIELPVIDIEPEIWSIIDGESAVARHGGDAAAPCTGTGTAVSTSEAEEAAANDWWLENLEKELGLWGYAEEDTQAHPDLLDHYTGLSPLCALEGDPVSTYFQTGPAAAEPELLVVVEPSAVLL

SEQ ID NO: 4184 - protein, 332 aa, Zea mays
SARASVSEPRNAQLEAPELSQADKKYQPSSQAIDKPADDGYNWRKYGQKQVKGSEYPRSYYKCTHLNCVVKKKVERAPDGHITEIIYKGQHNHEKPQANRRAKDNSDSNGNVTVQPKSESNSQGWVGQLNKFSEKIPDSSVAKSDQTSNQGAPPRQLLPGSSESEEVGDVDNREEADDGEPNPKRRNTDVGVSEVPLSQKTVTEPKIIVQTRSEVDLLDDGYRWRKYGQKVVKGNPHPRSYYKCTSAGCNVRKHVERASMDPKAVITTYEGKHNHDVPAARNSSHNTASSNSMPLKPHNVVPEKHPLLKDMDFGSTDQRPVHLRLKEEQIIV

SEQ ID NO: 4185 - protein, 180 aa, Hyacinthus orientalis
KPPLPSYSEMIMGAIEALDEKAGSNKSAISKYIESKYAEQLPEAHSSLLTAHLARMKESGEILMVKNNYMKPGPEATPKRGRGRPPKPKTPLLAGSVSPSPRPRGRPPKPKDPLAAAVAKAASGMPRQRGRPPKKARVGGGEDIPPTPPSVAAPAAPPGIKRGRGRPPKVKPPFADVGFA

SEQ ID NO: 4186 - protein, 391 aa, Zea mays
  misc_feature (296)..(296): Xaa can be any naturally occurring amino acid
MASSPSDLTLDYKPNGNGAAYAVTTPKPPQETLVVDGHHHHHHLTAAEQTTQKLREFLARLEEERLKIDAFKRELPLCMQLLNHAMESYRQQLEAYQMGSLQGAPARPLVLEEFMPLKNIGIDAAADKMGNPTSEKASWMESAQLWNGPAATADVAARGPQTPKESAECAHGPAGAGHGQRNGGGGGAFLPFAKDKTASVAEGAAAALPELALAPADKDAADADRKPYLDAAAAGSNNGGVLGARRDVVQSGVVKPAPEGQQAAPPQTHRKARRCWSPELHRRFVNALQILGGAQXRELMKVDGLTNDEVKSHLQKYRLHTRRPMPAPPAPATAAPQLVVLGGIWVPPEYASQAAGQAIYGAHPATQPHYTAAAQEYYPSPAAVHHLQHHP

SEQ ID NO: 4187 - protein, 172 aa, Antirrhinum majus
KATELRLGLPGTDESEPQTSSSIKNNNNKRSSSEMQGSCQKSTQQEESIAPAPKAQVVGWPPVRSFRKNVMKASESDGSGMFVKVSMDGAPYLRKIDLKFYNNYFDLLKALENMFKCTIGVYSEREGYNGSEFAPTYEDKDGDWMLVGDVPWDMFITSCKRLRIMQSKLCCL

SEQ ID NO: 4188 - protein, 338 aa, Zea mays
MDPRFPPPAPSSCFGGGGELPARGHHRRAHSETFIRLPDADLLLDPDADFGFSDIDFPSLSDDSPAASDPTPQPQAPPLQPPLQQAASPASAAPPRPPSGAHMRSLSLDAAFFDGLSLQGGGGGGGVRGGMAGHKRSGSMDGDTSPFEGESAPPSVLPDYAKKAVPDDKLAELALLDPKRAKRILANRQSAARSKERKIKYTSELERKVQTLQTEATTLSAQLTLLQRDTSGLTTENRELKLRLQAMEEQAKLRDALNDALREEVQRLKIAAGQVPNMNGNPFNGGLSQQQQMPSYFSQPQQMQYFSGHQGQHHHPKHDPQNSSNGGGQPLSDSMDFM

SEQ ID NO: 4189 - protein, 380 aa, Oryza sativa Japonica Group
MMMWPLEMEEGFVALKRTEHVEVTSLAVAVEATPSAKGGKGKVVVGGGGAGGGVGPTRVRVFCDDFDATDSSSDEDEEEVTARRRVKRYVQEIRLQRAAAVAVPPVKVKGEEVFPAAVSAKMAEAAKARVVLAAGRKRKAGGVDGAEPRFRGVRRRPWGKYAAEIRDPWRRVRVWLGTFDTAEEAAKVYDTAAIQLRGRDATTNFNQSGDSASLDVPPEVAERVPQPPGASKNASPATSYDSGEESHAAAASPTSVLRSFPPSAVVATADTANKKQPPPPPLVVRETDESVDVFGCSFSDDGGFAGELPPLYTDFDLLADFPEPPLDFLSNLPVEPFSLAPFSSNNGSPDLHLDDAPSPAAAQVDDFFQDITDLFQIPVV

SEQ ID NO: 4190 - protein, 279 aa, Arabidopsis thaliana
MAMALNMNAYVDEFMEALEPFMKVTSSSSTSNSSNPKPLTPNFIPNNDQVLPVSNQTGPIGLNQLTPTQILQIQTELHLRQNQSRRRAGSHLLTAKPTSMKKIDVATKPVKLYRGVRQRQWGKWVAEIRLPKNRTRLWLGTFETAQEAALAYDQAAHKIRGDNARLNFPDIVRQGHYKQILSPSINAKIESICNSSDLPLPQIEKQNKTEEVLSGFSKPEKEPEFGEIYGCGYSGSSPESDITLLDFSSDCVKEDESFLMGLHKYPSLEIDWDAIEKLF

SEQ ID NO: 4191 - protein, 216 aa, Triticum aestivum
SDRIPVPRTTLSQCVADDLDLPEQLLPDDKPWFGVAPNTSRSPNFFATPSIFPSDAKSTMVTVRERLTQALAYIEEMQRDKHVLLQVWVPTMSYGQLVLTTRGMPFTLNKSSERLVQFRDVSTRYQLSADVASKGSPVGLPGRVFIGKLPEWSPDVRYFTSYEYPMVAHAQYLDVHGTMGLPVFEKGNPSCLGVIELIMTRQKLNFTSEINNICSA

SEQ ID NO: 4192 - protein, 271 aa, Zea mays
MGRGKVQLKRIENKINRQVTFSKRRNGLLKKAHEISVLCDAEVAVIVFSPKGKLYEYASDSRMDKILERYERYSYAEKALISAESESEGNWCHEYRKLKAKIETIQRCHKHLMGEDLESLNPKELQQLEQQLESSLKHIRSRKSHLMAESISELQKKERSLQEENKALQKELSERQKAVASRQQQQQQVQWDQQTQVQVQTSSSSSSFMMRQDQQGLPPPQNICFPPLSIGERGEEVAAAAQQQLPPPPGQAQPQLRIAGLPPWMLSHLNA

SEQ ID NO: 4193 - protein, 205 aa, Eucalyptus globulus subsp. globulus
MVRGKTQMKRIENDTSRQVTFSKRRNGLLKKAFELSVLCDAEVALIIFSPRGKLYEFSSSSLCKTIEKYQTRAKDMEAKTAEISMQPSKGNTLDMEKKIEHFEISRRRLLGEGLDSCSVEELQQTENQLERSLTKIRARKNHLIREHIERLKAEERKLLEEKRKLLQEIECGKGLTPVSSERPREEIRAESMDVETELFIGPPKR

SEQ ID NO: 4194 - protein, 196 aa, Arabidopsis thaliana
MRPSDAGKPPYVARVEKIEADARNNVKVHCRWYYRPEESLGGRRQFHGAKELFLSDHFDVQSAHTIEGKCIVHTFKNYTRLENVGAEDYYCRFEYKAATGAFTPDRVAVYCKCEMPYNPDDLMVQCEGCKDWYHPACVGMTIEEAKKLDHFVCAECSSDDDVKKSQNGFTSSPADDVKVRLSLFSHLLYRCSITYL

SEQ ID NO: 4195 - protein, 285 aa, Glycine max
MSVVPCNCNHTTEKDNLSGESESFHKFFECWISEQKQHLKDLLAAESTQLISDEELQALNDKVVEHYEYYYKAKSRCAKQDVLAMLSPTWMSSLEEAFLWIGGWRPSMAFHLIYSKSGLQFEARLDEVLQGLRTHDLGDLSASQLAQLDEMQRRTILEEREITDLMARHQETVADASMVELSHVVSEMIRANQRGEVDQSKEIENKVESTLVLKEEGLEKILLKADELRFITLKDVVDVLTPKQAIHFLIAAAELHLRLHEWGKKMDARKCNQGFGEGKSHNSSS

SEQ ID NO: 4196 - protein, 695 aa, Arabidopsis thaliana
MDKSQKNPTSQIGTSTPKSKFEDSPVFNYISNLSPIESVKSISTAQTFSSLSFTSPPPVFTSPHVISHRESRFFRCHNSVDRSKHLESLDGSAVKGEVVVPLVEDLNKEASLEDEEETSVETSSELPQILKFDSQTSEHSDSPCTEDVVIEASSDPPRGDNGSSSEDVTMGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 4197 - protein, 165 aa, Oryza sativa Japonica Group
MESEPAQVHGGVNLNLRVLETSPRRRSANGGGGGAAPAAAAAVDPREAFSCNYCHRKFFSSQALGGHQNAHKLERTLAKRSRDIVMTAAVSPSPSSSSSSRAVHGFDGVAGGFFWTAPPYGHAAAAEAAEEDHDVAPPAPPPADGGCGGGRYGRNGEEIDLSLKL

SEQ ID NO: 4198 - protein, 334 aa, Arabidopsis thaliana
ATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTCEVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 4199 - protein, 212 aa, Oryza sativa Japonica Group
MGFPVCCYSELLLPKQLLHLLLLLGYIRRFLLWAFHAVGLGDLLDLGDEQQAVLQDHAREHRAPAQALPPQQQHRRAEFRTVPAMVIEEVLPVVRFDELVAAAPAVCGGGDCAVCLSGIGGGDEVRRLSNCRHVFHRGCLDRWMEHDDQRTCPLCRAPLIPDEMASALWAAAGVPDASDFDFSYFGAPLTPMPTPTLLRPHELLLTGLGGYQ

SEQ ID NO: 4200 - protein, 206 aa, Triticum aestivum
MITREEERIIGDVEDKQVLAKITMDDRKRSMSGSMLDLNEGIHMESDDGEVGDDNDEEEEDGGSTTDVAGSRSSSNNSSTNHALETQQGTGGGEHRVRQYNRSKLPRLRWTPDLHMAFIRAVERLGGQERATPKLVLQMMNVRGLSIAHVKSHLQMYRSKKLDHHGQRIRGAISSVFSPMDFHSMRGDRRFHDMLLQRAAALSSTA

SEQ ID NO: 4201 - protein, 397 aa, Brachypodium sylvaticum
MSGTGKRGALTEDWMLPTPSPRTLMLSLFNDDLSSGPCSDAFGDNKPQDGIDGGKPCLVDSSWEETTQVAEAPPHFEPNLFGAKEKPISGNSLAERMAPGNGLCALQIDTSRVGSSASIWSPVVIPPGVSPRELLESPVFLPNAIAQPSPTTGKLPFLMRANANLAIPSVHKKDEDLSSRDGCTIFFQPILRPKPPIFPTTNKPSVGDNRQDLSLQSSSTATKDVTGTTSVKPKKLDSMFDNNHPIPIPDNEQEECDADRDGNYSLAPAIAAEDGYNWRKYGQKQVKNSDHPRSYYKCSHPNCPVKKKVERCQDGHITEIVYKGSHNHPLPPPSHHFQDVHGEVLGTKLSASLNTADQLAHISETREAVDISPVLSNEDDNKGTHGTVSLGFDGGGD

SEQ ID NO: 4202 - protein, 246 aa, Helianthus annuus
SYMSSCPFKKNEIFFANKTIYEAALSSSTLHIVDFGIAYGFQWPILIKHLGDRPGGPPKLRITGIEFPQPGFRPAEWVEETGRRLATYCERFKVPFEYNAIAIQNWKMINIDDLKLQRNEFLAVNALARFENLLDETMVTGSSPRDAVLKLVRDMKPDIFVHSIVNGSYSAPFFVTRFREALFHYSALFDMLDATIERENEQRQSYEGEFHGRQVMNVIACEGHQRVERPETYKQWQVRITRAGSN

SEQ ID NO: 4203 - protein, 247 aa, Oryza sativa Japonica Group
MPELEVCSPASSGGASPPESPVEGRRGGGGGEKRGRSGDGGRHPSYRGVRMRAWGKWVSEIREPRKKSRIWLGTFPTPEMAARAHDAAALVVKGPAAVLNFPDMAASLPRPASASPRDVQAAAARAAAMEPPQPPPSSLTVQADSAAAAFLTPKNGGVSGAGAADDELEAIVELPRLDELDAAELVFGAAFQDTAAEHPWCDPVWIDGGYAAAAAAAAAAAAHDDLFGLDADHHGWAQSVGALLWNL

SEQ ID NO: 4204 - protein, 170 aa, Zea mays
  misc_feature (29)..(31): Xaa can be any naturally occurring amino acid
CTADEAALCDSCDHRVHHANKLAYKHQRXXXNHPSAEHFPVCDVCTERKAYVFCQQDRAILCKECDLPIHSANEHTKKHNKFLLTGIKLSASATLYSSLPSSNSKSVMKNPVIDSSSQQPLMDKTSSSTVSVPPTISKANEEAGFTSSISEYLINTIPGWQFEDLLNSPS

SEQ ID NO: 4205 - protein, 199 aa, Solanum demissum
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEEEELEAQNIYIYTMYFSDKGIPSR

SEQ ID NO: 4206 - protein, 322 aa, Oryza barthii
VVATADPSAADSARDTKRMRTGGGSTSSSSSSSSSLGGGASRGSVVEAAPPATQGTAAANAPAVPVVVVDTQEAGIRLVHALLACAEAVQQENFAAAEALVKQIPTLAASQGGAMRKVAAYFGEALARRVYLFRPADSTLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNS

SEQ ID NO: 4207 - protein, 1020 aa, Chlamydomonas reinhardtii
MANSCAASGGHDVEDDVQHQPRVPAGYQQASRGAHGGAGAAGRRGDGQQGTVFGGTGGERPSGTAVSGTAGSGGDQDDAVSGARHAAAGGHGRGKDRDGDQSGVQHQVMEALRKLNPDLQGQAIVVVVNPTGSPPPAAAPPAAIVRHGSGVRVMCQVDKCNQAMACQQEQYQRLRICEHHYHALEVQHEGMRQRFCQSCGRLHPVEEFESNMHACRARCGVDSRQRKRLRPDEHADTAECRPAPGMHGRVAMPQQMPRHGAHQVAHHVAHQVAHQVAHQVVQGVMLPASQPPQVPTWDWAMQSDQQRMHAGVPAVEHGQCQDLAAGTPSSTGSAGNAPQKHSGQMALPPLPQPHLPQQGQRGGMLPPQQFHQQQQQPNLASYPSVPPPRRPQMQPTDQPLHRVSSVPAQFQGGESNQHCMQPPAPQQPQNAPVRHLSLSGLPTGAPGSMPLHPNQRVRPSNPTPQLQMQQAPDLPRQYSAPPQQGQVVVQLQPATGAQGEDKLVAFGAPAAGGMAKLILSTVPLDAPAGNAGAGGAQGLMHAPSSRPAGPQQPGQLQAPLRRPSPGVVRPGGTDSHVSTSRGALPQQGGAPALRQSLASGPGRPMAPHHGMQSVNPGGRPGAPQRTTMPPPSSAPAQRQSAPRLAEGRAPSLNLRPSAEATGARVNAVPSQQLMQQLPPPPQQAPTQASAQAGAPMWPAPQQGLPQAAQQHAFIQQQQVQQAQQVQVPQAQRPLEQQQQQQQLPEQQAQPPQEGSLNQDAFCGQAALASEYPQLQSMPMHMDSTEYAYGEQACNGGAPQTADPSPPQPPQPPPPPPPGWQQLPPDQNALYGQGELQYHQPQMQPLFHDGAMQAAGSAAAGNSAVGGAAGEEPTTPRHAGIRAPQVAVMGGGGMAAALAATISGNAAVSSFDNRLGLPRDLRVSINGNYSFGDLHELVTPGSHGLLDSGLVSPNTELFNILNTGNGAEDTLGMGPMLDLLGPGESMYDDTANTSQALLPGPSGAGTAGPSVPPTLPLPPQQ

SEQ ID NO: 4208 - protein, 417 aa, Triticum aestivum
  misc_feature (202)..(202): Xaa can be any naturally occurring amino acid
  misc_feature (220)..(220): Xaa can be any naturally occurring amino acid
MARFQETKPDLLNSGSDTRMMAEARLPKARKPYMITKQREKWTEEEHKLFLEAMQLHGRAWRRIQEHIGTKTAVQIRSHAQKFFSKVTRDSSGDSGGSSSGAGPPIQIPPPRPKRKSVHPYPCNLRSAQPGKHAHAALLRVDKPQLSMCEQGNGSPTSVVTTSQIGLGSESFDSDTSTIDIEERCPTPSTGTAEVAVQAPPXTNDSKKSKGSSSTSEEVXCDNASDAPVLKLFGKTVVVNESHQLPSPGTCDLQTAADMELDTSSETLTSAPEANTWSPWLANSQQFMYYVPQGAVFFGYNNGSVPYPMSSSPKADQQHQHQASEAAAELRRREASSNTASSSVAETTARNSAESCTGAVGGDDEVVHAAGLRERVSPTLVQQRGFMPYKRCAAETKAMQPQAPREEADREMTRLCL

SEQ ID NO: 4209 - protein, 321 aa, Oryza sativa Japonica Group
MGSAGKEEEEEDGGGGAPAAAANNYGSSTTSSTTEEEGSGESRRRTSSSSSVRPYVRSKNPRLRWTPELHLSFVRAVDRLGGQDRATPKLVLQLMNVRGLSIGHVKSHLQMYRSKKIDESGQVIGGESWRSDDHLQMQGGGHGGQAYNLGHLSLPALHHRSITAGSGTIFQSRFGNSWSPWRCHGSYWLPAGHHLLVGSKPYYPPAAEAEAPFRRSSARYVARANTSNHPDFVQGSSSSPDDNIMNHQRPVLKEMICSEGSNHQEGPLNLDLSLDICPRGEKRKRECSWRKQEEDHDHATVAIGADQEAESCATGLSLSLF

SEQ ID NO: 4210 - protein, 149 aa, Triticum aestivum
  misc_feature (34)..(34): Xaa can be any naturally occurring amino acid
  misc_feature (66)..(66): Xaa can be any naturally occurring amino acid
  misc_feature (104)..(104): Xaa can be any naturally occurring amino acid
MMEEGLPPGFRFHPTDEELITYYLSRKVSDFSFXTRAIADADLNKCEPWDLPSKASMGEKEWYFFXMRDRKYPTGIRTNRATESGYWKTTGKDKEIFHGGRLVXMKKTLVFYGGRAPKGEKTSWVMHEYRIQNKFPYKPNKEEWVVCRV

SEQ ID NO: 4211 - protein, 322 aa, Oryza longistaminata
VVATADPSAADSARDTKRMRTGGGSTSSSSSSSSSLGGGASRGSVVEAAPPATQGAAAANAPAVPVVVVDTQEAGIRLVHALLACAEAVQQENFAAAEALVKQIPTLAASQGGAMRKVAAYFGEALARRVYLFRPADSTLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNS

SEQ ID NO: 4212 - protein, 316 aa, Zea mays
  misc_feature (263)..(263): Xaa can be any naturally occurring amino acid
MEWHLGGMTAAPLLPALYVSTVKMIPGRFPQEDKYIDENVEKVQRLDAFYSKILDFYLLTQKYSTLEIAIDRFAMPDRAESSPASSREASSSPPLSATETAARRSASGCGKRARARDGEKHPSYRGVRMRAWGKWVSEIREPRKKSRIWLGTFPTPEMAARAHDAAALVVKGPAAVLNFPEMAAALPRPATAAPRDVQAAAVRAAAMEPSMMLGPTAPLPRSALAPVKGQVHDDELEAIVELPPLDEDFSELLVPLGTASFSXTSATQASWRDPEWIDHDAGYMAAARDADELFGFGPDGDHGWAQPFGSTFLWNM

SEQ ID NO: 4213 - protein, 253 aa, Brassica napus
  misc_feature (155)..(155): Xaa can be any naturally occurring amino acid
  misc_feature (192)..(193): Xaa can be any naturally occurring amino acid
  misc_feature (197)..(197): Xaa can be any naturally occurring amino acid
METLNPLSHVPISDHRFVGQDMMSLQSPSSIWTKEENKMFERALAIYPEDSPDRWFKIASMIPGKTVFDVMKQYSKLEEDVFDIEEGRVPIPGYPSPLGLAQDTYRKRPNGARGSDHDRKKGVPWTEEEHRRFLLGLLKYGKGDWRNISRNFVVXKTPTQVASHAQKYYQRQLSGAKDKRRPSIHDITTGNXXNANXNRSFSDHRDILPDLVFIEKDNAEGLMCMSPNLFSPSSAPFDDAFNFAGVNAFSAGA

SEQ ID NO: 4214 - protein, 237 aa, Brassica napus
  misc_feature (30)..(30): Xaa can be any naturally occurring amino acid
EQRRRSKINDRFQKLRQLVPNSDQKRDKAXFLLEVIENIQFLQEKTSKYETPYQGWNQESAKLLNWQRNSQQLVPEGTVTFAPKLEEEKNNIPILATAETLNGVTPFPLSVQSNSLFSPLIAGNPLTQLHARVAASETVEPSQSSRSHTQSLKEEEGDEHEVHEGNISISSVYSQGLVKRLREALEKSGVDLTKATVSVEIELAKRSSEVSEPVSRTGNDDVKQTRKPKRLKTCNTS

SEQ ID NO: 4215 - protein, 451 aa, Populus tremula x Populus alba
MFSSSSSFNPFDQYANHTMIASTENPSSIESCSQTFLQHFPDPFLDVGDFLVGELLSQQQQQQLEEKEVLGSNTALAVEAHDPQTVPTASNEETKINNKKKKSNVDTSKQPIRQRRTGKDRHSKIHTAQGPRDRRMRLSLQISRKFFDLQDMLGFDKASKTIEWLFTKSKAGIKELTDSVPGGRRCSICADGKSVCSTPESEVVSGIKLTPETNGDKRGTKAKNDSLVSNPKEKRSKKVHKPVFNLVDRDSREKARARARERTRERMKNQGIDTSSDRSSQANPNKLEKFESSSPLEYGENLAPVNQEMSSPLKVGDVRESSNHDLLPHQMDYVSITGNFFWITSSPRSSSISDFSESVALPGGTNCKYEFLPLNSDMTNDGIQYRYNALTNMKLPPLNAHEESPNSIFMNMPNPNDQNSISILMTTTTNGNANQSSSNSFFAEDHFDCLY

SEQ ID NO: 4216 - protein, 305 aa, Oryza sativa Japonica Group
MADASSRTDTSTVLDTDDKNQMAHHFDINFVKNLIVKVDGQSGAIVPSNSSDRSDRSDKPMDQKVLRRLAQNREAARKSRLRKKAYVQQLESSKLKLASLEQEINKARQQGIYISSSGDQTHAMSGNGAMTFDLEYARWLEEQNKQINELRTAVNAHASDSDLRLIVDGIMAHYDEIFRLKGVAAKADVFHILSGMWKTPAERCFLWLGGFRSSELLKLLVNQLEPLTEQQLLGLSNLQQSSQQAEDALSQGMEALQQSLADTLAGSLGPSGSSGNVANYMGQMAMAMGKLGTLENFLRQIVQLY

SEQ ID NO: 4217 - protein, 942 aa, Oryza sativa
  misc_feature (436)..(436): Xaa can be any naturally occurring amino acid
MEQKPSPPPPPRSDEEEDGLMGCGMGGTGDIAGGDLDLMEGFLLATPGFDLSEFWHPGAASPFSPLFDIGSSVTTLTTPAPAAGEDDRDEAEMPSRGGGGLEVSPAHRGWTFQTAPQEVAVEPTVKERLRRALERIASQSQSQAQRGDGELLVQVWVPTRIGDRQVLTTCGQPFWLDRRNKRLANYRTVSMKYQFSADESARADLGLPGRVFVGRVPEWTPDVRYFSTEEYPRVQHAQYFDIRGSVALPVFEPRSRACLGVVELVMTTQKVNYSAEIENICNALKEVDLRSSDVSSDPRSKVVDASYRAIIPEIMDVLRAVCDTHNLPLAQTWIPCICQAKRGSRHSDESYKHCVSTVDEACYVRDCSVLGFHQACSEHHLFRGEGVVGRAFGTNEPCFSPDITTYSKTQYPLSHHAKLFGLRAAVAIQLRSVKTXSLDFVLEFFLPMKCINTEEQRAMLNSLSNTIQQVCYTLRVVKPKELVNDGPFEISQPTRPEFYAKSVHEDLDELCSGINVPGRTTSLEASEEVSSWIASLVDAQNKGGKGEIDVDLPFGFSKQDDEGFSVTAGWHTSPVMAPDGSMFSGFKRHEDYDVKENTCSSDPSNSNSDKAVEKRRTKTEKTVSLQDLRKHFAGSLKEAAKNLGVCPTTLKRICRQHGINRWPSRKIKKVGHSLKKLQMVIDSVHGPEGTVQLSSLYENFTKTTWSERELQGDVHFPASEQNFQLEPSVPDRPCEGRFTSHTSGSNSISPSCSQSSNSSLGCSSVPKTQQQHGSAPQLAVKEEISMDENQCSTLIKSASHAEAELQMFVEERPTMLFRSQSQVLLSEHKPIENMSNVQKARSDSLKIKAIYGEERCIFRLQPSWGFQRLKEEIVKRFGISQDTHVDLKYLDDESEWVLLTCDADLLECIDVYKSSSNQTVRILVNPSIQPLLNASFGQTGLS

SEQ ID NO: 4218 - protein, 307 aa, Glycine max
  misc_feature (187)..(187): Xaa can be any naturally occurring amino acid
  misc_feature (221)..(221): Xaa can be any naturally occurring amino acid
MMAVARKEMDRIKGPWSPEEDEALQKLVERHGPRNWSLISRSIPGRSGKSCRLRWCNQLSPQVEHRAFTPEEDETIIRAHARFGNKWATIARLLSGRTDNAIKNHWNSTLKRKCASFMTADEAAGGGFSPRPLKRSFSAGTAVPPPGSPSGSDVSESSAAPGVVSVSVSVSPSQVFRPVPVRPVVEXGVVARRRRCRRRGCWTYYLAFAVSSRGGVIGNLXRTSTVPVMPVNTVAVAAPVPLPAPEVGLGALNLNAEFMAVMHEMIRKEVRSYMEQQNGMMCFQGMEMMEGFRNVSVKRIGISRVDS

SEQ ID NO: 4219 - protein, 416 aa, Arabidopsis thaliana
MDPRLIVATQIGSIDELYAHIHENPYILEIIDAIPFINTPLHIASASGNLSFAMELMNLKPSFARKLNTYGLSPLHLAIEEGQTRLVLSLLKVDSDLVRLRGREDANVNGETALHIAVSNDRYEELEVLLGWVQRLRQTDAESLEMQFLNKRDQDGNTALHIAAYQNRFKAVKILVKCSAVNRNIHNRTGLTALDILHNQRDHHANSNIENIIRKWGGKSGNSLPKSKKVSEILRSPISFTEHLFTQTARYRNQTSEGTRSALLVIAALIITATYQTALQPPGGVYQENAAEESKKSVGTVVMSHKYFFVLRGVNTMAFVGAIFMAFCLLPAGEGYVWWFLWIAVPLYVSYLVSMSVISPDTVWYVSTNAGSVIIVVFAYMVVFFLRWKRSKKKVPGTSSELILEGLTTLDLAKGS

SEQ ID NO: 4220 - protein, 227 aa, Ipomoea batatas
MAREKIKIKKIDNITARQVTFSKRRRGLFKKAEELSVLCDADVALIIFSSTGKLFDYASSSMKGILERRNLHSKNLEKMDQPSLELQLVENANHSRLSKEIADMTHRLRQMRGEDLQGMSIEELQQLERSLETGLSRVIEKKGEKIMKEINELQQKGMNLMEEKERLTQQVMAISNGQRVTAVINSDNMLNEEGLSSESITNVCNSTSPPQDYDDSSDTSLKLGLPY

SEQ ID NO: 4221 - protein, 261 aa, Vitis vinifera
MDTAQWPQGIGVVKPMESSGPVAERRARPQKDQALNCPRCNSTNTKFCYYNNYSLSQPRYFCKTCRRYWTEGGSLRNVPVGGGSRKNKRSTSSSSSSSSPASSKKLLPDHLITSTPPGFPSSASQNPKIHEGQDLNLAFPPPPEDYNNSISEFADLSYNAMELLKSTGIASRGLGSFMPMSVSDSNSIYSSGFPLQEFKPTLNFSLDGFQSGYGIQESGARLLFPLEDLKQVSNTTEFEQSRGVQGDSAGYWNGMLGGGSW

SEQ ID NO: 4222 - protein, 324 aa, Zea mays
MGSLSQPTQEAPNILALCGVNGKAKRTHQVRRPNQQQPPSDGREQPLATWIQTPRHSNRVETTKLPLAPSLSLPAAAPSERTTAAIPQPPLLLHTRTARVRSQSSLYAMAKTKQGKRDVDAYTIKGTNKVVRVGDCVLMRPADTDKPPYVARVERMESDGRGGVRVRVRWYYRPEEAKGGRRPFHGSKELFLSDHLDTQSAHTIEGKCIVHSFKSYTKLDNVGPEDFYCRFDYKAATGAFTPDRVAVYCKCEMPYNPDDLMVQCEGCKDWFHPSCMGMTIEQAKKIDHYMCSDCAEKNGAKRPSNSYPVSPNSDSKIESKRRKR

SEQ ID NO: 4223 - protein, 330 aa, Oryza sativa Japonica Group
LRRRRARSEVAFRFPDDLGLGGGADGGGFDEIGSEDDLFSTFMDMEKIAGADRDRAAETSSPPRPTKHRHSASFDGFAFGAGAGGPGPGLGKQQDGAGGVFSEVMEAKKAMSSEQLAELAAIDPKRAKRILANRQSAARSKERKARYITELERKVQTLQTEATTLSAQLTLFQRDTTGLSAENAELKIRLQAMEQQAQLRDALNDALKQEVERLKIATGEMAKSNDAYNTGMQQVPYSPSFFQLSDQHAVQHHAGVQQLPHQFQQPHPSVPSHQMLSHPNSLSDMMQQDSLGRLQGLDIGKGPVAVKNEAEVVVKSEGSSISAGESNSTF

SEQ ID NO: 4224 - protein, 642 aa, Vicia faba
  misc_feature (14)..(14): Xaa can be any naturally occurring amino acid
MTDGHLFNNITLGXRGGTNPGQIKIYSGGILWKRQGGGKTIDVDKTDIMGVTWMKVPKTNQLGVQIKDGLLYKFTGFRDQDVVSLTNFFQNTFGITVEEKQLSVTGRNWGEVDLNGNMLAFMVGSKQAFEVSLADVSQTNLQGKNDVILEFHVDDTTGANEKDSLMEMSFHIPSSNTQFVGDENRPSAQVFRDKIMSMADVGVGGEDAVVTFDGIAILTPRGRYSVELHLSFLRLQGQANDFKIQYSSVVRLFLLPKSNQPHTFVIISLDPPIRKGQTLYPHIVMQFETDTVVDSELAISEDLYNSKYKDKLELSYKGLIHEVFTTVLRGLSGGKVTKPGNFRSCQDGYAVKSSLKAEDGILYPLEKSFFFLPKPPTLILHEEIDYVEFERHAAGGSNMHYFDLLIRLKSEQEHLFRNIQRNEYHNLYGFISSKGLKIMNIADAQQAVGGVAKVLENDDDDAVDPHLERIRNEAGGDESDEEDSDFVIDKDDGGSPTDDSGADVSDASQSGGETEKPAKKEPKKDLSSKASSSKKKSKDADVDGVKKKQKKKKDPNAPKRALSGFMFFSQMERENLKKTNPGISFTDVGRVLGEKWKNLSAEEKEPYEAKAQADKKRYKDEISGYKNPQPMNVDSGNESDSA

SEQ ID NO: 4225 - protein, 224 aa, Aristida purpurea var. longiseta
IENKISRQVTFAKRRNGLLKKAYELSLLCDAEVALIIFSGRGRLFEFSSSSCMYKTLERYRSCNYNPQEAKAPQESEINYQEYLKLKTRVEFLQTTQRNILGEDLGPLSMKELVQLENQIEISLKQIRSRKNQMLLDQHYDLKNKEQKLQDLNKDLRKKLQETSGENALHISWEEGGHSGASGNAIEPNQGFLQHPENDSSLQIGYHQQAYMDQLSNEDMGAHH

SEQ ID NO: 4226 - protein, 281 aa, Zea mays
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEDVVNAELRLEEPLLWE

SEQ ID NO: 4227 - protein, 218 aa, Arabidopsis thaliana
MIASESTKSWEASAVRQENEEEKKKPVKDSGKHPVYRGVRKRNWGKWVSEIREPRKKSRIWLGTFPSPEMAARAHDVAALSIKGASAILNFPDLAGSFPRPSSLSPRDIQVAALKAAHMETSQSFSSSSSLTFSSSQSSSSLESLVSSSATGSEELGEIVELPSLGSSYDGLTQLGNEFIFSDSADLWPYPPQWSEGDYQMIPASLSQDWDLQGLYNY

SEQ ID NO: 4228 - protein, 502 aa, Medicago sativa
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPMSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 4229 - protein, 285 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 4230 - protein, 187 aa, Retama monosperma
SSGPYPYFPSSSSSYHPFPFTNPENASANNNTFPHDPLSVSHNITTSHHHAPIPETLANFADCAAAAMFKKDVNGSNFGFSNLLTKKPAPKKDRHSKIHTSQGLRDRRVRLSIEIARKFFDLQDMLGFDKASNTLEWLFSKSKKAMRELAQSKNSCSGVANSFSSSDSECEVVSIINQNSIDATPEG

SEQ ID NO: 4231 - protein, 322 aa, Oryza glumipatula
VVATADPSAADSARDTKRMRTGGGSMSSSSSSSSSLGGGASRGSVVEAAPPATQGTAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNS

SEQ ID NO: 4232 - protein, 185 aa, Spartium junceum
SGPYPYFPSSSSSYHPFPFINPENASENNNTFPHDPLSVSYNIPTTHHHAPNPETLANFADCAAAMLKNDVNGSYFGFSNLLTKKPAPKKDRHSKIHTSQGLRDRRVRLSIEIARKFFDLQDMLGFDKASNTLEWLFNKSKKAMKELAQSKNSSSSVANSFSSSDSECEMVSIINQDSIDATPEG

SEQ ID NO: 4233 - protein, 184 aa, Lupinus angustifolius
SSGPYPYFPSSSSSYHPFAFFNPENASSNNTFSHDPFSFPYNMPNTHHYHAPNPETVANFADCGASAAMFKNDVSGSNFMAKKPAPKKDRHSKIYTSQGLRDRRVRLSIEIARKFFDLQDMLGFDKASNTLEWLFNKSKKAMKELARSKNSSSGVVANSFSSSDSECEVVSMINQDSIDATPEG

SEQ ID NO: 4234 - protein, 192 aa, Brassica napus
  misc_feature (158)..(158): Xaa can be any naturally occurring amino acid
LAECVPGRKDKRKTDVQCQHRWLKVLNPNLNKGPWRKEEDNLLSELVNVFIENDKPKWSKISKQLPGRIGKQCRERWHNHLNPTIKKTPWTREEELILVQAQRDQGNKWAEIAKLLPGRTENNIKNHWNCSLKRISEHLVTSSPLSGHGPCGSESSFXHKSNMMEIEKAAKSPQRYSLELTLEPMNWRNTSS

SEQ ID NO: 4235 - protein, 194 aa, Oryza sativa Indica Group
MEGMSKLAGGGGDVTFVGGGRRMAAAAAAALRLVELDLIGTVGAAVPGQATAPRLLVVSPAPAKEEDEEEERDGEPRQLFACHYCRREFYSSQALGGHQNAHKRERTLARRGAGAGAGGEQASSSSFAIHHGAFVSASPGWMARVLHGEAPPAISVAGDGGGGERWWWGGGNVGYYWPRDGDDQTRQLDLTLKL

SEQ ID NO: 4236 - protein, 216 aa, Dendrobium thyrsiflorum
KAHEISVLCDAEVAVIVFSNKGKLYEYSTDSSMEKILERYERYSYAERALFSNEANPQADWRLEYNKLKARVESLQKSQRHLMGEQLDSLSIKELQHVEQQLESSLKHIRSRKAQLILDSISELQKKEKILLEQNKTLEKEIIAKEKAKALMQNAPWEKQNLSRYSSAPLHVISDSVPTPTSRTFQAIANEEESPQAQLRVSNTLLPPWMLGHMNG

SEQ ID NO: 4237 - protein, 424 aa, Triticum aestivum
MDMNESSEKGMEGNGSSGPGGGIPVEWQSQFSGGGFSAHQHQQHPHMMDSFGSGMWSAASQHGAGFLAPVPGFLPPPGLGGHFPVDSGFIERAARSSCFVGPGAGGGMMGAGAFGGAGDQQMGSAFGEGYLDHRRKEGGDKAEPELAGSGGVPSSEAAGGDCSSKGSDSKKRRRPSEVMGGDQVQSSNVAADSANESAQSKDKGEESSPATGTTTGGKSKGKGAKESSEKEDYIHVRARRGQATNSHSLAERLRREKISERMKLLQDLVPGCSKVTGKAVMLDEIINYVQSLQRQVEFLSMKLATVNPRLDLNIEGLLSKDLLRFPGVSSSSMGFSPEMMHPQLQLSQPGLMQGGAAAMANSDVFRRIMQAQLGAKDGSHSQMAHALNGPFSDHVAQMAYPSMGSSHSHSQDLSIRPSQDAYQM

SEQ ID NO: 4238 - protein, 229 aa, Ipomoea batatas
MAREKIKIKKIDNITARQVTFSKRRRGLFKKAEELAVLCDADVALIVFSATGKLFEFASSNMKDILGKYELHSSNLDQATQPSRELQLENSLHVRLSKEVADKTRELRQMKGEELQGLSLEELQKLEKRLENGLTRVLETKGERVVTEIATLQRKGAELMKENKQLKEKMARVNGEKFPVIADVEAAGLIPEEGQSSESITTNVCSCNSGPPPEDDCSDTSLKLGLPIN

SEQ ID NO: 4239 - protein, 145 aa, Arabidopsis thaliana
SSGGDAEKVNDSPAAKSQVVGWPPVCSYRKKNSCKEASTTKVGLGYVKVSMDGVPYLRKMDLGSSQGYDDLAFALDKLFGFRGIGVALKDGDNCEYVTIYEDKDGDWMLAGDVPWGMFLESCKRLRIMKRSDATGFGLQPRGVDE

SEQ ID NO: 4240 - protein, 233 aa, Oryza sativa
EGEGRAATGKRERIAIRRIDNLAARQVTFSKRRRGLFKKAEELSILCDAEVGLVVFSATGKLFQFASTSMEQIIDRYNSHSKTLQRAEPSQLDLQGEDSSTCARLKEELAETSLRLRQMRGEELHRLNVEQLQELEKSLESGLGSVLKTKSKKILDEIDGLERKRMQLIEENLRLKEQVSRMSRMEEMQPGPDSEIVYEEGQSSESVTNASYPRPPPDNDYSSDTSLKLGLHS

SEQ ID NO: 4241 - protein, 248 aa, Populus trichocarpa
MGRGRVQLKRIENKINRQVTFSKRRTGLLKKANEISVLCDAEVALIVFSHKGKLFEYSTDDSMEKILERYERYSYAERQLVATDLDSQGNWTLEYNRLKAKVELLQRNHRNYLGEDLDSMSLKELQNLEQQIDTALKHIRARKNHLMSQSISELQRKEKAIQVQNNMLVKQIKEKEKNDKALAQPAFWDLQDHGPNASSFLLSQPAGLPLPCLNIGGSHQEEAPEARRNELGHTLEPIYSFHLGGYGA

SEQ ID NO: 4242 - protein, 361 aa, Physcomitrella patens subsp. patens
MPAACEFCSEACATVHCRADSARLCLTCDRHVHGANALSKRHPRTLLCHSCNVRPAVVRCSSCHSSFCETCDDNKHKFALGTDQHQRHSFQCFTGCPSATELAILWASQANEPRKRAGDMLTSSSSKEGVQYSLESRNGAVAPNPSARSGARGSWSVDTQRMDDNSKIDANMSGSGPPPPLKNMQDIGMCEEDERDLCSGFNISDVNLSFGNYEDIFSSTQDPTAATFPGCVPMNEATTNSSQMQSIPESDILRPLTNSGMSLAGSGPSGDSSDYVECDASSVVLAPITYTSLGSGSPDSVTFAQARDSAMLRYKEKKKIRSFGKKIRYESRKARADIRRRVKGRFVKVGQAYDYDLAIPF

SEQ ID NO: 4243 - protein, 222 aa, Chasmanthium latifolium
IENKISRQVTFAKRRNGLLKKAYELSLLCDAEVALIIFSGRGRLFEFSSSSCMYKTLERYRSSNYNSQEVKAPLDSEINYQEYLKLRTRVEFLQTTQRNILGEDLGPLSMKELEQLENQIEISLKHIRTRKSQVLLDQLFDLKTKEQELEDISKGLRKKLHETSGENALHISWEEGGHSGASGNAVEPYQGFQQHRENESSLQIGYRQQAYMEQLNNEDMED

SEQ ID NO: 4244 - protein, 225 aa, Danthonia spicata
IENKISRQVTFAKRRNGLLKKAYELSLLCDAEVALIIFSGRGRLFEFSSSSCMYKTLERYRTCNFNSQEAKAPLDSEINYQEYLKLKTRVEFLQTTQRNILGEDLGPLSSKELEQLENQIEISLKHIRTRKNQALLDQLFDLKSKEQELQDLNKDLRKKLQETSGENAVHISWEEGGHSGASGNAMEPSQGFLQHPENDSDLHMGYHQQAYMDHLNNEDMAAPHH

SEQ ID NO: 4245 - protein, 225 aa, Ehrharta erecta
IENKISRQVTFAKRRNGLLKKAYELSLLCDAEVALIIFSGRGRLFEFSSSSCMYKTLERYRSCNYNSQEAAPENEINYQEYLKLKTRVEFLRTTQRNILGEDLGPLSMKELEQLENQIVVSLKQIRDKKNQALLDQLFELKSKEQELRDLNKDLRKKLQETTGDNVLHMSWQDGGGQHSGSSGLTAEHHQGLLHHQDQGNHSLQIGYHQAYMDHLNNEAEMAGHN

SEQ ID NO: 4246 - protein, 848 aa, Brassica napus
MASSEVSMKGNRGRGENFSSAGYSDPTVAGEAQKTQSNRSVAAERVVDPEAALYRELWHACAGPLVTVPRQDDRVFYFPQGHIEQVEASTNQAAEQQMPLYDLPSKILCRVINVDLKAEADTDEVYAQITLLPEPVQDENSIEKEAPPPPPPRFQVHSFCKTLTASDTSTHGGFSVLRRHADECLPPLDMSRQPPTQELVAKDLHASEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYTESVKINYSIGMRFKMRFEGEEAPEQRFTGTIVGIEDSDPTRWAKSKWRSLKVRWDETTSIPRPDRVSPWKIEPALSPPALSPVPMPRPKRPRSNLASSTPDSSMRIREGSSKANMDPLPASGLSRVLQGQEYPTLRTKHVESVECDAPENSVVWQSSTDDDKVDVISASRRYENWISSGRHGPTCTDLLSGFGTNIEPPHGHQIPFYDRLSSPPSVAARKILSDQDGKFEYLANQWMMHSGLSLKLHESPKVPAASDASFQGIGNPNYGEYALPRAVTTENAAGNWPIRPRALNYFEEAVHAQAREHVTKRPAVVQEEAAKPRDGNCRLFGIPLVNNVNGTDTTLSQRNNLNDPAGPTQMASPKVQDLSDQSKGSKSTNDHREQGRPFPVSKPHPKDVQTKTNSCRSCTKVQKQGIALGRSVDLSKFQNYEELVTELDRLFEFNGELMAPKKDWLIVYTDDENDMMLVGDDPWQEFCCMVRKIFIYTKEEVRKMNPGTLCCRNEEEPVVGEGSDAKDAKSASNPSLSSAGNS

SEQ ID NO: 4247 - protein, 248 aa, Picea glauca
MEHLNAAAAQASSSLYGVSMAEFGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYCEMLTKYHEEL

SEQ ID NO: 4248 - protein, 264 aa, Zea mays
  misc_feature (84)..(84): Xaa can be any naturally occurring amino acid
  misc_feature (177)..(177): Xaa can be any naturally occurring amino acid
  misc_feature (198)..(198): Xaa can be any naturally occurring amino acid
MVKGAQLQDAAADAARNAAAAAARQQGCGGGGPAGCGKRQYKGVRMRSWGSWVSEIRAPNQKTRIWLGSYSTAEAAARAYDAAXLLCLKGSAADLNFPVHLPFHIPAAAMSPKSIQRVAAAAAANATCGSPLQAGAGAAAAAPHYYSYSSSAASTMAADGATPPCSYGDASSGVSSXPETAGNTDDLCYGVAHDDDVXMVAGDADLAALADIESFFRSPKCMEYAMMDPCSTFFAPAPMATDAASEWEWEEEGEIDLWSFSSLN

SEQ ID NO: 4249 - protein, 229 aa, Eleusine coracana
LENKISRQVTFAKRRNGLLKKAYELSLLCDAEVALIIFSAGRGRLFEFSSSSCMYKTLERYRTCNFNSHEVKAPLDSKINYQDYLKLKTRVEFLQTTQRNILGEDLGPLSNKELEQLEKQIEISLTQIRSRKNQMLLVQLLDLKSKEQELQDLNKDLRKKCQLKKTCGENATHISWEEGGHSGTSRNANEPNQGFLQHAENNYSSLQIGYYQQAYMDQLNNQDIGAAHN

SEQ ID NO: 4250 - protein, 167 aa, Zea mays
MARERREIKRIESAAARQVTFSKRRRGLFKKAEELSVLCDADVALIVFSSTGKLSQFASSSMNEIIDKYNTHSKNLGETEQPSLDLNLEHSKYANLNEQLAEASLRLRQMRGEELEGLNVEELQQLEKNLESGLHRVLQTKDQQFLEQINDLERKWRSFFLHRNYRR

SEQ ID NO: 4251 - protein, 418 aa, Glycine max
MSSATKNAANAVGGKTARACDGCITKRARWYCAADDAFLCQACDSSVHLANPLARRHERVRLKTASYKSTDERRQPPTWHTKKPRTPRHGKHSRNNNPFHLVPEEGSEEANSHDENEEQLVYRVPIVDPFVAELCGTNSSPSSVTSTDQGVVAAAAAASAEVEYKGIQSNDFCSNSNEIENLHGMLPSDAELAEFAADVESFLGRGLENKCVGMEELGLVDTKEEECSVGSGKVKVEEEESPLMEMDMGRDDQSFELSFDYETCEEVKEMKVSDLELGNELGEMKENDDDEVKRKKVSLQLDYEAIIIAWASQKSPWTTADKQNLDPDECWHQCMGSCGTAFHHPYGELGGFGIHSVIVDGGREARVSRYREKRRTRLFSKKIRYEVRKLNAEKRPRMKGRFVKRASFAPPTFPLLNK

SEQ ID NO: 4252 - protein, 647 aa, Arabidopsis thaliana
  misc_feature (616)..(616): Xaa can be any naturally occurring amino acid
MADGHSFNNISLSGRGGKNPGLLKINSGGIQWKKQGGGKAVEVDRSDIVSVSWTKVTKSNQLGVKTKDGLYYKFVGFRDQDVPSLSSFFQSSYGKTPDEKQLSVSGRNWGEVDLHGNTLTFLVGSKQAFEVSLADVSQTQLQGKNDVTLEFHVDDTAGANEKDSLMEISFHIPNSNTQFVGDENRPPSQVFNDTIVAMADVSPGVEDAVVTFESIAILTPRGRYNVELHLSFLRLQGQANDFKIQYSSVVRLFLLPKSNQPHTFVVISLDPPIRKGQTMYPHIVMQFETDTVVESELSISDELMNTKFKDKLERSYKGLIHEVFTTVLRWLSGAKITKPGKFRSSQDGFAVKSSLKAEDGVLYPLEKGFFFLPKPPTLILHDEIDYVEFERHAAGGANMHYFDLLIRLKTDHEHLFRNIQRNEYHNLYTFISSKGLKIMNLGGAGTADGVAAVLGDNDDDDAVDPHLTRIRNQAADESDEEDEDFVMGEDDDGGSPTDDSGGDDSDASEGGVGEIKEKSIKKEPKKEASSSKGLPPKRKTVAADEGSSKRKKPKKKKDPNAPKRAMSGFMFFSQMERDNIKKEHPGIAFGEVGKVLGDKWRQMSADDKEPYEAKAXQVDKQRYKDEISDYKNPQPMNVDSGNDSDSN

SEQ ID NO: 4253 - protein, 451 aa, Oryza sativa Indica Group
MAFHYPDHGLAMDPSSAAASSPNPSFSPGGGGGAGVGGGEREKAAVAAHPLSARLLAAPVACLRVATPVAQLPRLDEADSASARLPSQPPPTTDANGGPLRWRGARPLHVVVTHYVLLLCSFKEQLQQHVRVHAMEAVMGCWELEQSLQSLTGASPGEGTGATMSDDEDNQVDSEANMFDGNDGSDGMGFGPLMLTEGERSLVERVRHELKNELKQGYKEKLVDIREEILRKRRAVVVTHYVLLLCSFKEQLQQHVRVHAMEAVMGCWELEQSLQSLTGASPGEGTGATMSDDEDNQVDSEANMFDGNDGSDGMGFGPLMLTEGERSLVERVRHELKNELKQGYKEKLVDIREEILRKRRAGKLPGDTASILKAWWQAHSKWPYPTEDDKARLVQETGLQLKQINNWFINQRKRNWHSNPASSGEKTKKKRSFKIRIGYVLCFDARCSVEM

SEQ ID NO: 4254 - protein, 214 aa, Dendrobium thyrsiflorum
KAHEISILCDTEVALIIFSTKGKLYEYSTDSCMDRILERYERYCYAEKALQNTEPESQGDMSQEYGKLKNKIEALQKSRSHLMGENLDTLSLKELQHLEQQLETALKHIRSQRTQLLLNSIAELQRKEKSLLEHNSLLEKKITENESTTAMTQDLNPKQQRQAQESSSPPPFINDIPTLNLGTYPVSHGEEVAEPPLTGMNSNSLPPWMLRSLT

SEQ ID NO: 4255 - protein, 418 aa, Zea mays
MWEGGGSHAHEALLLQAAGSGAADYGHAGPSLLRPWLGPAAASGFSYMAPNHAQPGPLGAEAAVASRFGFGGGGYSDGGVEQEQFVVIGSAETVPPRHSLQAAGVGGRTTALLPHGPRMVSGLLGTLQAELGRMTAKEIMDAKALAASRSHSEAERSRRQRINGHLAKLRSLLPNTTKTDKASLLAEVIEHVKELKRQTSAAARQRHLLLPTEADDLSVDAAEDGDDGRLVARASLCCEDRVGLIPDIARALAALSLRARRAEIATLGGRVRNVLLITTADDDDEEGEGHVEGGCAGASSNRRHELVASIQEALRVVMDRKTASSDTSSSSGGGGGGSIKRQRVSGLHEQVVCEIDVEGDKGVHMYNLGGYYNLAHQQPSIMSWKFEVVDGRPEGLRGNGMKTTHGIGDRFVLNGTVG

SEQ ID NO: 4256 - protein, 684 aa, Glycine max
MVLQKRLEYGFNGYQAPAMPRASRSTRRRAKFRRAEDNQKCAFDLLATVAGKLLQERENPTMSSDTSLEKDQCGFVKECQDANKPSKSEISDEGSCDNSGFSRLSSQTNKKNCGLKEFTHLAIDGDVGIASIVTSSSCLERFIAEKMVDSNSHFKVENVTSKVNLDFSDYPKDSDFKLDGDTSKGKDELHKFEKVPIGSGIDMCNFEDPLDVNPPALISLGGNAKLSGYNDRIPCSLLSKSRDNVPVVSRDDDENSSGCTHPINTETKSFRPKTCIGKRMASNFQKVAEKTKNYALSNNDGDWKRTYLSKRNCNKHQSSQMNIPFKKRKLFNYRSVANSNGLIRRGGIYYSPENCMNQDGCDSPPGMHKDPGMSSLEACQHQTLRSIGSHVNLRIKSFRVPELFIEVPETATIGSLKRTVMDAVTAVLGGELHIGVFLQGKQVKDDSKTLLQTGISHHNELDALGFTLEPNSSQSLPIVCASHSPRPKADITEPVIRYPSSPAVIHQRIQGNSDMLPEHQVTSLGRHFESDHDSAPSPVNASVDKNMKDSKELVTVPEMDEELAMVPVHQKPKRSEIVQRRIRRPFSVDEVEALVQAVEKLGTGRWRDVKLCAFDNAKHRTYVDLKDKWKTLVHTARISPQQRRGEPVPQELLDRVLVAHAYWSQQQTKSQHKHHPETETVFSF

SEQ ID NO: 4257 - protein, 332 aa, Pennisetum glaucum
MQSLTDGVVVTSIRKKRPRRSRDGPTSVAAVIQRWAEHNKQLEHDSDGAKRPRKAPAKGSKKGCMKGKGGPENTHCGYRGVRQRTWGKWVAEIREPNRVNRLWLGTFPTAEDAARAYDEAARAMYGELARTNFPSQKAVASSQAARVPTPAQVAPAAVEGVVPSTSCESTTTSNHSDVASSSNKTEASDMSSSVKVECPEAVGAGSHRSEMVSGISHQHEDSHPSIQASTPNISDKEVFEPLEPIENLPEGDFDGFDIDEMLRMMEADPQNEGGAGAGAGAGGGMEQTFFFDGLDPNLLESMLQSEPEPYSLSEEQDMFLAGFESPGFFEGL

SEQ ID NO: 4258 - protein, 346 aa, Ginkgo biloba
MGRQPCCDKVGLKKGPWTAEEDRKLVNFITTHGHGCWREVPKLAGLLRCGKSCRLRWTNYLRPDLKRGLLSESEEKLIIDLHAAIGNRWSRIAAQLPGRTDNEIKNYWNTRIKKKLRQMGIDPVTHKPLNQMQMDYMIRPPAPMNAEENNKFEPPLKPENVAEASSPENIRGPDEEMRMNMPACSSLESLEIDLPLRMEDSMKLFNVCSPTSVISLSGRTEEVDSDDSNIVDQVNNPLSDSHKNNANNNMTTSCCSFNNGGNIHSRSSDIKAEPPSLWDDQMGVLGDPISDYLQWNDLELWSAGLDAASGWIQQLPECHWSEMQGDIEISSNCPELQRLASILDEM

SEQ ID NO: 4259 - protein, 202 aa, Zea mays
MASTSSSTPAAEVEERGRKRKRAAGAAPTQPSEWRTRREHEIYSSRLLEAIRLVRAGPSSAAAAKAAPTRSRAVREAADRALAVAARGRTHWSRAILASHRRRLQAAHRARLRAPASPPPRHGASAAKGTAALPPVARKAMVLGRLVPGCRKLSFPTLLAETTDYIAALQMQVRAMTALAEALSAVSSSSSGAGSSPSSSPA

SEQ ID NO: 4260 - protein, 143 aa, Cichorium intybus
MAREKIKIRKIDNITARQVTFSKRRRGLLKKAEELAVLCDADVALVIFSATGKLFEYASSSMQELLGKYKLHSTNNVNKVDEPSLDLQLVESQESRMSQEVLEKDRELSQLRGEDLQGLTLEELQRLESLLEGRLNRVAPDKG

SEQ ID NO: 4261 - protein, 235 aa, Leersia virginica
LENKISRQVTFAKRRNGLLKKAYELSLLCDAEVALIIFSGRSRLFEFSSSSCMYKTLERYRSCNYNSQDAAAPENEINYQEYLKLKTRVEFLQTTQRNILGEDLGPLSMKELEQLENQIEVSLKQIRTRKSQALLDQLFDLKSKEQQLQDLNKDLRKKLQETSAENVLYMSWQDGGGHSGSATVLAADQPHHHQGLLHPHPEGDHSLQIGYHHTHHHHQAYMDHLNNEADMVAHH

SEQ ID NO: 4262 - protein, 423 aa, Arabidopsis thaliana
MMKGLIGYRFSPTGEEVINHYLKNKLLGKYWLVDEAISEINILSHKPSKDLPKLARIQSEDLEWYFFSPIEYTNPNKMKMKRTTGSGFWKPTGVDREIRDKRGNGVVIGIKKTLVYHEGKSPHGVRTPWVMHEYHITCLPHHKRKYVVCQVKYKGEAAEISYEPSPSLVSDSHTVIAITGEPEPELQVEQPGKENLLGMSVDDLIEPMNQQEEPQGPHLAPNDDEFIRGLRHVDRGTVEYLFANEENMDGLSMNDLRIPMIVQQEDLSEWEGFNADTFFSDNNNNYNLNVHHQLTPYGDGYLNAFSGYNEGNPPDHELVMQENRNDHMPRKPVTGTIDYSSDSGSDAGSISTTVKQEIPRAVDAPMNNESSLVKTEKKGLFIVEDAMERNRKKPRFIYLMKMIIGNIISVLLPVKRLIPVKKL

SEQ ID NO: 4263 - protein, 81 aa, Brassica napus
  misc_feature (11)..(12): Xaa can be any naturally occurring amino acid
  misc_feature (18)..(18): Xaa can be any naturally occurring amino acid
  misc_feature (27)..(27): Xaa can be any naturally occurring amino acid
  misc_feature (50)..(50): Xaa can be any naturally occurring amino acid
  misc_feature (58)..(58): Xaa can be any naturally occurring amino acid
  misc_feature (63)..(63): Xaa can be any naturally occurring amino acid
  misc_feature (71)..(71): Xaa can be any naturally occurring amino acid
  misc_feature (74)..(74): Xaa can be any naturally occurring amino acid
YSEDITESEVXXRYEIGXNPPLLESCXEEEEEDESKRDLTKVMVMIVIAXAGLLGGKXLAIVXTVSSCLFXRLXCSKSQTI

SEQ ID NO: 4264 - protein, 225 aa, Lithachne humilis
IENKISRQVTFAKRRNGLLKKAYELSLLCDAEVALVIFSGRGRLFEFSSSSCVHKTLERYRSCNYNTQEANAPVENEINYHEYLKLKTRVDFLQTNQRNILGEDLGPLSMKELEQLDNQIETSLKQIRSRKNQVLLDQLFDLKSKEQELQDINKDLRKKLQETNGDQKVVHINSWQDGGQGSSSGHAIEPYQGLIQHPENDPSMQIAYHQVYMDQLNHEDMAAQH

SEQ ID NO: 4265 - protein, 298 aa, Zea mays
MVEEGATAAASRSGPAPFLSKTHQMVEEPGTDEVISWAEQGRSFVVWKPVELARDLLPLHFKHCNFSSFVRQLNTYGFRKVVPDRWEFANENFRRGEQGLLSGIRRRKSTTPQPSKYGGGSVVNTAFPPPLPFPPPASVTTSGGGGGAGAGNERSSSSASSPPRTDDLTSENEQLKKDNRTLSTELAQARRHCEELLGFLSRFLDVRQLDLGLLMQEDVRAGAGDDAAPRRAMVSQLERGGEEGKSVKLFGVLLKDAARKRARCEEAAASERPIKMIRIGEPWIGVPSSGPGRCGGGN

SEQ ID NO: 4266 - protein, 222 aa, Panicum miliaceum
IENKISRQGTFAKRRNGLLKKAYELSLLCDAEVALIIFSGRGRLFEFSSSSCMYKTLERYRSSNYSSQEVKTPLDGEINYQDYLKLKTRVEFLQTTQRNILGEDLGPLSMKELEQLENQVEISLKHIRTRKNQMLLDHLFDLKSKEQELQDLNKDLRKKLQETNAENVLHVSWEEGGHSGASGNAIEPYQGFLQHPENDPSLQIGYHQQAYMDQLNNEDMAD

SEQ ID NO: 4267 - protein, 237 aa, Vitis vinifera
MDRVFEYDPSLFSYQTNYNLPNFVDLRELEDHFLFLDQNLPSCNGVSIHDHPDDFDHYLEVGSEEHLTQLPSGNDSEDRLKIGGGFSDLQSVIHGGFSGSWKHEEGTQQSSRSKTAALEMDDIKQYFNVPITRAAKELKVGLTVLKKRCRELNITRWPHRKIKSLKALITNAKVLNKTRELGLTEEIEMLEEHRRMLEKQPEMELTEKAKKLRQACFKANYKRKRALQAPFTQISYE

SEQ ID NO: 4268 - protein, 201 aa, Oryza sativa
MARERREIRRIESAAARQVTFSKRRRGLFKKAEELAVLCDADVALVVFSSTGKLSQFASSNMNEIIDKYTTHSKNLGKTDKQPSIDLNMRGEELEGLSVEELQQMEKNLEAGLQRVLCTKDQQFMQEISELQRKGIQLAEENMRLRDQMPQVPTAGLAVPDTENVLTEDGQSSESVMTALNSGSSQDNDDGSDISLKLGLP

SEQ ID NO: 4269 - protein, 269 aa, Oryza sativa Indica Group
MVTALAHVIRAAPDLHLPHHPSSSASAAAHPQQASSFYPTAAAAASSPSDQLAAAAAAAEEQGRRRHYRGVRQRPWGKWAAEIRDPKKAARVWLGTFDTAEDAAIAYDEAALRFKGTKAKLNFPERVQGRTDLGFLVTRGIPPAATHGGGYYPSSSPAAGACPPPRQQQTVVPYPDLMRYAQLLQGGVGGSYMPFGGAATMSSSTVSSSSAPQILDFSTQQLIRAGPPSPMPSSGSGSATAAASSTTSASSPGAWPYGGSERKKKDSSS

SEQ ID NO: 4270 - protein, 90 aa, Kluyveromyces lactis
PAFVNKLWSMVNDKSNEKFIHWSTSGESIVVPNRERFVQEVLKKYFKHSNFASFVRQLNMYGWHKVQDVKSGSMLSNNDSRWEFENERHA

SEQ ID NO: 4271 - protein, 603 aa, Oryza sativa
MHEASEVKIPARPRSNTICNPRLDVIVAANHSVFIKGVLSLAICMQVSTAVGSCDYASTVPAAIVSSGSGVVNHTSYCTCRSIDIMLQLPLPWPLALHKWSGVVVLCSSNIQSIRKQQAKKQHYSLHELAKRIAMVEPGRARETKVTASASSSAGSDAAVMKKKKKKKKLVVASRKVDEKDKKQVDYKCSRSSGRDECCKVESRHQQCTEPESPSYRNSSSSSHAGHHHHRAADGKKLGCNSSSICKVKQDNPMQQHMRRAEDELKVKDKPPVAEPYCKRRASVSACNISSERSVKKSVKQQQQEASSSLQSSASISASSCSSTAGGGGSFRGMQQLSLRRLSGCYECHMVVDPISGVFRDNSSMRATICSCPDCGEIFVRPDSLHLHQSIRHAVSELGAEDTSRNIISIIFQSSWLKKQSPVCAIDRILKVHNAARTLARFDDYRAAVKAKAMAHRHPRCTADGNELLRFHCATLSCDLGLHGATHLCDHLSCAACAIIRHGFRPPAPGAGIRTMATSGRAHDAVVSSGSEGDRRAMLVCRVIAGRVRREEAAAAAAEEEEEEEEEYDSVAGTTPGLYSNLDELDVFNPTAILPCFVVVYRA

SEQ ID NO: 4272 - protein, 896 aa, Glycine max
MMDSPEPSKNNNGSSSSASTLNNNNNNDDAPSSESPQVQESPFLRFVKTLSPIPTKASHMTQGCVGLSSPPLVFKSPRISHRETQLTKRPQGTQSFGGVIPQSVNEGNRLGEAPGDSRTSNSHQSLPERFINDTQQVFDFKNDENTQYYSSPSCIDKYLVDPGDIDQMYSADQDVQQQSTDAAETSLSDQTHSKNNILNFDRKDGPGDKVEESLPLSEDFNKVHLEKAAYGEEPEKMEGEKNDVEWSSQEPAKLESILAADGFDKRYSHGPLPQDVKGCEDYNEMVPTSHVTAENILQDGSEATLKHHGIRRRCLQFGEAASNALGRNVKLNAASHTMITVKPSELVTSLCPRRGSGNFPSTSPKPSGIGLHLNSIINAIPIDQAATTGVRLSDSSQGMKSTSSIRLQRMENVKRSILSSNVDGRSLVDTRTESHEIDDTVATDTGNSEDLNQPPSPCKKKKKTSVTADDNGCKRCNCKKSKCLKLYCDCFAAGTYCTDPCACQGCLNRPEYVETVVETKQQIESRNPIAFAPKIVQPTTDISSHMDDENLTTPSSARHKRGCNCKRSMCLKKYCECYQANVGCSSGCRCEGCKNVHGKKEDYVAFGHTSSKERVSSIVEEGSDCTFHNKLEMVASKTVYDLHCLSPITPSLQCSDQGKEDAKSRVISGNYLPSPESDVNMLASCTNYTKSSENLHGSEALLDTNEMLGNTPYDSQIECSDAALLQLTPLPNPEQSGTFIILICTQMSVQRLLTPDSPMDVFASYLAVLFVGVVLPLTPSTRVGEAQYLQCSESDSKLFDILENETPDILKEASTPMTSVKVNSPTQKRVSPPQSCHIGIGSSSSGGLRSGRKFILKAVPTFPSLSPCINSKSNGDEDSCNSPSKSPLKANECPPT

SEQ ID NO: 4273 - protein, 111 aa, Citrus limon
METSVPYENDLNLKATELRLGLPGSDENEQQTRNNKRSLPDTPDDLDTKDKSDEAASVAKAQVVGWPPIRSYRKNSLQQKKNEGECAGIYVKVSMDGAPYLRKIDLKLYNG

SEQ ID NO: 4274 - protein, 90 aa, Kluyveromyces lactis
PAFVNKLWSMVNDKSNEKFIHWSTSGESIVVPNRERFVQEVLAKYFKHSNFASFVRQLNMYGWHKVQDVKSGSMLSNNDSRWEFENERHA

SEQ ID NO: 4275 - protein, 766 aa, Saccharomyces cerevisiae YJM789
MSEEETVSAPAPASTPAPAGTDVGSGGAAAGIANAGAEGGDGAEDVKKHGSKMLVGPRPPQNAIFIHKLYQILEDESLHDLIWWTPSGLSFMIKPVERFSKALATYFKHTNITSFVRQLNIYGFHKVSHDHSSNDANSGDDANTNDDSNTHDDNSGNKNSSGDENTGGGVQEKEKSNPTKIWEFKHSSGIFKKGDIEGLKHIKRRASSRNNSSINSRKNSSNQNYDIDSGARVRPSSIQDPSTSSNSFGNFVPQIPGANNSIPEYFNNSHVTYENANHVPLESNNPEMQEQNRPPNFQDETLKHLKEINFDMVKIIESMQHFISLQHSFCSQSFTFKNVSKKKSENIVKDHQKQLQAFESDMLTFKQHVMSRAHRTIDSLCAVNAAATAASVAPAPAPTSTSAYAPKSQYEMMVPPGNQYVPQKSSSTTNIPSRFNTASVPPSQLFVQYQPQSQQHVTYAKQPAHVPNFINQPIPIQQLPPQYADTFSTPQMMHNPFASKNNNKPGNTKRTDSVLMDPLTPAASVGVQGPLNYPIMNINPSVRDYNKPVPQNMAPSPIYPINEPTTRLYSQPKMRSLGSTSSLPNDRRNSPLKLTPRSSLNEDSLYPKPRNSLKSSISGTSLSSSFTLVANNPAPIRYSQQGLLRSLNKAANCAPDSATPLDSSVLTGPPPKNMDNLPVVSSNLINSPMNVEHSSSLSQAEPAPQIELPQPSLPTTSTTKNTGEADNSKRKGSGVYSLLNQEDSSTSSADPKTEDKAAPALKKVKR

SEQ ID NO: 4276 - protein, 236 aa, Oryza sativa Indica Group
MASPEGSTWVFDCPLMDDLAAAAGFDAAPAGGFYWTTPAPPQAALQPPPPPQQPVAPATAAPNACPRSESGTRPSSKACREKVRRDKLNERFLELGAVLEPGKTPKMDKSSILNDAIRVMAELRSEAQKLKESNESLQEKIKELKAEKNELRDEKQKLKAEKESLEQQIKFLNARPSFVPHPPVIPASAFTAPQGQAAGQKLMMPVIGYPGFPMWQFMPPSDVDTTDDTKSCPPVA

SEQ ID NO: 4277 - protein, 277 aa, Triticum aestivum
MGRAPCCEKMGLKRGPWTPEEDKILVAHIHSHGHGNWRALPKQAGLLRCGKSCRLRWINYLRPDIKRGNFTDEEEQSIIQLHQLLGNRWSAIAARLPGRTDNEIKNVWHTHLKKRLDPGAQEQLEEASAAKKRKKPAAAARKREGKIKMRKLDALTAKAAPVLSSPDRSVSSTLTESTSTASAAEEQHGNSGSSASASASVKEECFTSSEESEEFQIDESFWSETLSTPLDDINDVCMEPHDAFGKPADGDMDYWLKVFMEGGGDDNNDGALDLPQI

SEQ ID NO: 4278 - protein, 203 aa, Populus deltoides
MGRGKVELKRIENSASRQVTFSKRRNGLLKKAFELSILCEAEVSLIIFSPSGKFYQFSSHDMERSVARYRSEVGLPGTNDQRSRSLEFWRSEIEELRRTINKTEAQLRHFIGEDIAPLGLKELKQLERQLKTGVERIRSKKKRVISEHIKLLKSEQRALQEENARLQKRLHELPDANVSSRIPEPNACNAFHQQRIFLDGSHH

SEQ ID NO: 4279 - protein, 399 aa, Oryza sativa Indica Group
MVGGGRERNGGVRQYNRSKVPRLRWTPDLHHCFVHAIHKLGGQDKATPKRVLQLMGVGGLTISHVKSHLQMYRNMRNDLGMQGIQVQQVDQEHTYGGGVEVWTDMQQCDHDECDVPCCSCHSPKPRKEPLLHLQLKSSGMNIDEPGTRARIAAPNVRSCRDDAAASATETRRRRGGRPEEVDDDANASASPRISQLQLLRLRGHGIRESDMSPSTSLQCYYVRSQRTTTMPPGAAAAAAGGDGGSQCYAAPRYSSSSKLKFLGFVVTSGPPPPPLPPPAACCCGSDDNIPFQVGTFAPHRVAPPTASCGGGGGGRAEARPSSSYRSVWFEPAAAAAASNNGVAPDGEHDDGCSLSLSLALDTGCGGAGAGAGGSLVSSTTSSSSGSRISLDLSLSTLDS

SEQ ID NO: 4280 - protein, 202 aa, Zea mays
MERGDEASSVVSKASTAEQRLTREQHGDGAAWLNLTLGASESPSPSPSPDAASCSADSESGSGSGSAAKPPPHKVFSCNFCLRKFFSSQALGGHQNAHKRERSAAKRSSYHAQRVVVGGLPLHAHAALMRSLRANPAPAPAVRTAARFLEGGVAAAAWATVPCEEAPSSAWPGSFRLRAPHSEYEQACEPIQPSKIDLDLRL

SEQ ID NO: 4281 - protein, 127 aa, Sorghum bicolor
MGKGRAPCCAKVGLNKGSWTPEEDMRLIAYIQKYGHANWRALPKQAGLLRCGKSCRLRWINYLRPDLKRGNFTADEEETIIKLHAMLGNKWSKIASCLPGRTDNEIKNVWNTHLKKPVFPACGWERT

SEQ ID NO: 4282 - protein, 699 aa, Catharanthus roseus
MTDYRLQPKMNLWGTTTNTAASPIITSDDNSSMMEAFMTSSDPISLWPPSMSVNHHHPPTPTSSAVTTAVDSAKSMPAQPAFFNQENLQQRLQTLIDGARESWTYAIFWQSSVVEFAGPSVLGWGDGYYKGEEDKGKRKNSSSASSFAEQEHRKKVLRELNSLIAGPQGTADDAVDEEVTDTEWFFLISMTQSFVSGSGLPGQALYNSNPVWVTGAGRLAVSHCDRARQAQSFGLQTLVCIPSANGVVELGSTELIFQSSDLMNKVRILFNFNNIDLGSSSGPWPENDPSSLWLTDPSPSGVGVKEGVNTNNNTSVQGNSIPSGNKQQLVFGNNDNHPTTSTLTDHPGAGAVNSYNNSSQNAQQPQGSFFTRELNFSEYGFERSSVKNGNCKPESGEILNFGGESVTKKNSVSGNGNLFSVQSQFGAGEENKNKKRPSPVSRGSNDEGMLSFTSGVVLPSTGVVKSSGGGGGGDSDHSDLEASVVKEAESSRVVDPEKRPRKRGRKPANGREEPLNHVEAERQRREKLNQRFYALRAVVPNVSKMDKASLLGDAISYINELKAKLQTTETDKDELKNQLDSLKKELASKESRLLSSPDQDLKSSNKQSVGNLDMDIDVKIIGREAMIRVQSSKNNHPAARVMGALKDLDLELLHASVSVVNDLMIQQNTVRMGSRFYTQEQLRIALTSRIAGNSMRLLV

SEQ ID NO: 4283 - protein, 261 aa, Arabidopsis thaliana
METASLSFPVPNTSFGVNKSMPLGLNQLTPYQIHQIQNQLNHRRSTISNLSPNRIRMKNLTPSTSKTKNLYRGVRQRHWGKWVAEIRLPKNRTRLWLGTFETAEKAALAYDQAAFQLRGDIAKLNFPNLIHEDMNPLPSSVDTKLQAICKSLRKTEEICSVSDQTKEYSVYSVSDKTELFLPKAELFLPKREHLETNELSNESPRSDETSLLDESQAEYSSSDKTFLDFSDTEFEEIGSFGLRKFPSVEIDWDAISKLANS

SEQ ID NO: 4284 - protein, 146 aa, Brassica napus
  misc_feature (139)..(139): Xaa can be any naturally occurring amino acid
ASFVWFLSIWPTMETSSLVINYHQSLSRIIKLPHVPKSYAFSSFQSFQTRQLVNKQLSYRATSPAAVQRDNYETASFVEDDDESYGEVNRIIGSRMAAGGGGTAMEYLIEWKDGHSPSWVPSSYIAADVVSEYETPWWXAARKADD

SEQ ID NO: 4285 - protein, 264 aa, Medicago truncatula
MDVCQNVQVSSECKQEKVLNPSCSNLSSSLDDLFSAQNMEVDVGMEWLSVFVEDCFSSPQSCVLLPSSVQNTTSTVSSKPSNTVKKPKQEQNESPFAVPGKARSKRKRLSAPRRPKDPLSILSNTLNPQNESLCSDPPLLKQAYWLADSELMVPKGEKEVTKDCEVVEKERFDFEGFVNNGQNPIPTRRCTHCLSQRTPQWRAGPLGPKTLCNACGVRYKSGRLLPEYRPAKSPTFVSFLHSNSHKKVMEMRMNVVSSINPPSE

SEQ ID NO: 4286 - protein, 304 aa, Zea mays
MGVESECDRIKGPWSPEEDEALRRLVERHGARNWTAIGRGIPGRSGKSCRLRWCNQLSPQVERRPFTPEEDAAILAAHARLGNRWAAIARLLPGRTDNAVKNHWNSSLKRKLATATATSSGSDAERACKRASPGPGSPTASDRSDLSHGCGAAQVFRPVPRAGGFDAISAADVRPPPPPAVADEDPLTSLSLSLPGLDQSPSGFHHDSARSHFQELSPSSSPSPQSTPPAFPPQAAPSQSSYAFSGELVAAMQEMIRAEVRKYMSGAGLRAGCGPGAVGEVCMPQLVEGVMRAAAERVGVVTRP

SEQ ID NO: 4287 - protein, 467 aa, Glycine max
MQVTSSQSHMKAELKGTTSISFQNPNTALFNTPHNNPLSGALKGCLGSLDGACIEKLLLHCASALESNDITLAQQVMWVLNNVASPVGDTNQRLTSWFLRALISRASRICPTAMSFKGSNTIQRRLMSVTELAGYVDLIPWHRFGYCASNNEIYKAITGFQRVHIVDFSITHCMQWPTFIDGLAKRPEGPPSLRITVPSCRPHVPPLVNISIHEVGLRLGNFAKFRDVPFEFNVIGNTEGPLTPAELSDESTSFHFEAMLSLLNPTMLNLREDEALVINCQNWLRYLSDDRKGISCQSFSLRDAFLNLIKGLNPRIVLLVDEDCDLSASSLTSRITTCFNHLWIPFDALETFLPKDSCQRSEFESDIGQKIENIIGYEGHQRIERLESGVQMSQRMKNVGYLSVPFCDETVREVKGLLDEHASGWGMKREEGMLVLTWKGNSCVFATAWVPCEILRDHHIGMDASLS

SEQ ID NO: 4288 - protein, 231 aa, Brassica napus
MGRSPCCEKAHMNKGAWTKEEDQLLVDYIRKHGEGCWRSLPRAAGLQRCGKSCRLRWMNYLRPDLKRGNFTEEEDELIIKLHSLFGNKWSLIAGRLPGRTDNEIKNYWNTHIKRKLLSRGIDPNTHRPINGSATPPSKTTTPSLLHDEPVQFDLAKPDQHQTVKPEPTVLYREEGDYNNNNCTSSETTSEEDCVLNLELSVGPATTRSYRYESTRKANLDSIESTGRWGSE

SEQ ID NO: 4289 - protein, 224 aa, Arabidopsis lyrata
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSLPSLFITAATTSSRHHQQENVYENIAKSFDGVVSASYEDKPKQELAQNDVLMATTNDPSHYYGNNALWVHDDDFELSSLFTRNDEFCFW

SEQ ID NO: 4290 - protein, 223 aa, Arabidopsis lyrata
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIDKRVPGRTDNQVKNYWNTHLSKKLVGDYSSAVKTTGEDDDSLPSLFITAATTSCHHQQENVYENIAKSFDGVVSASYEDKPKQELAQNDVLMATTNDPSHYYGNNALWVHDDDFELSSLFTRNDEFCFW

SEQ ID NO: 4291 - protein, 251 aa, Oryza sativa Indica Group
MEGEAFCTNSAIASAPPLKFSTKINLCLPPWVQENDSAESPLNTYPWEGIHGPRCMAGWLDEEWRCKVTSKNVLQNRLPVLSISIGSSEEDQEGSGGETELPEIDAHGVDQELKHHLLKKYSGYLSSLKQELSKKKKKGKLPKDARQQLLNWWELHYKWPYPSAYSTANTCDVCTVDSVISIKESQKVALAESTGLDLKQINNWFINQRKRHWKPSDEMQFVMMDGYHPTNAAAFYMDGHFINDGGLYRLG

SEQ ID NO: 4292 - protein, 872 aa, Zea mays
MQCVRDELCRAGSEESVTCICMEEGGDPQLPSISVARTTSEGAGAVDLDLLEQLLSGDNGWLEVVSRSPNSVAFPPPSAFFSADATATTVTTTAAPAANASWLIQTGGASTPSVRERFSQALSYIRDTQSDGDVLVQLWVPVNRDDGKLVLTTSGQPFTLDHRSDSLIRFREVSTKYQFPADVRSGESPGLPGRVFIGRLPEWSPDIRCFTSYEYARVTDAKYLDVHGTMGLPVFEKRSYSCLGVIELIMTKQKLNFTSELNTICSALQAVNLRSTEVSSIPRKKFSTASYKDALPEILEVLRAACLTHKLPLAQTWVTCTQQGKRGSRHSDENYRYCISTIDEACFVNEAEMRGFHEACSEHHLLRGEGVAGKALTTNQPCFLPDIGSSTKLEYPLSHHAKIFRLKGAVAIRLRCTRTGIADFVLEFFLPTDCEALEEQKTVLDSLSGTMQSVCQTLRVVTEREMEDEAALEMNELNSFTPPGKDKDELSFGGNSADRREASWTSLAGTSQQEPDLAALRMHGTFSPGGQGLSLSGVQATAEGSKTKRRTKAEKTVSLQVLRQYFAGSLKDAARSLGVCPTTLKRICRQHGITRWPSRKIKKVDHSLRKLQQIIDSVHGAETAFQLNTLYKDLTDTSISSDNNLSGSVTVPPTNQSNLTDFNKHQPHKSSSNMPSTSHSHSSCSHGSQSSPSCSVGATEHAQQGIIDLMKSENPVKDSSIQTMQTENTSLYEHFSVHEAPIDLLQDVTEKANGAHHSSRSLSSPNPKQNTDANMRVKATFGSEKVRFRLNPECNFQGLKHELAKRLSIVDTNPLVLKYLDDDSEWVLMTCDADLQECLHVYKLADIQTIKISVHLAVSPATRVTAGHTGLS

SEQ ID NO: 4293 - protein, 846 aa, Solanum lycopersicum
MAASEVSIQGYSEPSDGSRPVSETGRSSSGVGIVDADTALYTELWRSCAGPLVTVPREGELVYYFPQGHIEQVEASTNQVADQQMPLYNLPSKILCRVVNVLLKAEPDTDEVYAQVTLMPEPNQDENAVKKEPMRPPPPRFHVHSFCKTLTASDTSTHGGFSVLRRHADECLPQLDMSRQPPTQELVAKDLHGNEWRFRHIFRGQPRRHLLQSGWSVFVSSKRLVAGDAFIFLRGENGELRVGVRRAMRQQGNAPSSVISSHSMHLGVLATAWHAIQTKTMFTVYYKPRTSPAEFIVPYDHYMESVKNNYSIGMRFKMRFEGEEAPEQRFTGTIVGIEDADPQRWLESKWRCLKVRWDENSSIPRPDRVSPWKIEPALSPPALNVPPVARPKRPRSSILPTSPDSSVLTREGSSRATADHSQASGFPRVLQGQELSTFRGGFAEINETDLSEKPMIWQTSVNDEKNDIHSASKRYLPDKWLPLGRPESSLTDLLSGFGSSHGFCLPSADQAAFGARLVKQQTQDQEKDFSLLGKPWSLLSSGLSLNLMDSGSKAPGIGGDTPYQMRGDARYSGYGEFSVLPGHRVANQQGSWIMPQPVSPYMQLSSHSREMMHKPSVVKQPEAVKPKEGNYKLFGIPLTSNVCTDAVMMRKSSLIDPASDMNIGIHPHQSLATDSDQRSEQSKGSKVDDGVAANDHDKQFHTFHLAARDKDGKGHSSSTRSCTKVHKQGTALGRSVDLAKFNNYDELIAELDQLFDFNGELKARSKSWLVVYTDDEGDMMLVGDDPWQEFCGMVRKIFIYTKEEVQRMNPGTLNSKGEDTSSVAEGSDAKEVKNLQLPSESGQAES

SEQ ID NO: 4294 - protein, 343 aa, Zea mays
MQQPEPADLPGWAFQPRAAPAPAAARGAHHRRARSEVAFRLPDDLGLGGGAGPDGDAFDEIGSEDDLFSTFMDIEKISTSGPSDRAAENSSPPRPKHRHSSSVDGSGFFFSPGAGGGAGKDAAASLAEVLEAKKSMTPEQLAELAAIDPKRAKRILANRQSAARSKERKARYMTDLERKVQTLQTEATTLSAQLTLFQRDTTGLSTENAELKIRLQAMEQQAQLRDALNDALKQELERLKHATGEMTNSSEAYNMRFQHVPYNSSFFPLSQQNASPHLGSTQLPLPFHPPHPNVPNHQMRNTLPDIMQQESLGRLQGLDIGKGPLVVKLESSSISASESSSTF

SEQ ID NO: 4295 - protein, 161 aa, Oryza sativa Indica Group
MEMMEAAEDEDLGIIDPRSDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPASAVYTARPDHGVWRA

SEQ ID NO: 4296 - protein, 919 aa, Oryza sativa Indica Group
MEQKPSPPPPPRSDEEEDGLMGCGMGGTGDIAGGDLDLMEEFLLATPGLDLSEFWHPGAASPFSPLFDIGSSVTTLTTPAPAAGEDDRDEAEMPSRGGGGLEVSPAHRGWTFQTAPQEVAVEPTVKERLRRALERIASQSQSQAQRGDGELLVQVWVPTRIGDRQVLTTCGQPFWLDRRNQRLASYRTVSMKYQFSADESARADLGLPGRVFVGRVPEWTPDVRYFSTEEYPRVQHAQYFDIRGSVALPVFEPRSRACLGVVELVMTTQKVNYSAEIENICNALKEVDLRSSDVSSDPRSKVVDASYRAIIPEIMDVLRAVCDTHNLPLAQTWIPCICQAKRGSRHSDESYKHCVSTVDEACYVRDCSVLGFHQACSEHHLFRGEGVVGRAFGTNEPCFSPDITTYSKTQYPLSHHAKLFGLRAAVAIQLRSVKTGSLDFVLEFFLPMKCINTEEQRAMLNSLSNTIQQVCYTLRVVKPKELVNDGPFEISQPTRPEFYAKSVHEDLDELCSSINVPGRTTSLEASEEVSSWIASLVDAQNKGGKGEIDVDLPFGFSKQDDEGFSVTAGWHTSPVMAPDGSMFSGFKRHEDYDVKENTCSSDPSNSNSDKAVEKRRTKTEKTVSLQDLRKHFAGSLKEAAKNLGVCPTTLKRICRQHGINRWPSRKIKKVGHSLKKLQMVIDSVHGPEGTVQLSSLSMKILPRPHVPDRPCEGRFTSHTSGSNSISPSCSQSSNSSLGCSSVPKTQQQHGSAPQLAVKEEISMDENQCSTLIKSASHAEAELQMFVEERPTMLFRSQSQVLLSEHKPIENMSNVQKARSDSLKIKAIYGEERCIFRLQPSWGFQRLKEEIVKRFGISQDTHVDLKYLDDESEWVLLTCDADLLECIDVYKSSSNQTVRILVNPSIQPLLNASFGQTGLS

SEQ ID NO: 4297 - protein, 189 aa, Arabidopsis thaliana
MKVADMQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 4298 - protein, 322 aa, Oryza rufipogon
VVATADPSAADSARDTKRMRTGGGSTSSSSSSSSSLGGGASRGSVVEAAPPAMQGTAAANAPAVPVVVVDTQEAGIRLVHALLACAEAVQQENFAAAEALVKQIPTLAASQGGAMRKVAAYFGEALARRVYLFRPADSTLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNS

SEQ ID NO: 4299 - protein, 315 aa, Arabidopsis thaliana
MPTLYKKAGYMKRGLDMARSYNDHESSQETGPESPNSSTFNGMKALISSHSPKRSRRSVEKRVVNVPMKEMEGSRHKGDTTPPSDSWAWRKYGQKPIKGSPYPRGYYRCSSTKGCPARKQVERSRDDPTMILITYTSEHNHPWPLTSSTRNGPKPKPEPKPEPEPEVEPEAEEEDNKFMVLGRGIETTPSCVDEFAWFTEMETTSSTILESPIFSSEKKTAVSGADDVAVFFPMGEEDESLFADLGELPECSVVFRHRSSVVGSQVEIFFSKFLYKVGIIRKHCFIICCNEQVTISQIKSLFAIQLQLWPVSQNL

SEQ ID NO: 4300 - protein, 226 aa, Zea mays
MGAARDSTAAGQKRGTGTRCELCGGAAAVHCAADSAFLCLRCDAKVHGANFLASRHVRRRLVPRRAADPEASSAASSGSSCVSTADSAESAATAPAPCPSRTAGRRAPARARRPRAEAVLEGWAKRMGFAAGPARRRAAAAAAALRALGRGVAAARVPLRVGMAGALWSEVAAGCRGNGGEEASLLQRLEAAAHVPARLVLTAASWMARRPDARQEDHEEGWAECS

SEQ ID NO: 4301 - protein, 394 aa, Arabidopsis thaliana
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSQALITSIDTAEKKKNPYDDAQGTEIGEHKLGQETIKKKRAGFFHRMIQKFVKKIHLCSSISRT

SEQ ID NO: 4302 - protein, 266 aa, Brassica napus
MALEAMNCPTNSSSFTAREDRNEPTDDLTNDAVFMEPWLKRKRSKRQRSGSPSSSPPRSRPKSQIQDLAEEEYLALCLLMLANNHHQPKRRPQESTTKLSHKCSVCGKAFPSYQALGGHKASHRIKPPTTTADDDSTPPSIAVAKHPTSTAIAPSGKIHECSICHKVFPTGQALGGHKPCHYEGNLGGGGGGSKSVSPSGSVSSTVSEGRSTRVIIDLNLPALPELSLHPDSVVDEKILSPLTGKKPLLLAGPAQVIKKKDLSLRI

SEQ ID NO: 4303 - protein, 311 aa, Arabidopsis thaliana
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSADDGAVSSDEELREDDDIAADDSQQRSNDRDLKDQLLRKFGSHISSLKLEFSKKKKKGKLPREARQALLDWWNVHNKWPYPTEGDKISLAEETGLDQKQINNWFINQRKRHWKPSENMPFDMMDDSNETFFTE

SEQ ID NO: 4304 - protein, 61 aa, Physcomitrella patens subsp. patens
HYRGVRQRPWGKFAAEIRDSSKNGSRIWLGTFDTAELAALAYDRAALQMRGSKALLNFPLK

SEQ ID NO: 4305 - protein, 351 aa, Brassica oleracea
MTRRCSHCNHNGHNSRTCPNRGVKLFGVRLTEGSIRKSASMGNLSHYTGSGSGGHGSGSPGDVPDHVAGGDGYASEDFVAGSSSSSRERKKGTPWTEEEHRMFLLGLQKLGKGDWRGISRNYVNTRTPTQVASHAQKYFIRQSNVSRRKRRSSLFDMIPDEGEDVPMDQQEPEAENTPVETLMQSSDSVHQTLAFSSRQAPSILEIDECESMDSTNSTTGEPSSIAAAASSSTSILEETTQPQLQSFPILYPAYFSPYYPFPYPIWPAGYVPEPTKKEETHEILRPTAVHSKAPINVDELLGMSKLSLGESKKKNGESDQSLSLKLGTRQSAFQPNPSSDSSDITNVVHAV

SEQ ID NO: 4306 - protein, 695 aa, Ashbya gossypii ATCC 10895
MAQLEDPKERAGKVGESQHGQHHNTAFIHKLYSMLEDDNMKDLIWWSASQNSFLIKPNEKFSKALATFFKHTNVASFVRQLNMYGFHKVSDHKPSSAKGTSQDEDEAINLWEFRHSMGCFRKGDKESLKSIKRRSSKNQVLLSRNNSAQSLASQYNSQQDLGPGGSSIAGHVHPIEPADKYYSTTVYQPPYTDAPPLHSQSQIQAYPDMRFPQEQKPHTSSVITLPHLPNSAIEDLRATNLDMMKLLDLVQKAMHISSPPSANELGGSVCSTSGGSGLSSNQLGSASGSANDVTSPSSFARSPTGTRERTLEYLHQEIAAFRTTILMKLQRHAELQLHMLPPTPSQRHSHPQNSYAVSAPPSTGTNFLPYNGSGSIGMPTGYDAYPTNKPALAIPGAISHGFHGSPYLMLDPYAKGSSSSISRKRHMSVLVDPLAPAPMSAPAAMQVPSLAQPTSTSSSPVHAPEGNMPHANAAGANSPFHASCPVSRIDSRQDLHHHQTSNPSASEDKRPFSPSRKDSPPSQLLPLLTTNARGSGDGNSLLLAPQSPATLPPTASQHRLPAPTPQNNAGRGPAQVSITYKPYFPYGTIPPQPVLSSQYILPLFQSGSGSFTSGSSVTAAHAPLRSTTAIPETSSCNNSEIPSFPKPTTDEQQAPATVNQSATNSHRQSIVNQDTCSSPATSKSRGLYALLNHDT

SEQ ID NO: 4307 - protein, 585 aa, Physcomitrella patens subsp. patens
MRTTGSTQGCQNTNGMQGQVEYSSGSDGVHPGRKWGGDNFRKRNSSSSGEYTPERSSESQNASGGSPRTGYQGGFSGGSGKTGGTVRQYVRSKMPRLRWTPDLHQCFVVAVERLGGQDRATPKLVLQLMDVKGLTIAHVKSHLQMYRSMKNDENGQNGLEQTDQMIEDHGTSDTTLVHTSLGPQRRDQFQGHASHVRDSDVTSKPIFPNFVHRHSGILQLLDHRSAVSRHDGHGEWSNLAFSQYGPPTGHRDWPDDEFQMRWRKREQNLARGTHVTGNTYSDQSGIDLHEDRWSSKPSYSVPSDWEKKFQKSHNIGLGFSAYQERPWLQSGGVAPTMAASQQSNSLKRQESTASEWDRWQGQGGRQDDWSRQSKHNVSDEPTSTLGDSRIHLKQLLDHSCSSSNVEEKQQCAREDEVTLQTTKWPAVFEIRDQSTPDGYADSCRHAFAEDHAGISSPWSIMQRSEPGTASTLSNNRELDGTLSLYPYSSRTAQSSSPVLKSQQSMSFPHIGDDHHEYHSSLGPSKTVQLSSSQGITLDLTMSTDSLVPGSVVQGLRRISGSPKQQSRSRIQLELCRSRVQSCRLS

SEQ ID NO: 4308 - protein, 222 aa, Zea mays
MGHHRGGCRCELCGAPAAVHCAADAAFLCAACDAKVHGANFLASRHRRTRLLLAAPDECGYESGASSCVSTAVDSAAPPPRRTRGGGSPGPRSRGEAVLEAWARRTGLTAADARRRAAAAARALRAHAHGLASARVAPRVAMAAALWREVAGRGGTGGGGHGHGEALRRLEACAHVPAGLVVAVAKSMARARGRGDEADTDAAAEGWDECAWAGPKSSPPRP

SEQ ID NO: 4309 - protein, 331 aa, Zea mays
MCCAPKVANAEGRGPCRCCAGGEEDDEDGQQPAAAWRMLSGYERSREASMMVDALATVVAGGATPPATAGARQQQVSPEGQWWSDYYAGDVTPPPSLPAPAAHEHGAARIPATAASPSSSSQAPSPSSTGSGTPRRRYRGVRQRPWGKWAAEIRDPHKAARVWLGNFDTAEAAARAYDVAALRFRGSRAKLNFPESATLAAPPPTAAAAAVPPPPSPPPQRPEALLESQALALAGGREYSEYARFLQCPADPPRLYDQAPAATVPSAASGSASSSFPVLFRFGGGGESSGAASSQWWTQGSRSVSQEGAGSPPASWADSAWWPAPPRDPPR

SEQ ID NO: 4310 - protein, 336 aa, Nicotiana tabacum
PRRAAEDCFPPLDYRQQRPSQELVAKDLHGIEWKFRHIYRGQPRRHLLTTGWSAFVNRKKLVSGDAVLFLRTADGELRLGVRRAAQAKTCSNYLAAYSQLLNVSGIVDVVKAISSTNAFSICYNPRASSSGFILPYHKFSKTLAHPFSAGMRFKMRVETEDAAEQRFTGLVVGVSDVDPVRWPGSKWRCLLVRWDDLDVSRHNRVSPWEIEPSGSAPVSSSLVMPSAKRTRVGFPITKADFPIPRDGIAVSDFGESSRFQKVLQGQEILGISSPFVGFDAHSPRTAGIRCFPGFPSSGASRLGNSIRTLLGDTDKSPESIGFSDSSRFNKVLQGQE

SEQ ID NO: 4311 - protein, 261 aa, Zea mays
MDRPDHQQQQFFMPTTVQVPQPQQQQQQLWCPMLDEPPSSFLAGRGGGGASRRGERKRRFTEEQIRSLESMFHAHHAKLEPREKAELARELGLQPRQVAIWFQNKRARWRSKQLEHDYALLRAKFDDLHAHVESLKQDKLALTTQLSELSERLRERDDRAAAAGGGGRETMASSSSCIGGGGEEEAEDDKRNVLLFGCVDMEPPAESCVLVGSTCAALADVSVESECDDQHLHYDDEFPESYCAMPELWEPWPLVEWNAVA

SEQ ID NO: 4312 - protein, 504 aa, Vitis vinifera
MASSSSSPPQSSHQFLTSVLSRRGPSALPYAEDVKWMIRQHFLSLADAFPALHPQTAAYTHNDGRTVNLLRVEGNIPMVYLQVTYYIPIVVWLMEAYPRQPPCVYVNPTRQMVIKRPHPHVNPSGLVSLPYLQNWIYPTSNLADLARNLSLVFGRDPPLYSQQPRPNLNPNSIPPRAFRPSSPHRPAADRTQVHRNAVNRLADRLHGDSEVLRKTREAEMEELFNAQAVLRQREEQISKGLREMQDEKEGLELQLQMILINSDIMEAWLRENQGKRVMDVENAFEYSDFVSSQMLECSSSDLAIDDVIYALDKALQEGSIPFDQYLKNVRMLSREQFLHRAMSAKARATQLQPSRFSMAMHGHLLPVPQPPSSILQHLETTMAAIEALNDKSGSSKSSISKHIELAHGGLPAAHSTLLAHHLNRMKQNGDPVMVRNHCMKPDPNAPPRKGRGRPPEPEVPFPPGTVLTPPRPSCHPLKPRNPYALVSPPKKVSSGSGKPRGRPP

SEQ ID NO: 4313 - protein, 336 aa, Nicotiana tabacum
PRRAAEDCFPPLDYRQQRPSQELVAKDLHGIEWKFRHIYRGQPRRHLLTTGWSAFVNKKKLVSGDAVLFLRTADGELRLGVRRAAQAKTCSNYLAAYSQLLNVSGIVDVVNAISSTNAFSICYNPRASSSGFIIPYHKFSKTLAHPFSAGMRFKMRVETEDAAEQRFTGLVVGVSDVDPVRWPGSKWRCLLVRWDDLDVSRHNRVSPWEIEPSGSAPVSSSLVMPSAKRTRVGFPITKADFPIPRDGIAVSDFGESSRFQKVLQGQEILGINSPYGGFDAHSPRTAGIRCFPGFPSSGASRLGNSIRTLLGDTDKSPESIGFSDSSRFNKVLQGQE

SEQ ID NO: 4314 - protein, 477 aa, Ashbya gossypii ATCC 10895
MTDQSAKEELFKPVGEAVEDTVNDETGLRDTGAADAMGHPVQEIESLCMNCHEDGITRLLLTSIPYFREIVIMSFECPHCGLKNSEIQPASEIQEKGARYQLKVEEKADFDRQVIKAETAASRFVELDLEIPPKRGQLTTVEGLLTEMIEDLDADQAARKEVDENLYDQIAQFIAKVRAALSCEPGTLPLTFTLDDPAGNSWIEYKPGEAAPKWSKTEYLRSDEQNVQVGIITRDQLEQRRQEKRAELSQRERNKSQAAQAGLLSDATDIENFHNEVQTFTATCPSCVHPCDTHMKPVNIPHFKEVIIMSTVCEHCGYKSNEVKTGGAIPDKGRKITLICDDAEDLSRDILKSETCSVSIPELHLDIQQGTLGGKFTTLEGLLTQVYEELESRVFTQTSDSMDEATRNRWTSFFSKLREAIDGKIKFTVIMEDPLAGSYIQNVYAPDADPNMTIEDYERTAEQNEDLGLNDIDVGEH

SEQ ID NO: 4315 - protein, 264 aa, Nicotiana tabacum
KVLQGQEKAVNAYEENAFRRPHDLRQPPQRKLRWRRGQVRLENQQHNHILDPWLDFIGKEVHGTSPSSNGFSNLQSSKIPSFASESLSIPKIVDYRNSNSKGNVESDVMGSQPTGGSKLKLFGVDILNGPESPSQHGSKLTHFGSFPAASKTVNFLEQSKSTSGNSDTQCSRSCTKVLKYGCALGRSIDMSRVKGYGELISELDKLFGFEGSLLDGSKDWHVTYQDREGNTKLLGDYPWSDSQAMVRKMFICPIGADYLADRSF

SEQ ID NO: 4316 - protein, 811 aa, Solanum lycopersicum
MEIDLNHALVSEVEKNVCCNEECDKGGGGGCVNCSLYTSTTSSCSSNVSSSSSLALTSIYKELWHACAGPLTSLPKKGNVVVYFPQGHMEEAVSAFPFSPVKIDLPTFGLQPQIFCRVEDVQLLANKENDEVYTQLTLLPLPESMAISLEGKEHEDSGTDEEGNGVNPGKSASHMFCKTLTASDTTTHGGFSVPRRAAEDCFPPLDYKEQRPSQELIAKDLHGVEWKFRHIYRGQPRRHLLTTGWSIFVSQKNLVSGDAVLFLRGEGGNLRLGIRRAARPRNGLPESIIKSQYSGPDVLSSVATALSAKSTFHVFYSPRASHADFVVPYQKYVKAINSRIPVGTRFKMKFDLDDSPERRYSGVVTGISDMDPFRWPNSKWRCLMVRWDEDIMSNHQERVSPWEIDSSVSLPPLSIQSSPRLKKLRTSQQAPSVLDSHFAGGSALLDFEESIRSSKVLQGQENLGLISPPYGCDKPVRPLDFELQRVARHNLMPNGVENIIVGDFVKTQPPTTYTGFLESNRFPKVLQGQEICSLRSLTGKGDVNFGAWGKPEFGCNVFGTYQRPRANFYPLASEGARNVFLPYNAMYRAGQDPVVPSYSTNFQRENPTLNQNSIQNVVRREEVGMPKFVNEQRPPEMSKVSIPENHFKNENDDSFNAQAPCKLFGFSLTKEPSTPSSQSSGKRSCTKVHKQGSLVGRAIDLSRLNGYDDLLVELERLFNMEDLLRDPNKGWRILYTDSENDMMVVGDDPWHEFCEVVSKIHIYTQEEVEKMTIEGISDDTQSCLEEAPAIMDVSKSSSVGQPDSSPTVIRI

SEQ ID NO: 4317 - protein, 319 aa, Vitis vinifera
MDQLYGLHSPSSSDYHHPPPFPPENLISPSHYPNFNSPAPFPIFGSDQLLSASSLVVSDAASMVAEIQGGGSGEEVSSAIRAKIATHPLYPKLLHAYIECQKVGAPPEVAYLLEEIRRGSELCRRNAVSTCLGADPELDEFMETYCDILVKYKSDLARPFDEATAFLNNIETQLNTLCNGASRSYVSDEAAGSSEEDLSGGEVEVQECLQTTENQELKDKLLRKYSGYISTLKHEFSKTKKKGKLPKEARQALLDWWNIHYKWPYPTEEDKIALAESTGLDQKQINNWFINQRKRHWKPSENMQFAVMDSIYGPFFMNE

SEQ ID NO: 4318 - protein, 192 aa, Picea sitchensis
MGRSPCCEKVHANNKGAWTKEEDERLIAHIEAHGEGSWRSLPKAAGLLRCGKSCRLRWINYLRPDLKRGSISEEEDDLIIKLHSLLGNRWSLIAGRLPGRTDNEIKNYWNTHMKKKLLSRGLDPQSHRPLGQPCKTTLSSRPIPEHEIRGFQSPRTAEVADFFHYDRQESSAFKRAASDAEERPDLNLDLCI

SEQ ID NO: 4319 - protein, 322 aa, Oryza rufipogon
VVATADPSAADSARDTKGMRTGGGSTSSSSSSSSSLGGGASRGSVVEAAPLATQGTAAANAPAVPVVVVDTQEAGIRLVHALLACAEAVQQENFAAAEALVKQIPTLAASQGGAMRKVAAYFGEALARRVYLFRPADSTLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNS

SEQ ID NO: 4320 - protein, 388 aa, Oryza sativa Indica Group
MEAVLRHPSLSRLKPPNPNAQRTPALSITVPLRLRLPNRRLTAAAVFQDQTNPRNPASKGGDDDEAYGEVDRIVSSRTIKNPVFAEDGSATTVTATEYLVEWKDGHEPSWIPAEAIAADVVAEYETPWWTAAKKADAAEITALLADETLRRDPDAEDAQGRTAMHFAAGLGSEECVRALAEAGADVGRPERAGGGLTPLHIAVGYGRPAAVRVLLELGAEPEAPDGQGRTPLELVQDVLAKTPKGNPATFERRLALEAAAKELEKAVYEWGEVEKVVDGRGEGKWREYLVEWRDGGDREWVRAAWVAEDLVKDFDAGLEYAVAEAVVDKREAAEGEGKWEYLVKWVDIEEATWEPAENVDAELLQEFEQRQSGVAAGGDAPPPPPVAG

SEQ ID NO: 4321 - protein, 322 aa, Oryza rufipogon
VVATADPSAADSARDTKRMRTGGGSTSSSSSSSSSLAGGASRGSVVEAAPPATQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNS

SEQ ID NO: 4322 - protein, 322 aa, Oryza rufipogon
VVTTADPSAADSARDTKRMRTGGGSMSSSSSSSSSLGGGASRGSVVEAAPPATQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNS

SEQ ID NO: 4323 - protein, 218 aa, Brassica napus
MVKMGLKPNPVTPNPTHYNAKEIRYRGVRKRPWGRYAAEIRDPGKKTRVWLGTFDTAEEAARAYDKAARDFRGAKAKTNFLELNEKVLSGGGGFARSPSQSSTLDYASPPAVVTPATDGIVPPRLELSLGGGGGACYQIPMARPLYFLDLMGVGNGGRGQLPVSSAFRSPVMQVSTKMACGAQSDSDSSSVVDFEVVMEKRSQPLDLDLNLLPPVEQA

SEQ ID NO: 4324 - protein, 319 aa, Vitis vinifera
MLDLNLNDVSDDSFHGSTQAVDPGKLLDLSSNQMEDSGSFNSSIVNADALSSTTADDDSSSNHLDHCCGIVAFSFDFFKQNEDHDNKSSDSVTRQFFPVTSGGEGDCSLGSSLQHPCILQVGSGGPLLPKKPQQQQQVKKSRRGPRSRSSQYRGVTFYRRTGRWESHIWDCGKQVYLGGFDTAHAAARAYDRAAIKFRGADADINFAVSDYDEDIKQMSNFTKEEFVHVLRRGSTGFSRGSSKYRGVTLHKCGRWEARMGQFLGKKYIYLGLFDSEIEAARAYDKAAIKCNGREAVTNFEPSTYEGEIIFPADNGGKSS

SEQ ID NO: 4325 - protein, 449 aa, Oryza sativa
MSSTAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAFGQLLSRRLVVVPEAAAGSGGDSPEERKDEGEIVEEQEQLLYRVPIFDPALSEFCSPPPLEDAAAAVSCCNEDGAVENPTKPSMTTTTATTPPLQFFPDGQANFGPTDAELREFAADMEALLGRGLDDGNDEDSFCMETLGLIEPVDDDAGRVKVEADGDAGMTLAWCHELDTETSSGEMLDIDFDYGSPQAATTPDEKVGSSGPAAAADDDAQLQQSNLALSLNYEAIIESWGTSPWTDGERPHVKLDDSWPRDYSGVWMAAAGVFGHGGEEQALTPRLGMDGGREARVSRYREKRRTRLFSKKIRYEVRKLNAEKRPRMKGRFVKRAAAAATAAVATACVA

SEQ ID NO: 4326 - protein, 68 aa, Pisum sativum
  misc_feature (5)..(6): Xaa can be any naturally occurring amino acid
FTKQXXRWTDEEHKKFLEALKLYGRAWRKIEEHVGTKTAVQIRSHAQKFFSKINRDTNGNDTTLVESI

SEQ ID NO: 4327 - protein, 175 aa, Brassica napus
EVDILDDGYRWRKYGQKVVRGNPNPRSYYKCTAPGCPVRKHVERASHDPKAVITTYEGKHNHDVPTSKSGSSNHHEIQPRFRPPDETDTISLNLGVGISSNGPNENQQLVNQTHPNGVGFRFVHAAPVSTYYASMNQYGPRETQSETQNGDISSLNHSSSYPYPHNNIGRIQTGP

SEQ ID NO: 4328 - protein, 350 aa, Oryza sativa Japonica Group
MSQRRVAGPMGVMSKQQQEAMAEEMMELRRGPWTLEEDNLLMNYIACHGEGRWNLLARCSGLKRTGKSCRLRWLNYLKPDIKRGNLTPEEQLLILELHSRWGNRWSRIAQHLPGRTDNEIKNYWRTRVQKQARQLKVDANSTVFRDAVRCYWMPRLLEKMAGAATDPTPPPPPPLHHHAAMATASSSPFDFDTHLQQAEAATACVVPNNVYHHHIDPSPSTSTSAGSTAAAAAFQPLPCFSELRWDQQMQSSGELDDGAAGVFVDSASALGSLSLDGLDLGPAEYYSDSTLLDYLNSSCTGSAMMTMMTASGNAGSYNYCGGAMDGGDTWRSDEVCQAAARKLGEWGGGI

SEQ ID NO: 4329 - protein, 445 aa, Physcomitrella patens subsp. patens
MEQQTPSASVNVDSEARSCLTSSHNVYNTSSSAYTNFFNTTAYLPECHTMRPPAPPTYITTDTHRREGYSTSPFAPSCSNFSTLNCSAAHDMASEGSINRDMEKFQQELAYKCPRSSDLLLAITTSANTAVREHGSSAERRRRGNSGLFGNMSLLTEDEDDAPDAQDPEFEDNPQSEQDLELRAAIIDHPFYPEMVLAHVRVFKIGAPRRLRRKLDELAKKFQRFQDCDHTSKIGSDPELDHFMRSYVGVLTKFAEDLEEPFNKFIQFTDNTSKALEEICGHYVDTTPDEDNCGFDIGPLEYGAQEGDDLDTLGDENVMYPLDIDESVIVDPMASDEDIKKALRKKYGRHIGELKAEFNRVRKKGKLPTSARTILKDWFNRHSHWPYPSEMEKQYLQRICGLNLKQINNWFINERKRHWSCEGKCMHPNAKFYGTSNGQCRGHLE

SEQ ID NO: 4330 - protein, 108 aa, Betula platyphylla
HKRHKVCEHHPKAQVVLVGGMRQRFCQQCSRFHELSEFDETKRSCRRRLAGHNERRRKNTAESHAEGSSRKGTGTHQLKDIVCGQVDDRGRIQITIHENSTYKHFQIR

SEQ ID NO: 4331 - protein, 587 aa, Oryza sativa Japonica Group
MGAMAMVEQEGCVENRQPLAASSSSVSDGSSYGGGGGGLAQMSPPVSSSANSISGLRRTSGPIRRAKGGWTPEEDETLRKAVEAYKGRNWKKIAECFPYRTEVQCLHRWQKVLNPELIKGPWTQEEDDQIIDLVKKYGPTKWSVIAKALPGRIGKQCRERWHNHLNPEIRKDAWTTEEEQALINAHRIYGNKWAEIAKVLPGRTDNSIKNHWNSSLRKKQDMYNTSNNMVVPKLLVHDKFKDKPKLMAMEGHLDLNKAPIINSKDQPGTAHRSNCSGFLSRSSLPTAQPLTSREASVVDGSAVTLVAQALESDSVRGKGLEIDSVHEKGLEVNSAPDHTGNSWTIQLEAAPSKGEAELSLKNEARSLGPLCYQIPNMEDVVPVSSSLFSDHLTGNHTSEHCGDDILSPAGCTTPPPTKGKLTSQLSVDSILKSAANSFPGTPSILKRRKRDKSTPVSASEMKISGSNTDRFYTPMGMEPATATPESFKTTSFLSLGSLDGSVKSFDVSPQYRARSKRMALTKTVEKQLDFSSDGLDTCGSEILNSSCNNSQSTLSITEAPKLKEKEHAVQLENLTKNFAHTTNLDVT

SEQ ID NO: 4332 - protein, 239 aa, Eriobotrya japonica
MGGGRVQLKRIENKINRQVTFSKRRTGLLKKAHEISVLCDAQVAVVVFSNKGKLFEYATDSCMEQILERYERYSYAERQLVEPEFESQGNWTFEYCRLKAKVEVLQRNHRHYLGEDLDSLTLKEIQNLEQQLDTALKQIRLRKNQLMHESISELQRKRKAIQEENNLLAKKIKEKEKAAAQPQVQDWEQQNIGLDLLPQPLPCLNNGGTQQDEFLQVRRNQLDLTLEPLYSCHLGCFAA

SEQ ID NO: 4333 - protein, 189 aa, Lupinus hispanicus
SSGPYPYFSSSSSSYHPFAFFNPENGSSNNTFSHDPFSFPYNVPSTHHYHAPNPETVANFADCAASAAMLKNDVSGSNFGFNNFLTKKPTPKKDRHSKIYTSQGLRDRRVRLSIEIARKFFDLQDMLGFDKASNTLEWLFNKSKKAMKELARSKNSSSGVDANSFSSSDSECEVVSMINQDSIDATPEG

SEQ ID NO: 4334 - protein, 150 aa, Brassica napus
MDPSVKEYQEMLKIEKRGHQDLDLGLTLFRGTTSSEFNLIDSFKSSSSSTSHHLHNHQEHLEDPRVFSCNYCQRKFYSSQALGGHQNAHKRERTLAKRGKYYKMSLSSSPPSSAFAFGHGSVSRFASMASLPLHGSTSNRSTLGIQAHST

SEQ ID NO: 4335 - protein, 639 aa, Oryza sativa Japonica Group
MTNSNNGNGGTNAAASGWLGFSLSPHMASSTMDEHHHVHHHQQQQQQQQQQQHHQQQQHGLFFPSVTTAAAAAAYGLAGDVVAATNGYYSQLASMPLKSDGSLCIMEALRRTDQDHHGPKLEDFLGAAQPAMALSLDNTSSFYYGGGGAAAAGHGQHGYLQACDLYGGPAAPSLVTAADEEAAAAAAAMASWVAARGAATAYATGAADANAAENVLPSATAAQHLHHPLALSMSSGSLSSCITAGEYGMAAVAAADGGRKRGGAGGGGQKQPVHHRKSIDTFGQRTSQYRGVTRHRWTGRYEAHLWDNSCKKEGQTRKGRQGGYDMEEKAARAYDLAALKYWGPSTHINFPLEDYQEELEEMKNMTRQEYVAHLRRKSSGFSRGASMYRGVTRHHQHGRWQARIGRVSGNKDLYLGTFSTQEEAAEAYDVAAIKFRGLNAVTNFDITRYDVDKIMASNTLLPADLARRNAATTTSKDDHSAAGAGAIVSVHSAADIAVADTLWKATTAPRQQQQHHDDVVLSGADQAAFSVLHDLVAVDAAAAHQQQQQQQHMSMSAASSLVTSLSNSREGSPDRGGGLSMLFAKPSPAVAASAQQQASTKLMAAPLPLGSWVSSPPASARPPAVSIAHMPLFAAWTDA

SEQ ID NO: 4336 - protein, 189 aa, Lupinus luteus
SSGPYPYFPSSSSSYHPFAFFNPENGSSNNTLSHDPFSFPYNVPSTHHYHAPNPETVANFSDCAASAAMLKNDVSGSNFGFNNFLTKKPTPKKDRHSKIYTSQGLRDRRVRLSIEIARKFFDLQDMLGFDKASNTLEWLFNKSKKAMKELARSKNSSSGVDANSFSSSDSECEVVSMINQDSIDATPEG

SEQ ID NO: 4337 - protein, 260 aa, Zea mays
  misc_feature (188)..(188): Xaa can be any naturally occurring amino acid
  misc_feature (191)..(191): Xaa can be any naturally occurring amino acid
  misc_feature (204)..(205): Xaa can be any naturally occurring amino acid
  misc_feature (230)..(230): Xaa can be any naturally occurring amino acid
QQQHQLLSVSPPPSSAVAASSSGRRKAAASEAARRRRRRPKAVRNTDEMESQRRNHIAVERNRRRQMNEYLSVLRSAMPPSYTQRGDQASIVAGAINFVKELEQLLQSLEAQKRRQRCTEPLAASSFAGFFIFPQYSTTAATSGAVGSSSDSAGSGGDQSGGGGGARRGVADIEVSLAESHANVKVLXRGXPRQLLRMVVALQXXPSPCSHLTVTTTADHLALYSLSLKXEDECRLSPSVDDIAAAVNEILDECARGGAH

SEQ ID NO: 4338 - protein, 190 aa, Genista umbellata
SSGPYPYPYFPSSSSSYHPFPFINPESASANNNTFPHDPLYVSYNIPTTHHHAPIPETLAKFSDCVAAAAMFKNDVNGSKFGFSNLLAKKPAPKKDRHSKIHTSQGLRDSRVRLSIEIARKFFDLQDMLGFDKASNTLQWLFNKSKKAMKELAQSKNSSSGVANSFSSSDSECEMVSIINQDSIDATPEG

SEQ ID NO: 4339 - protein, 320 aa, Glycine max
MMEHNIIVNNNNVIAPFVIKTYNMVNDPTTDKLIMWGPANNSFIVLDPLDFSHSLLPAFFKHNNFSSFVRQLNTYGFRKVDPDRWEFANEWFLRGQKHLLRNIARRKHGGAGRSNFNLHSHHHPLKVEELDDEAMVMEIARLKEEQKALEEELQGMNKRLETTEKRPQQMMAFLSKVVEDPQVLSRILREREKKHLGEKKRRLIPPPTTTAATTSSSSSSGIKTEFEEDEGNYNIMSSSPETGLEIDNNNICSPLAAGYWGEQGCHGYNRGAVTAPLTVVAPAVPTMGGGYLGRGVFFGEMAAEGNAVPPYPFSLLEGGF

SEQ ID NO: 4340 - protein, 348 aa, Arabidopsis thaliana
MSSEDWDLFAVVRSCSSSVSTTNSCAGHEDDIGNCKQQQDPPPPPLFQASSSCNELQDSCKPFLPVTTTTTTTWSPPPLLPPPKASSPSPNILLKQEQVLLESQDQKPPLSVRVFPPSTSSSVFVFRGQRDQLLQQQSQPPLRSRKRKNQQKRTICHVTQENLSSDLWAWRKYGQKPIKGSPYPRNYYRCSSSKGCLARKQVERSNLDPNIFIVTYTGEHTHPRPTHRNSLAGSTRNKSQPVNPVPKPDTSPLSDTVKEEIHLSPTTPLKGNDDVQETNGDEDMVGQEVNMEEEEEEEEVEEDDEEEEDDDDVDDLLIPNLAVRDRDDLFFAGSFPSWSAGSAGDGGG

SEQ ID NO: 4341 - protein, 772 aa, Glycine max
MGCTASKLENEDTVRRCKERRRLMKEAVYVRHHLAAAHSDYCRSLRLTGSALSTFSTGEPLSVSDHTPAVFLNNSQHLQHQHQHQHQHQPSPSPPPPKLDPILPRRRKPPPPKLPHILSDSSPSSTPRSHVSNFFPTAHSTYSSTPSQTSSVWNWENFYPPPPPPASGYFPEEQQQKFSHTKTQTPSHYSHKTQTPSHYSHKTQQHTNLQIHDTDSERSEYDYFDGKLETENENEKTDSHSHHLPEEYTETEREEVQCSEWGDHYSTTSSSDDGDDRVEGDVESRSEIGTRSNFGSSVRAESVVGVGGGGGAKRFDAASSVAAAEMKMVVRHRDLREIVEAIKENFDNAASAGDQVSEMLEISRAQLDRSFKQLRKTVYHSSSILSNLSSSWTSKPPLAVKYRLDTGSLDEPGGPKSLCSTLERLLAWEKKLYEEVKAREGVKIEHEKKLSALQTQEYKGEDEAKIFKTKASINRLQSLIAVTSQAVSTTSTATIGLRDSDLVPQLVDLIHGFMYMWRSMHHYHEIQSNIVQQVRGLVNRSSRGDSTSELHRQATRDLESAVSAWHSSFCRLIKFQRDFILSLHGWFKLSLVPVHNDNINSRETSDTYQFFDEWKLALDRVPDTVASEAIKSFINVVHVISSKQVEELKIKKRTETASKELEKKASSLRNLERKFYSSYSMVGISLPDSAPDNGQVLDARDPLAEKKLELATCQRRVEDEMLRHSKAVEVTRAMTLNNLQTGLPGVFQALTSFSSLFTEALESVCTRSYAIK

SEQ ID NO: 4342 - protein, 291 aa, Arabidopsis thaliana
MQEAALGMMGATVGGDGDTAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 4343 - protein, 942 aa, Oryza sativa Japonica Group
MEQKPSPPPPPRSDEEEDGLMGCGMGGTGDIAGGDLDLMEEFLLATPGFDLSEFWHPGAASPFSPLFDIGSSVTTLTTPAPAAGEDDRDEAEMPSRGGGGLEVSPAHRGWTFQTAPQEVALEPTVKERLRRALERIASQSQSQAQRGDGELLVQVWVPTRIGDRQVLTTCGQPFWLDRRNQRLANYRTVSMKYQFSADESARADLGLPGRVFVGRVPEWTPDVRYFSTEEYPRVQHAQYFDIRGSVALPVFEPRSRACLGVVELVMTTQKVNYSAEIENICNALKEVDLRSSDVSSDPRSKVVDASYRAIIPEIMDVLRAVCDTHNLPLAQTWIPCICQAKRGSRHSDESYKHCVSTVDEACYVRDCSVLGFHQACSEHHLFRGEGVVGRAFGTNEPCFSPDITTYSKTQYPLSHHAKLFGLRAAVAIQLRSVKTGSLDFVLEFFLPMKCINTEEQRAMLNSLSNTIQQVCYTLRVVKPKELVNDGPFEISQPTRPEFYAKSVHEDLDELCSGINVPGRTTSLEASEEVSSWIASLVDAQNKGGKGEIDVDLPFGFSKQDDEGFSVTAGWHTSPVMAPDGSMFSGFKRHEDYDVKENTCSSDPSNSNSDKAVEKRRTKTEKTVSLQDLRKHFAGSLKEAAKNLGVCPTTLKRICRQHGINRWPSRKIKKVGHSLKKLQMVIDSVHGPEGTVQLSSLYENFTKTTWSERELQGDVHFPASEQNFQLEPSVPDRPCEGRFTSHTSGSNSISPSCSQSSNSSLGCSSVPKTQQQHGSAPQLAVKEEISMDENQCSTLIKSASHAEAELQMFVEERPTMLFRSQSQVLLSEHKPIENMSNVQKARSDSLKIKAIYGEERCIFRLQPSWGFQRLKEEIVKRFGISQDTHVDLKYLDDESEWVLLTCDADLLECIDVYKSSSNQTVRILVNPSIQPLLNASFGQTGLS

SEQ ID NO: 4344 - protein, 349 aa, Triticum aestivum
MCGGAILSDIIPPPRRPAGGRLWQADRKKRRAGPRRVPEEEPEEEAEEGDEDFEADFEGFVDEESDGEVKPFPARRSGFSGDGLKATAAGEYDCASGSAKRKRKNQFRGIRRRPWGKWAAEIRDPRKGVRVWLGTYNSAEEAARAYDVEARRIRGKKAKVNFPEEAPMAPQQRCATAVKVPEFNTEQKPVLNTMGNADVYSCSAVDYTLNQQFVQPQNMSFVPTVNAVEAPFMNFSSDQGSNSFSCSDFSWENDIKTPDITSVLASIPTSTEVNESAFLQNNGINSTVPPVMGDANVDLADLEPYMKFLMDDGSDESIDSILSCDVPQDVVGNMGLWTFDDMPLSAGFY

SEQ ID NO: 4345 - protein, 285 aa, Populus trichocarpa
MIIDDHNRNHNNNTVTATGCYFMDNNDGSSSSVKAKIMAHPHYHRLLAAYANCQKVGAPPEVVARLEEACASAASIAPANTGCIGEDPALDQFMEAYCEMLTKYEQELSKPLKEAMLFLQRVECQFKALTLSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 4346 - protein, 349 aa, Triticum aestivum
  misc_feature (66)..(66): Xaa can be any naturally occurring amino acid
  misc_feature (256)..(256): Xaa can be any naturally occurring amino acid
MDGGVAAAAAAAAAASTVTTAVAPPGAAGAGAPPPFLMKTYDMVDDPATDAVVSWGPANNSFIAWXNTPEFARDLLPKYFKHNNFSSFVRQLNTYGFRKVDPDKWEFANEGFLRGQKHLLKTITRRKPSHANNQVQVPQQQPQQQHQQQPQLQNAPMPSCVEVGKFGMEEEIEMLKRDKNVLMQELVRLRQQQQTTDHQLQTLGKRLHGMEQRQQQMMSFLAKAMQSPGFLAQFVQQNENSKRRLVAAHKKRRLPXPDDGLNSESALLDGQISSITYDLRSTKPCLGKSCTRILPNRIESMVHQIIFSGTCFPVPNFDSLYNPNFGSPFKVPGNLGCLIAQNLRFNIWV

SEQ ID NO: 4347 - protein, 426 aa, Arabidopsis thaliana
MDSKLLLVTQSGSVDDLYSLIQAAPDILQKVDVLPIIHTPLHEASSAGKLDLAMELMILKPSFAKKLNEYGLSPLHLAVENDQVELALELVKVDPSLVRIRGRGGMTPLHLVAKKGDVDLLTDFLLACPESIKDVNVNGETILHITIMNDKYEQLKVLTGWMQKMRDSDDVFIDVLNRRDRGGNTVLHLAAYENNDKVVKQLVKCLSLDRNIQNKSGMTALDVLRARGSHMNKEIEEIIQMSGGKTGGSLSGIQEWYIFLREPVTFKEHCKTRIARYRSRISDGSRNALLVIAALIISATFQTAAQLLDKEKLDKVKKNGMRFSEFQLWGCNTVAFSIAILFSFILLPVGRAYEWWYFIITVPLVFSYFLLMYMMHGLSFFFLIIYEGGLFLVYLLVLYVKWKRCTQMKVRKPKSDLISDNFKNMV

SEQ ID NO: 4348 - protein, 689 aa, Solanum lycopersicum
MVYKKKLDFGFNGFQVPVIPKAPRSVRRRRSCKKLDDDQICAFELLAAVAGKLLLESESSTSSNAAEGKNEIADGRDGIKSEQVEEGKAVKSECLDQGSCVESDYLPDTAVQDQNLKHGFDKPHHAENNYFLEHTSTVIGSDADLKLENCKEVNITDGKFHHKIEGGSSSLEDPCDSKIRTGTQKHLDDDSKQIEDVTVTNTCSVKNPIKECVNNSGLFNSDGSVQLPLYRDSVPSASFVKQRNSVKLGVRDDDENSFDCYRYSAKLRAFRTTSRLGYRRIRKMLKSRHWKVAPKLKEYERSYTNGGMESFYLSRKSVRARKRCQLEVPSKRRKLSNHGFAVAYYQEASSESVTNSPDKEIKRDISTSHAIPPRGTADPASVNNHHKKDPNVKFSIKSFKVPELYIEVPETATVGSLKRTVMEAVTAILESGLRVGVVLQGKKVRDDNRTLEQAGISQNGNLDNLGFTLEPRFTQVSPSSSPNKLPASSTYVADQELTRRRPSPIMEFGIHNASADPLETDMCKYSENNHPSELSPTNPIDSSTDVSIPDSRALVIVPSVNAEALAMVPLNHKSKRSELSQRRIRRPFSVAEVEALVEAVEHLGTGRWRDVKMRAFDNADHRTYVDLKDKWKTLVHTASIAPQQRRGEPVPQELLDRVLAAHAYWSQQQGKHHAELLKTPDAKAQKVSA

SEQ ID NO: 4349 - protein, 261 aa, Physcomitrella patens subsp. patens
MVEKVVVSSLRVKRGGNLLAPLKRNVSSIAKKSSTPKSGKPVGSPKVYKGVRMRTWGKWVSEIREPNKRSRIWLGSFPTAEMAAKAYDAAAVCLRGRSVKLNFPDSPPRCAARCNSPREVQAAATAAAVACIPSATALTVANFQSPAQTLESSPLHSSPSSSDMSSGDEDSGEDSVQSFVAEGSQISPSEVVPVLEWVKVEFGDKETVAAGDVDFDCDYSFISEFAADSLLACSYNSKGRTEYLPIETHDAALYDSTLWFF

SEQ ID NO: 4350 - protein, 338 aa, Arabidopsis thaliana
MPTLYKKAGCQFQLTTMGGVKRKISIELIEKKDSRAVAFSKRSRGLYSKASDLCLLSDAQIAIIATPVSSKSNVSFYTFGHSSVDNVVAAFLTNQRPREGLGLDYWWEDERLSKSEDLEELRDAMDSMSKMLKDLKDLQNQRDCEEDVKKKGVLHGTHQKQTFNPESCSVNFDGFNKNTEEFDLDEIFDYVSTAEALSMNLDMDDVSVVTTNQNPVSASETVEDRELVVHKNMDEDNIHVSDMDDKDTMLMISDKNNVLPENLDEFDQELDLDQLLDFETNYESLLKSCEMEDYASMVTTKQNLCSNPEAVEDGGLMIQKDLPEDNLCFSDYFSDLHC

SEQ ID NO: 4351 - protein, 638 aa, Oryza sativa
  misc_feature (98)..(98): Xaa can be any naturally occurring amino acid
  misc_feature (114)..(114): Xaa can be any naturally occurring amino acid
  misc_feature (125)..(125): Xaa can be any naturally occurring amino acid
  misc_feature (145)..(145): Xaa can be any naturally occurring amino acid
MVLQKRLDYGSHGHRAPIKPRVATLAPVKRSTRIRKKQMYALDLLATAAEKLLADQDNLSSGPNINETPEGYVTSMKPSLKQNSLNEAFSRLKNVAVXKKDECKGCTVGCAGIXGFLKKPNMGLXAKTRPTQNLADSVLESLTAXKPDVLAKDSFVSSKKSCRLGFGLGTIPEYGSVGVCQPWSTRSAEVKQVHRARPTAIRSQEDSDAAALCALVETMDLDTKPLAEASSGSNSGVHICGPDRGHNSHPSCLAKVQHAADRDDDENSSGCVHPSTSGNNRGYIPHYIGDRRIRRLFASRLRKAARNRICGEMSCKGNKLSLCEKKMPTTRRRVQQTTLKRKRLAQLYSEKSSDEVKLTIKSFNIPELLIEIPENATVGSLKKTVSDAVTTIIERGLRVGILLQGKNIQNDNKTLRQAGICRGKKLNDIGFTLECEAGQDSHPGVIVPEEMDFVGASVVDKSATVKCEEPAENQQLMQDFPGCSLSDPGSVDYPVEWSTQETSASSQAIVPFADPNSLALANVPLSRSKRPDFGQRRIRRPFTVAEVELLVEAVEHLGTGRWRDVKFRAFENVHHRTYVDLKDKWKTLVHTASIAPQQRRGAPVPQELLDRVLAAQAYWSEQQAKLHGDPPVPEICPT

SEQ ID NO: 4352 - protein, 247 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTNEYENQHRTTVSIGMDPELDQFMEAYCEMLTKYHEEL

SEQ ID NO: 4353 - protein, 278 aa, Glycine max
  misc_feature (92)..(92): Xaa can be any naturally occurring amino acid
  misc_feature (104)..(104): Xaa can be any naturally occurring amino acid
  misc_feature (125)..(125): Xaa can be any naturally occurring amino acid
MANRWWTGSVGLENSGDSMKKPDLGFSMNESAVTGNHTGEEEEKGNSDEPREGAIDVSTTRRPRGRPPGSKNKPKPPIFVTRDSPNALRSRXWEIAAGADIADXVAQFARRLQRGVSILSGSGTXVVNVTIRQPTAPGAVMALHGRFDILSLTGSFLPGPSPPGATGLTIYLAGGQGHVVGGGVVGPLLAAAPVLLMAATFSNATYERLPLEDDDQEHGGGGGSPPGITGGPGEASSSISVYNNNVPPNLGLSNGQHLNHEAYSSSPWVHSPHARPPF

SEQ ID NO: 4354 - protein, 366 aa, Solanum lycopersicum
GACAKAIAENNLITAEWLMSELRTVVSVCGSPIQRLGAYMLEGLVARLASSGSSIYKALRCKEPTSVELFSYMHLLYEICPYFKFGYLSANGAIVDAMKDENSIHIIDFQIAQGSQWITLIHALAARPGGPPRIRITGIDDSTSAYARGGGIEIVGRRLSSIAASCNVPFEFHPVSASCPDIEIEHLKVLPGEPLAVNFALVLHHMPDESVGTQNHRDRLLRMVKSLSPKIVTLVEQESNTNTAQFFPRFLETLNYYLSVFESIDVALPRDHKERINVEQHCLAREIVNILACEGAERVERHELLERWRSRFAVAGFKPYPLSSSVNATIKTLLENYYQSYTLNERNGALYLGWMNRDLVASCAWK

SEQ ID NO: 4355 - protein, 148 aa, Picea sitchensis
MGTFALPPGFRFHPTDEELIFNYLKVKLKNGLKASEVEVIPDVDLYRCEPWDLPEKSFLPNTDMEWYFFSPRDRKYPNGSRTNRATEAGYWKATGRDRKVYSLASTIGIKKTLVFYRGRAPQGERTDWVMHEYRLEENECEAGPCLQM

SEQ ID NO: 4356 - protein, 438 aa, Oryza sativa Japonica Group
MASMPQLEEKDSSDLAINKGPSLDLVKSPLMMNDASATVTAMQPNEGMEEFPVKVRKPYTITKQREKWTEEEHDKFLEALKLYGRSWRQIQEHIGTKTAVQIRSHAQKFFSKVVREPGSNNAIEIPPPRPKRKPLHPYPRKCANSGSDANPATAQLKLAPGSSSSGSDQENGSPISVLSAMQSDAFGSSVSNPSTRCTSPASSDDGNNIPTFTSGEDNNVPCEPTVIDPSQSHKEIDQDRKDVNNMSEEDSSEEEVQETSLKLFGRTVVIPDPRKRSSSDPKHESEEQISQPSNEEMLQASSSVGEIPAAYCAPNGWFMSYNSFPFQFGESAADARIPPLHVWWPYYGFAPISHPRGLSTVMQQTEGSDESDGVKSHSSESSSDSGENVQMTAPQSSRIVESLGAIYVRDSGSSFELKPSANSAFVRVKPSNSGDEEI

SEQ ID NO: 4357 - protein, 374 aa, Oryza sativa Japonica Group
MEAVLRHPSLSRLKPPNPNAQRTPALSITVPFRLRLPNRRLTAAAVFQDQTNPRNPASKGGDDDEAYGEVDRIVSSRTIKNPVFAEDGSATTVTATEYLVEWKDGHEPSWIPAEAIAADVVAEYETPWWTAAKKADAAEITALLADETLRRDPDAEDAQGRTAMHFAAGLGSEECVRALAEAGADVGRPERAGGGLTPLHIALGAEPEAPDGQGRTPLELVQDVLAKTPKGNPATFERRLALEAAAKELEKAVYEWGEVEKVVDGRGEGKWREYLVEWRDGGDREWVRAAWVAEDLVKDFDAGLEYAVAEAVVNKREAAEGEGKWEYLVKWVDIEEATWEPAENVDAELLQEFEQRQSGVAAGGDAPPPPPVAG

SEQ ID NO: 4358 - protein, 433 aa, Oryza sativa Indica Group
MASSSSDLTLDDHHHLTAVAAASGQATQKLQEFLSRLEEERLKIDAFKRELPLCMQLLNHAMEAYRQQLEAYQMGSQHGAAAAAAARAPLVLEEFIPVKNIGIDVVAADKAAAAAAGGNSVSSEKASWMLALAPAEKAADAITIAAGEVDKKPYAHDNGVVARSREAQNGGKPPSTPPDGQAVPPPPQPHRKARRCWSPELHRRFVNALQILGGAQVATPKQIRELMKVDGLTNDEVKSHLQKYRLHTRRPMPSPAPPTAATPQLVVLGGIWVPPEYATQAAGPAIYGAHPATQPHYTAAVAAQEYYHHHHHHLQHHPAAAALVHHRAVAPPPPLPPQQQLAPPYSAKSSASARLGSPDSDGRGSGGGGGAAASGAGRDMSESIEEEGEGEEREDDDDDDEMAATNNAHAVDGDDDDDEINTTTTTSAGAINY

SEQ ID NO: 4359 - protein, 84 aa, Chlamydomonas reinhardtii
CLKLYCDCFAAGQFCGACSCASCQNRPEYADRVQQRREDIAARDPQAFTRKIMDAPGGGGGKHKRGCNCKRSHCLKKYCECFQV

SEQ ID NO: 4360 - protein, 420 aa, Solanum lycopersicum
AAHAPTIVDQEGVQLKKSIGPKRVTTGNNSNNKEGRWAEHLLNPCAAAITVGNMNRVQHLLYVLHELASFTGDANHRLAAHGLRALTHHLSSPGSSSASSGTIGVTNFSSANHKFFRDSLINFIDVSPWFRIPNNIANSSVLQIIGQQDRLKNLHILDIGVSHGFQWPTLLEELTRRSGGPPPLVRLTVITPTTENGELTGTPFVIGPPGYDFSSQLLAYAKAININLQINRLDNFPLQNLNSQIINSSSDETLVICAQFRLHNLNHTIPDDRTDLLKILKSLDPKGLVLSENNTECSCNSCGDFATTFSRRVEYLWRFLDSTSVAYKGRESEERRMMEGEAAKALTNMGEMNERKEKWCERMRSAGFVKAVFGEDAIDGARALLRKYDSNWEIRVEEKDGCVDLWWKGQPISFCSLWKI

SEQ ID NO: 4361 - protein, 371 aa, Pisum sativum
MEGSSNGSSSYVMAAFGENSGGLCPPMMMMPLVTSSHHHPINSNNNNANNTSCLFLPIPNSTNNNNHYTNNNNSNNTMLQNNHHTTQNTPGLGYYFMDNHNNNGASSSSSSSAVKAKIMAHPHYHRLLEAYINCQKVGAPSEVVTRLEEACASAVRMGGDAVGSGCIGEDPALDQFMEAYCEMLIKYEQELSKPLKEAMLFLQRIEVQFKNLTVSSSSDNIACNEGGDRNGSSEEDQVDLYNNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPTHPHYYMDNVLTNSFPMDLSNTML

SEQ ID NO: 4362 - protein, 135 aa, Oryza sativa Indica Group
MEVNRGEEEDVNLELTLCYTSASSPEPIGFFLCMYCDRKFYSSQALGGHQNAHKYERSLAKRRREIAAALRAHGAPPPPPAPGGAGAAAAQKAVGVEAQQQHQHAPVVGGFARGGGKSSPPAAEYGDGLDLSLRL

SEQ ID NO: 4363 - protein, 155 aa, Physcomitrella patens subsp. patens
SRKPRGRPPGSKNKPKPPVIITRENGNAMRPHVLEVASGHDVWESVTDFARRRQRGVCVMGGSGTVTNVTLRQPTTPGATVTIHGRFEIISLSGSYLPPPAPSPPTGLTISFAGASGQVLGGCVAGALTAASPVLVIATSFTGATYDRLPLADDE

SEQ ID NO: 4364 - protein, 174 aa, Oryza sativa Japonica Group
MVGSSEDEPCSGDADAADFGQEHSSRLADHELKEMLLKKYSGCLSRLRSEFLKKRKKGKLPKDARSALMDWWNTHYRWPYPTVMSRKRLFDTQKPLTHTDLGLCLPIDLSQEEDKVRLAAMTGLDPKQINNWFINQRKRHWKPSEDMRFALMEGVTGGSSSGTTLYFDTGTIGP

SEQ ID NO: 4365 - protein, 872 aa, Burkholderia thailandensis E264
MPNHFSNGRTNQSRTVVIRSGAMPRLLGQPALKFLSLRGEEHLGKLYTYELLLRTPDDFHVPLATSANLDLKAMIGTEMTVGIQLDGIGTGAQGGVGAGAREISGLVVKAGFLRSEGRYNVYRIELRPWLWLATLTSDYKIFQDKSVVEIIDTVLHDYPYPVEKRLDIDKYSVAGESARNEPRAFQVQYGETDFDFVQRLMEEWGIYWFFEHSDNKHRLVLCDHIGGHRKAPSEAYHEIAHHPEGGKIDIEYINYFSTDEALRPGRVVIDDFDFTRPLASLVTSNHQPRETNWGEGELFEWPGDYTDSKHGDLISRVRMEERRATGSRAYGRGNVRGLACGHTFVLAKHKHDDANREYLVIESALMLTEVADETGSGYRYECDNELVVQPSNEVFRMPRETPKPTTNGPQSAIVVGPPGHEVWTDEFGRVKIRFLWDRYARNDATDSCWVRVSQAWAGVNFGGIYIPRIGQEVIVGFMNGDPDRPLILGSLYNTITPPPWDLPGDATKSGFKSKSITGGRENYNGIRFEDKLGAEEFHMQAEKDMNRLTKNDESHTIGANYSIGVGITHTRAVGAMFSSIVGGAASYAVGGAESTMIGGAYALNVGGAHAVAVGGASSVSVGGAYARNVGGAYALTVGGVLSIVCGASSITMTACGSIKIVGKNIRIIGSDEVVVQGAPLQLNPGDSDCGGGGGGGGGGGAIPPIPLPSFFLDITKPILPPPPPPPTEVPPEPTPTPEPTPTPEPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTSSEI

SEQ ID NO: 4366 - protein, 196 aa, Triticum aestivum
  misc_feature (169)..(169): Xaa can be any naturally occurring amino acid
  misc_feature (183)..(183): Xaa can be any naturally occurring amino acid
MYHQHQGPSELFTTRTTFPMERHLFLHGGSTQGDSGLVLSTDAKPRLKWTPELHQRFVDAVNQLGGAEKATPKTVMRLMGIPGLTLYHLKSHLQKYRLSKNLQAQVNVGTNKNTIGCAIAADGMPGTSVPAMINTNVIPQPEKTMQIGEALQMQIEVQRQLNEQLEVRXQRHLQLRIKAQGKXYLQAVLEQAQESL

SEQ ID NO: 4367 - protein, 632 aa, Triticum aestivum
RATCSVSITPPRPLLRVRGEALRPHLTAVAAVPPHVFCRVVDVNLQADPATDEVYAQVSLLVDNEEAKRRMRQGESEEACDGDGEDTGAAKRRARMPHMFCKTLTASDTSTHGGFSVPRRAAEDCFPPLDYNLQRPSQELVAKDLHGTEWRFRHIYRGQPRRHLLTTGWSAFVNKKKLVSGDAVLFLRGEDGVLQLGVRRAAQLKNVSPFPALFNQDSSLRSLGNVAHAVAMKSIFHIYYNPRLCESEFIVPYWKFMRSFSQPFSVGMRFKMKYENEDASERRSTGMITGSRESDLKSHGSKWKCLVVRWDDDVECRRLNRVSPWEIELAGSVSGSHLSSPHSKRLKPCLPQVNPDMLLPSGSVSSDFAESARFHKVLQGQELLGSKAHDGTVNSASEASQASEARNFQYSDDRNCSINMCNIPGVPGLGARTPPENHGFSYHCSGFGESQRFQKVLQGQEVFGPYEGGTLSDAVIRGSSFCQPDGNYTSRATYKWLMSQGCDYRGPVTPAMPQASSPLSVLMFPQTSSKIHGFEYVCRSLDKDDNIRHVTINATQDMGRTSHTLPLWPRLVSGKAVASCAGTKKLPSIGSAEHEPNDKDVHTNGCKIFGISLTQKVRVCDEVECSSANCDF

SEQ ID NO: 4368 - protein, 472 aa, Oryza sativa Japonica Group
MEGGRLGGAAASASAAAAADARGGMSGFAAPQHAIVKHGPGSVTHCGGKWTFAELCQSEQIWVLDCYCMQWACKFATNATECHTNLNNVQPTQVTDFGALAQSAGFRIEDLANLSTNGLFNLKSNAHTIINDPLQFENYVKSISPSNITTTATVTVVDPQTLVPQKGAQLNLVTIRTGNVENWGESTIADTSPRTDTSTDPDTDERNQMFEQGQLAAPTASDSSDRSKDKLDHKTLRRLAQNREAARKSRLRKKAYIQNLESSRLKLTQIEQELQRARQQGIFISTSSDQSHSASGNGALAFDMEYARWLEEHNKHINELRAAVNAHAGDNDLKSTVDSIMAHYNEIFKLKGVAAKADVFHVLSGMWKTPAERCFMWLGGFRSSELLKLLAGQLEPLTEQQLAGIANLQQSSQQAEDALSQGMEALQQSLAETLASGSLGPAGSSGNVANYMGQMAMAMGKLGTLRKLPTAG

SEQ ID NO: 4369 - protein, 113 aa, Brassica napus
WKKIAEFFPDRTEVRCLHRWQKVLNPDLIKGPWTQQEDEKIIELVEKYGPAKWSIISDSLPGRIGKQCRERWHNHLNPGINKDAWTPEEELALMNAHRVHGNKWAEIAKVLPG

SEQ ID NO: 4370 - protein, 359 aa, Vitis vinifera
MQDPSNPNPISHSHNAHQPPSTSFPNTATSLRGGHHRRAHSEVNFRIPEDLHLVSDPFDVPSASFEEMGSEDDLFCTYIDIDKFGSRPEGDARIDNAGGGLAAESGDGEKSSRPRHRHSNSVDGSSMSRGESLFVDTIEAKKAMAPDKLAELWTLDPKRAKRILANRQSAARSKERKARYILELERKVQTLQTEATTLSAQLTLFQRDTTGLTTENTELKLRLQAMEQQAQLRDALNEALKKEVERLKIATGEIMTSSDAYNLGMHHVPYTQSSFFSHQSQPGPSESQNIQMPQFHPFPSNMLTHHQPLLGAAHSNALSDMLQQDPLGRLQGLDISSRGPSLVKSEGPSISASESSSTF

SEQ ID NO: 4371 - protein, 151 aa, Physcomitrella patens subsp. patens
GVHGSNARSKYECATCKRQFKSHQALGGHRASHKKVKGADNEEMQMTAHKSKSHECSICHRVFNSGQALGGHKRCHWSGGSGAGEVTSAKPVQSQEELEGGPQRRPVKEAVLDLNLPAPEFLEEEMAQQQDAVVPLNYLPAPSLNLYPIYA

SEQ ID NO: 4372 - protein, 571 aa, Malus x domestica
MAGAKLEECCLENKQSMATSSSSVSEGSGSAIIKSPGACSPASASPTQRRTSGPIRRAKGGWTPQEDETLRNAVAAFKGKSWKKIAEFFPDRSEVQCLHRWQKVLNPELVKGPWTQEEDDKIIELVAKYGPTKWSLIAKSLPGRIGKQCRERWHNHLNPDIKKEAWTLEEELALMKAHQMHGNKWAEIAKVLPGRTDNAIKNHWNSSLKKKLDFYLATGKLPPPPKYGAKEPRSNATKKILVRSTKGSDSTAQTSSGNADMSKLDEDGKDQFESAAPPQDMGASSSVHPNECADSEGVECDLRLSFMDLSCSNSDSGPKFDNFGVKRKPQIENSVSNGRAESENCGFSNQMDEDSVKTTSFPFETPRYGSLYYEPPPLESSVQFNSGFSSMHRLQNDYTSSPNLSPISFFTPPCVKGSGLCNQIPESILKIAAKTFPNTPSILRKRKTIGQGKSPCHKVAVVDCESVREMLNVSSEHKNSAEVSGSQDGSLCESPTSNGISTIGPNGKAFNASPPYRLRARRTAVFKSVEKQLEFTCDEEYDANSMSVELSANGGSVVIKDCTHPTKMAVT

SEQ ID NO: 4373 - protein, 468 aa, Oryza sativa
  misc_feature (268)..(268): Xaa can be any naturally occurring amino acid
MDRDQMTNTMRDQAANLTSMNPLFYPFMADDALLGMAPPPPQQLLPSVSIQHMDWSPDTMLDNLTFIEEKIRQVKDVIRSMAGRRASSSSAATPEQQLVNADLTCLIVQLISTAGSLLPSLKNSSFLSRTTPPPAAAAGAAQAVSLAAGESSSSARNNETNREDEEEQMGSPDYDELFKVWTNGGAMDECVGAAGDEQDARENPAAAAEEEKYEVLQLEEDEILAPHTHFCGICGKGFKRDANLRMHMRGHGDEYKSAAALAKPPPPXPEGEEQPPQPERRYSCPHAGCKRNRMHASFQPLKTILCVKNHYKRSHCEKRHVCGRCGAKRFSVMADLKTHEKHCGRDRWLCSCGTSFSRKDKLFAHVALFQGHAPALPPPPPPPTSGRRRHKQEEPEFTWGGGGGNEFLDVKGIAGVGSGSGGGDEFFSAGSFGAMDFGFGQLDASLAMLLPSESEQFAGDHQEENGDK

SEQ ID NO: 4374 - protein, 388 aa, Oryza sativa Japonica Group
MAKSRRIAAAHLTCMEIFNRALDWALERELHTSRRGADDDRQILKLVHAATARGRRSRGRGSTSPPRKGGMESSVPMIMADKKASAFHIRRTGKNIWKKPDRDFSKIPFPMAGVHQGSHPEAGANKHTEVEEEQEDRLRADTRVINMVTVREEIRKGPWTEQEDLQLVCTVRLFGERRWDFIAKVSGLNRTGKSCRLRWVNYLHPGLKRGRMSPHEERLILELHARWGNRWSRIARRLPGRTDNEIKNYWRTHMRKKAQERKSNMSPSSSSSSLTYQSCHPETPSMIIGIEEQELHGGSGCITSIMKSTPVDMDGYPMDQIWMEIEAPNVLPGPCFDEAKDSASNSLSGPLLPYPMWDYYCPETCLRMDDEIKVAPQFGYGKGVGPCY

SEQ ID NO: 4375 - protein, 464 aa, Oryza sativa
MIVGAGYFEDSHDQSLMAGSLIHDSNQAPASSENTSIDLQKFKVHPYSTEALSNTANLAEAARAINHLQHQLEIDLEQEVPPVETANWDPAICTIPDHIINHQFSEDPQNILVEQQIQQYDSALYPNGVYTPAPDLLNLMQCTMAPAFPATTSVFGDTTLNGTNYLDLNGELTGVAAVPDSGSGLMFASDSALQLGYHGTQSHLIKDICHSLPQNYGLFPSEDERDVIIGVGSGDLFQEIDDRQFDSVLECRRGKGEFGKGKGKANFATERERREQLNVKFRTLRMLFPNPTKNDRASIVGDAIEYIDELNRTVKELKILVEQKRHGNNRRKVLKLDQEAAADGESSSMRPVRDDQDNQLHGAIRSSWVQRRSKECHVDVRILDDEVNIKLTEKKKANSLLHAAKVLDEFQLELIHVVGGIIGDHHIFMFNTKVSEGSAVYACAVAKKLLQAVDVQHQALDIFN

SEQ ID NO: 4376 - protein, 312 aa, Malus x domestica
MAVSRKDMDRIKGPWSPEEDDSLQRLVQKHGPRNWSLISKSIPGRSGKSCRLRWCNQLSPQVEHRAFTPEEDDMIIRAHARFGNKWATIARLLNGRTDNAIKNHWNSTLKRKCSDGGGVDLNGGYDGHFLRDHEQPPLKRSVSAGSGVPVSTGLYMSPGSPSGSDASDSSAQVMSLSDCHVYRPLARTGGVLPPAETTSSSNNNSSNSEKNDPPTSLSLSLPGVDSEEVSNQVAPVTESTQAPAPAPVSTTSVAVQNIPVELLAVMQGMIRKEVRNYMAGLEQSGVCFQQAAAGNEGFWNVGVKRIGFSRIE

SEQ ID NO: 4377 - protein, 152 aa, Brassica napus
  misc_feature (55)..(55): Xaa can be any naturally occurring amino acid
  misc_feature (128)..(128): Xaa can be any naturally occurring amino acid
  misc_feature (146)..(147): Xaa can be any naturally occurring amino acid
  misc_feature (151)..(151): Xaa can be any naturally occurring amino acid
MSGEGSKDHQDEDEATLPGFRFHPTDEELLGYYLRRKVENKPIKLELIKQVDIYXKFDPWDLPRVSSVGEKEWYFFCMRGRKYRNSVRPNRVTGSGFWKATGIDKPVYSSLDCVGLKKSLVYYLGSAXGKGTKTDWMMHEFRLPSXXKPNXP

SEQ ID NO: 4378 - protein, 298 aa, Malus x domestica
MAAPTTPNEENEFRRGPWTLEEDNLLIHYIVNHGEGHWNSVAKLAGLKRTGKSCRLRWLNYLKPDIKRGNLTPQEQLMILELHSKWGNRWSKIAQHLPGRTGNEIKNYWRTRVQKQARQLNIESNSEQFLDAVRGFWVPTLLQKMEQSSSSCSSTLSTSQNSASPCLSPNHAAPSVPLSTSPPSNATNVLDNYHISGNSNLATVPSNILSADSFVSHVPQMAEPSTSFPPAYYRLGYSSLSPDGSHYVDSSSYDVEGLSLDPVSPMGNLGNSQFDCQMGGNDWMLDNVTDSLWNMDGP

SEQ ID NO: 4379 - protein, 382 aa, Glycine max
  misc_feature (343)..(343): Xaa can be any naturally occurring amino acid
MEAIFVTKPASHSLLLTKLSPNPKHLFPPHQQSFHNIRHKPTRFRPVIAVFQNQHQQDAAAASNHTEDESYGEVKGIIGSRALEAATGMEYLIEWNDGHAPSWVPADFIAKDVVAEYETPWWTAAKKADESALKNLIESDDGRDVDAVDADGRTALLFVAGLGSESCVKLLAEAGANLDHRDRSGGLAALHMAAGYVRPGVAKVLLDLGADPEVADDRGRTALDLAREILKVTPKGNPMQFGRRIGLEGVIRVLEGAVFEYAEVQEILERRGKGENLEYLVRWKDGGANEWVKAKFVAEDLVKDYEAGLEYAVAEAVLAKRVADEGTPEFLVKWADLEEPTWXPEENVDPELVKAFEGSNNQAQPSSNGPAVVFSNQDSPSL

SEQ ID NO: 4380 - protein, 633 aa, Oryza sativa Indica Group
MVLQKRLDYGSHGHRAPIKPRVATLAPVKRSTRIRKKQMYALDLLATAAEKLLADQDNLSSGPNINETPEGYVTSMKPVKAEQFDEAFPLRSVAVKKDDCKGCTVGCAGICGFLRQANMCLAENSSTQNLADSVLESLTAKPDVLAKDSFVSSKKSCRLGFGLGTIPEYGSVGVCQPWSTRSAEVKQVHRARPTAIRSQEDSDAAALCALVETMDLDTKPLAEASSGSNSGVHICGPDRGHNSHPSCLAKVQHAADRDDDENSSGCVHPSTSGNNRGYIPHYIGDRRIRRLFASRLRKAARNRICGEMSCKGNKLSLCEKKMPTTRRRVQQTTLKRKRLAQLYSEKSSDEVKLTIKSFNIPELLIEIPENATVGSLKKTVSDAVTTIIERGLRVGILLQGKNIQNDNKTLRQAGICRGKKLDDIGFTLECEAGQDSHPGVIVPEEMDFVGASVVDKSATVKCEEPAENQQLMQDFPGCSLSNPGSVDYPVEWSTQETSASSQAIVPFADPNSLALANVLLSRSKRPDFGQRRIRRPFTVAEVELLVEAVEHLGTGRWRDVKFRAFENVHHRTYVDLKDKWKTLVHTASIAPQQRRGAPVPQELLDRVLAAQAYWSEQQAKLHGDPPVPEICPT

SEQ ID NO: 4381 - protein, 329 aa, Malus x domestica
MGRSPYCENAGLKKGPWKPEEDQKLLAYIEEYGHGSWRTLSAKTGLQRCGKSCRLRWTNYLRPDIKRGNFSLQEEQTIIKLHALLGNRWSAIRAHLPKRTDNEIKNHWNTHLKKRLTKMGIDPMTHKPKSHALCPSQLKDAANLSHMAQWENARLEAEARLVRKSNLHVSTPFQTQLGSSAAPARLVNKDLAPPPPPPPPLCLDVLTAWQGSFTNSTSMPSFQYNNGGACDETMGMRVEDHGFGKSNKFSELKEIIDAYNIGEVWKAENANVLLPNFMEDLSDLLFESSNELYGNSNNVVGISCYGDFEENNKIDSHWNNMVNLVNCSK

SEQ ID NO: 4382 - protein, 372 aa, Sinapis alba
MGSSHEEGKSTTQSDKPAQVQAPPPPPPPIQEQSNVHVYHHDWAAMQAYYGTRVAIPPQYYNSNGHAAPPPPYIWGSPSPMMAPYGTPYPPFCPPGGIYAHPGVQMGTQPQGPTSQATPVVTTPLNLEAPANSAGNTDQGFMKKLKEFDGLAMSISNNKAGSAEHSSEPRNSQSSENNDDSSNGSDGNTTGGEQSRKKRSREGSPTNDGKPSSQIVPLLRDENEKQAVTMGTPVMPTAMDFPQPCHGAPREVWNEKEVKREKRKQSNRESARRSRLRKQAETEELSVKVDALVAENMTLRSKLGQLNDESEKLRLENEALLAQLKATQTQATGKTENLISGVDKNNSVSGSSKNVEQQLLNVSLRTDSVAAS

SEQ ID NO: 4383 - protein, 258 aa, Arabidopsis thaliana
MKMMQEEGNRKGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHMRKKAQEKKRPVSPTSSFSNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSG

SEQ ID NO: 4384 - protein, 258 aa, Oryza sativa Japonica Group
MGRAPCCEKMGLKRGPWTAEEDRILVAHIERHGHSNWRALPRQAGLLRCGKSCRLRWINYLRPDIKRGNFTREEEDAIIHLHDLLGNRWSAIAARLPGRTDNEIKNVWHTHLKKRLEPKPSSGREAAAPKRKATKKAAAVAVAIDVPTTVPVSPEQSLSTTTTSAATTEEYSYSMASSADHNTTDSFTSEEEFQIDDSFWSETLAMTVDSTDSGMEMSGGDPLGAGGASPSSSNDDDMDDFWLKLFIQAGGMQNLPQI

SEQ ID NO: 4385 - protein, 469 aa, Zea mays
  misc_feature (300)..(300): Xaa can be any naturally occurring amino acid
SQTIEEFRYASRHPSAPLSVSTPTAGDHRTHSRRHDHHHGSKRKKKPPPPPSPQPSLPLAPRTPPPPGAPSPKVRAAGKNNHAQYQYQQRRGQPTKNRAAAASSSWEQVKSLLSCRTATAAARVHDPSALARLRGASLCAMRDVVLSSASGDRDTAPLNRRRAPSSSAASGAGSSSHHSSLRGLSGCYECRAIDVEPMSRRRYPRPRELCACPQCGEVFTMADSLEHHQAIRHAVSELGPEDSGRNIVDIIFNSSWQKRGRPICHIDRILKVHNAPRTVARFEAYRDAVRSRSRCRAAAXRVAADGNELLRFHSAPLACALGLGGATALCCAGGASSPCGVCTAIRHGFAPWAGAHPLGVRTTASSARAHDCGCSASPSSVQQTQQPANDAAACRAMLVCRVIAGRVRRGGGGGATSNAADEDQEGPFDSVAVEDAVSSSMYGNLEELFVANPRAILPCFVVIYRVLDA

SEQ ID NO: 4386 - protein, 365 aa, Zea mays
  misc_feature (58)..(58): Xaa can be any naturally occurring amino acid
  misc_feature (91)..(91): Xaa can be any naturally occurring amino acid
  misc_feature (109)..(109): Xaa can be any naturally occurring amino acid
MYHPQCELLTMAHETPDLDAGQPHLTVSGVASIPAELSFHLLHSLDAAAAVNPVTAPXSSTIDYFLGGADPHQQAMQYEPLPPAAGGHHQXTMDMFRDYCDGHYPTAEXYIRGTMTGALVFGATDDDDSAAAYMPGGHFETSPPPPRATGRGRKRGRALGGGFHAVLANGVEKKEKQRRLRLTEKFTALMHLIPNVTKTDRATVISDAIEYIQELGRTVEELTLLVEKKRRRRELQGDVVDAAAAAVVAAAGEAESSEGEVAPPPPAVPRQPIRSTYIQRRSKDTSVDVRIVEEDVNIKLTKRRRDGCLAAASRALDDLRLDLVHLSGGKIGDCQIYMFNTKIHKGSSVFASAVAGRLMEVVDEY

SEQ ID NO: 4387 - protein, 290 aa, Brassica oleracea
MATPSEASALSFIKKHLLDESSPLPKVTTTNPWIASETISNFSIFGSFDQTGFDFSEFETKPEITDLVTHRFTDSFESEPEANAEIQLASSESFTFQSNPRGVSGPASRSNRKPPLKIDPPSRTEWIQFATENPQPEQLPVHVAAEEKRHYRGVRMRPWGKFAAEIRDPNRRGTRVWLGTFDTAIEAARAYDQAAFRLRGSKAIVNFPLEVGTWNQRADVGQNKRKRDGEGEEVTVVAKVLKTEESHAVETETSSLTAVDDWDLTELLSMPLLSPLSPHPPFGYPQLTVV

SEQ ID NO: 4388 - protein, 336 aa, Coleochaete scutata
MGRGKIEIRRIENATSRQVTFSKRRNGLLKKAYELSVLCDVDIAVIVFSPTGKLFQYASSSMKEILERYEQVPPEQKEKGSQRLDNMDYLNREVAKLRNEVEHKYHEARQLEGEDLDRLGVYELEQLEQKLSNSMRRIRGRKDELMKAELEGLRKQVADMETALVGAASFDGRPLSGSSNYLLQSIPGIRTMPPSSLGGMNPASTSLQLGSDRLFGNRGVELHDRSASDESPVMTNRMSVDFAQAPREMSGVDLSGSPVPPWKSQAAAAAQQEWKNQASSPTDWKVTNTEHLDSWPKAPAPTPEWKSTSVQPEWKNQSSPSSEWKPLDWMYHGPQD

SEQ ID NO: 4389 - protein, 468 aa, Aspergillus oryzae
MSVEDKPVQQEAPVESQFQKPGDLVERDEDTGVMSLESLCMNCHENGTTRLLLLRVPYFRDIILESFECPHCHFKDNSVKSAGQIQEKGAKYTLTVQGENDLQRQVVRSDTSIFKVESLGIEMPKGESQFTTVEGVIQKIYESLSSEQPLRKAQAPELHDALVPIIENLQKILNRDGFPFTVSLDDPTGNSWIAPTINDTGNNYKRRDYPRTHEQNEELGISADPNAVEHEASGEWEDSEIVDGQVYSLPTECPGCTKPGFVNMKKVNIPYFKEVIIWSTSCEHCGYRTSEVKTGGEVPEKGKRITLRVENEVDLSRDILKSDTCALHSEELEVTVQPGTLGGRFTTVEGLLTEIRDQLHGQIFDVDDASGAGGDSMASDTKEKWTRFFSRLDAAINGDMKFVITLEDPMANSYVQDLCAPAVDHQITTEEYTRTEEEEEELGLKDMKLEGYEEDTEKKEEDNTEQKS

SEQ ID NO: 4390 - protein, 208 aa, Brassica oleracea
MELFPSQPDLNLNISRRREEQDDKEQEQVERRLVYQSQASDSVRNASGHLIDTVKFTSNYEPTKFYHYQEHNESQDQDSRSILMVSQNQTLGHYYYSPTPPFFFSEVNGQHANPNYSYKLHHGHRRQAQPQPQRCTAKRGVRAPRMRWTTTLHAHFVRAVQLLGGHERATPKSVLELMDVQDLTLAHVKSHLQVIFPISLDCTMYNSI

SEQ ID NO: 4391 - protein, 153 aa, Narcissus pseudonarcissus
MCGGAIISDFIPPSRSRKLTADYLWPNLNKGKDKKKSFGFEDDFEADFNEFEDESEEGESEAVDVKPFKFGAKAGFSREGSTYLKPIELNGAAERSSKRKRKNQYRGIRQRPWGKWAAEIRDPNKGVRVWLGTFNTAEEAARAYDDEARRIRG

SEQ ID NO: 4392 - protein, 378 aa, Vitis vinifera
MDQLQVDSAAAALVDEEDVVTANDARRDGDTRAGGSSSRVRGPWSPEEDAILSQLVSKFGPRNWSLIARGISGRSGKSCRLRWCNQLDPCVKRKPFTEEEDRIIIAAHSHHGNKWASIARLLPGRTDNAIKNHWNSTLKRQCKKLDMFKPISGSMLEDGSPDRTKASSEETMSPGDIDSRKPPEGRDASLMDDGPYQCENKVQTTEDHSSISRPMARVSAFSVYNPPSGLRVGSAFSRAAPMKGPLVQTSKPHLEVCKFLEGVYSEPTIPLQCGHGCCEAPTGGQSQGSLLGPEFIEYMEPPPFSSHELASIAAELNSIAWIKSGLVNSSSSMQDETAGQRLCMGAAAQLKNEHLRLEEGRNKLMGMMPEVLPTQMPA

SEQ ID NO: 4393 - protein, 433 aa, Zea mays
MVLDLNVASPADSGTSSSSVLNSADGGFRFGLLGSPVDDDDCSGEMAPGASTGFMTRQLFPSPTPPAEPEPEPVAAPVPVWQPQRAEDLGMAQRPVAPAKKTRRGPRSRSSQYRGVTFYRRTGRWESHIWDCGKQVYLGGFDTAHAAARAYDRAAIKFRGLDADINFSLSDYEDDLKQMRNWTKEEFVHILRRQSTGFARGSSKYRGVTLHKCGRWEARMGQLLGKKYIYLGLFDSEVEAARAYDRAALRFNGREAVTNFEPSSYNAGDNNLRDTETEAIDDGDAIDLDLRISQPNVQDPKRDNTLAGLQPTCDSPESSNTMASQPMSSSSPWPGYHQNPAVSFHHQRLYSSACHGFFPNHQVQERPVERRPELGAQPFPSWAWQAQGSPHVPLHHSAASSGFSTAAGANGGMPLPSHPPAQFPTTTNPFFFP

SEQ ID NO: 4394 - protein, 324 aa, Picea sitchensis
MREIGRMGCKSGPNSAQINLPPGFRFYPTDEELMVHYLCKRVASQPFPIPIIAEIDLYKFDPWQLPEKALFGEKEWYFFSPRDRKYPNGSRPNRAAGSGYWKATGTDKPVTAGLNRMKVGVKKALVFYKGKAPRGIKTNWIMHEYRLADSASKAAKRKGSIRLDDWVLCRIYEKHYASQKAVPKESNELSSCVDPEEDQYMAPVASNSPPDMDDNKLLINLPRINSLNRINSLLKFPSREIMKMPDPNYNQTEQQYSRAETDAGSNSGGQAIEYGQNSPFWRNQQFGYNYDQMAQNPFPQQLEHMPSLGANSSAFFASLAAELL

SEQ ID NO: 4395 - protein, 507 aa, Oryza sativa
MASSSSDLTLDDHHHLTAVAAASGQATQKLQEFLSRLEEERLKIDAFKRELPLCMQLLNHAMEAYRQQLEAYQMGSQHSAAAAAAARAPLVLEEFIPVKNIGIDVVAADKAAAAGGNSVSSEKASWMVSAQLWNAPASASAADTAAKGPQTPKEHSEHHPLDTSPKLITALDGGGGGGGAFLPFSKDNAMGDGSAAAAAALPELALAPAEKAADAITIAAGEVDKKPYAHDNGVVARSREAQNGGKPPSTPSDGQAVPPPPQPHRKARRCWSPELHRRFVNALQILGGAQVATPKQIRELMKVDGLTNDEVKSHLQKYRLHTRRPMPSPAPPTAATPQLVVLGGIWVPPEYATQAAGPAIYGAHPATQPHYTAAVAAQEYYHHHHHHLQHHPAAAALVHHRAVAPPPPLPPQQQLAPPYSAKSSASARLGSPDSDGRGSGGGGGAAASGAGRDMSESIEEEGEGEEREDDDDDDEMAATNNAHAVDGDDDNDEINTTTTTSAGAINY

SEQ ID NO: 4396 - protein, 209 aa, Gossypium barbadense
KQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVGPLNPTTTNSMDVACKLRVFSTENDDGVSDAASYLEDETPPTGVSNLDLDLTIAFPSSPIKNIIEESQQKTASIVTNDEEERYTVPTLLLFR

SEQ ID NO: 4397 - protein, 527 aa, Zea mays
MCDFFLPRMEGDQAGGGDLTDIVRSGGAVPSSAAEATARDEWQLHQGEPPMLFPPLPSSTATASEAGCAAGSTGANVFGADDPFSGLVDPFCTDYYSSCADFLDATMPDAMPKVGFDAAICGGSGSGCGGGGGQGQLIDVRRKQPLLPRGVQMLPVGALAPREIQPYPAFASDMVKLGITAGQVAGCAIDAAVVGMQMPSPRAAGGIKRRKNQARKVVCIPAPTAAGGRPTGEVVPSDLWAWRKYGQKPIKGSPYPRHVLIRHASTNYLGLRFKGNINLKLNKQTAGDKLEFKQDIWGCLGYYRCSSSKGCSARKQVERSRNDPNMLVITYTSEHNHPWPTQRNALAGSTRNHHGKNSSGSSGSKGSQNEKQEQQQPSNVKEEPKDPAATTTATSTITTLTTSISPAAVVKEETLAAGSSEALGQVMDTAVADHNIELMDQVFSESYRPMIPEAGHPDDFFSDLAELESDPMSLIFSKEYMEAKPSGGDRGHHEKAISKDLDPLFDMLDWSANSSSAGSSFEQGKRG

SEQ ID NO: 4398 - protein, 326 aa, Mangifera indica
MMATASSELSIKSSNETSKSPMEEDKDLNLETALYKELWHACAGPLVTVPRQGERVYYFPQGHIEQVEASTNQFADQQMPIYDLRSKILCRVINVQLKAKPDTDEVFAQITLLPEPNQDENAVEKEPPPPLLPRFHVHSFCKTLTASDTSTHGGFSVLRRHAEECLPVLDMSQQPPTQDLVAKDLHGNEWRFRHIFRGQPRRHLLQSGWSVFVSSKRLVAGDAFIFLRCEKELRVGVRRAMRQQGNVPSSVISSHSMHLGVLATAWHAVSTGTMFTVYYKPRISPAEFIVPFDQYMESVKSNYSIGMRFKMRFEGEEAPEQRLVFG

SEQ ID NO: 4399 - protein, 244 aa, Triticum monococcum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHAAQQDQTQPQTSSSSSSFMLRDAPPAANTSIHPAAAGERAEDAAVQPQAPPRTGLPPWMVSHING

SEQ ID NO: 4400 - protein, 78 aa, Chlamydomonas reinhardtii
CHVEGCTVDLASAGPYYQRYRTCELHLKAPYIIKDGMQQRFCQQCGRFHELSEFDNNKRSCRARWGHHNQRRRKRTEE

SEQ ID NO: 4401 - protein, 588 aa, Physcomitrella patens subsp. patens
MMFRLPQPGGKEEEQRRQRLSEAEPARQGQPQQQQQIAGYEISISGTEHSEKVEGLSKRGGGEGSSEERRVRARPSDQPSKSGPPGAECTRPARAARSSGGKDRHSKVNTAKGPRDRRVRLSVPTAVQFYDVQDRLGFDQPSKAVEWLIKHAKAAIDELEQLPSVRQGEPAASFEQQPQTTSSTVSTFSAGLPGVLAAPLPESSSTSYGTYDSHGQPAMMSTFGHTGHGMEAVMGPQHQHHHLASYGLNFPLEQQAGLFRAGSSGDSQAGGSGTARVESRAKARERARERAKEKHITERDPGTGRISSSMVTHHVPASASAGMQQQHPHLVQSPYANLPSQVSSALLHPFQASPAFNASTGIHPPSRPPPPAATPYHASSYGFSESSFVYSGHYNPPPTPYNQAEPSLHQQQQQLPSVSHYFVENPPPPSHYSSSNPQGMNTPKPMTLPGFSPGPASSSLRASLFGSVISEQHQSLHYSSGSYLSPSGYYFPPSYASIAQRPPPSSSPLLGPSLPGSSLRPSQGTMRYTLPGMRSDQEQARGHEQQQQQEEELGTHDQTPHSLDPNFYTSQIPARLQGLEELEEEFKR

SEQ ID NO: 4402 - protein, 454 aa, Arabidopsis thaliana
MPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 4403 - protein, 417 aa, Oryza sativa
MEMASGGGAAAAAGGGVGGSGGGGGGGDEHRQLHGLKFGKKIYFEDAAAAAGGGGTGSGSGSASAAPPSSSSKAAGGGRGGGGKNKGKGVAAAAPPPPPPPPRCQVEGCGADLSGIKNYYWRHKVCFMHSKAPRVVVAGLEQRFCQQCSRFHLLPEFDQGKRSCRRRLAGHNERRRRPQTPLASRYGRLAASVEEHRRFRSFTLDFSYPRVPSSVRNAWPAIQPGDRISGGIQWHRNVAPHGHSSAVAGYGANTYSGQGSSSSGPPVFAGPNLPPGGCLAGVGAATDSSCALSLLSTQPWDTTTHSAAASHNQAAAMSTTTSFDGNPVAPSAMAGSYMAPSPWTGSRGHEGGGRSVAHQLPHEVSLDEVHPGPSHHAHFSGELELALQGNGPAPAPRIDPGSGSTFDQTSNTMDWSL

SEQ ID NO: 4404 - protein, 234 aa, Hyacinthus orientalis
MGRGKIEIKRIENTTNRQVTFCKRRNGLLKKAYELSVLCDAEVALIVFSTRGRLYEYSNNSIKSTIERDKKACADSSSSSAVIEVNTQRYYQQEASKLRQQIQILQNANRHLMGESLDPLNVKELKQLETRLERGITRVRSKKHELLFAELEYMQKREVELQTDNMYLRAKIGENERAHQASVVQAGTEFDALPTFDSRNYYQVHMLQAASHYSHHQDQTALHLGYETKADPSA

SEQ ID NO: 4405 - protein, 245 aa, Solanum lycopersicum
MATNSSSHSPRTVEEIFKDFSARHAAVLRALTTDVEDFYSQCDPERDNLCLYGHPNESWEVAVPAEEVPPELPEPVLGINFARDGMERRDWLSLVAMHTDSWLLSVAFYFGARLNRNERSRVFTLINDLPTVFEAVTGRKPLKDKPSVDSGKKSKNNAKREKQMKANQRLQEESDDEDEGNEDEHEETLCGSCGTNGNEDEFWIGCDMCEKWYHGKCVKITPAKAQSIKEYRCPSCSNKRAKHMA

SEQ ID NO: 4406 - protein, 243 aa, Prunus mume
MAYENKSMSLDSPQRKLGRGKIEIKRIENTTNRQVTFCKRRNGLLKKAYELSVLCDAEVALIVFSNRGRLYEYANNSVKETIERYKKACAESTNTGSVSEASTQYYQQEAAKLRAQIGNLQNSSRHMMGESLSSMNMKDLKNLESKLEKGINRIRSKKNELLFAEIEYMQKREIDLHNNNQLLRAKIAENERSQQNINVMAGGGSYEIMQSQPYDSRNYFQVNALQPNHQYNSRQDPMALQLV

SEQ ID NO: 4407 - protein, 201 aa, Zea mays
MDSTSCLLDDASSGASTGKNKPAPVPAPAAATGKPLQRVGSSGTSAVMDAAEPGAEADSDGARRAPGGVSGKLPSSKYKGVVPQPNGRWGAQIYERHQRVWLGTFTGEAEAARAYDVAAQRFRGRDAVTNFRPLAESDLDPDAAAELRFLASRSKAEVVDMLRKHTYGEELAHNRRAFAAAAPAASPPPQNNRRPPAAKNT

SEQ ID NO: 4408 - protein, 122 aa, Brassica napus
MRRGRVSTPVTANHNPSIKETRFRGVRKRPWGRYAAEIRDPYKKSRVWLGTFDSAVDAARAYDAAARNLRGPKAKTNFPIESPPSPPQIDPFMDHRLYAGASSRPTSSSMSSTVESSSGQRS

SEQ ID NO: 4409 - protein, 85 aa, Ixophorus unisetus
ECQKVGAPPEVSARPTAMAQELEARQRTALGGLSAATEPELDQFMEAYHEMLVKFREELTRPLQEAMEFMRRVETQLNSLSISGR

SEQ ID NO: 4410 - protein, 85 aa, Ixophorus unisetus
ECQKVGAPPEVSARLTAMAQELEARQRTALGGLGAATEPELDQFMVAYHEMLVKFREELTRPLQEAMEFMRRVETQLNSLSISGR

SEQ ID NO: 4411 - protein, 301 aa, Solanum peruvianum
MSQRTAPAPFLLKTYQLVDDAATDDVISWNEIGTTFVVWKTAEFAKDLLPKYFKHNNFSSFVRQLNTYGFRKIVPDKWEFANENFKRGQKELLTAIRRRKTVTSTPAGGKSVAAGASASPDNSGDDIGSSSTSSPDSKNPGSVDTPGKLSQFTDLSDENEKLKKDNQMLSSELVQAKKQCNELVAFLSQYVKVAPDMINRIMSQGTPSGSSLEELVKEVGGVKDLEEQGSYNDNDDKEDDDEKGDTLKLFGVLLKEKKKKRGPDENIETCGGRGKMMKTVDYNGPWMKMSSPAGESSKVCN

SEQ ID NO: 4412 - protein, 379 aa, Zea mays
MDSMEDAVSGTAAQGDLAEVVARAGAMAAAASHHHHRRPPSPAAADHGHIVSAARATARSQIMLVPAACYDEETRPAAACGDAVMFDAPSSAMAAAVGPYHHLSSSSAALAPAHGGYWLPPQQISQEHACGGLDEPPMVTRISPVTTPPPPSHHHQIMNRKNEVKKVVCIPALPPPASSRPGGGEVIPSDLWAWRKYGQKPIKGSPYPRGYYRCSSSKGCMARKQVERSRSDPNMLVITYTAEHNHPWPMQRNVLAGYSRPHTATHMSSNCKKKKNSCSVEPTSSWPTTTTSSSSSKNGNYECQQMTNMTMEENAAAGYVAYAIDDEECAAMHQPINCGSVQPSADEVFAELEELEPTTSSPVNANIYSRGVTYEWHKF

SEQ ID NO: 4413 - protein, 85 aa, Ixophorus unisetus
ECQKVGAPPEVSARLTAMAQELEARQRTALGGLGAATEPELDQFMEAYHEMLVKFREELTRPLREAMEFMRRVETQLNSLSISGR

SEQ ID NO: 4414 - protein, 317 aa, Citrus sinensis
MAFNRREVDRIKGPWSPEEDEALQQLVQKHGPRNWSLISKSIPGRSGKSCRLRWCNQLSPQVEHRAFTPEEDEMIIRAHARFGNKWATIARLLNGRTDNAIKNHWNSTLKRKCSSMLTENGIFLNCNGYDADFGNSIQQQPLKLKRSVSAGSSVPVTTGLYMSPGSPSGSDVSDSSVPGLSSNYNIYKPVARSGGINVDVNVVPEPETTSSSNDPPTSLSLSLPGVDSSSEVSNKVSESTQAVNAKASVPAPVSSDSGSKGLVGFSKEFMAVMQEMIKQEVRTYMAALEQQRGGACYNGSGGGGDGVLRNVAMQRTG

SEQ ID NO: 4415 - protein, 588 aa, Oryza sativa Japonica Group
MSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGTGKGGQKQPVHRKSIDTFGQRTSQYRGVTRHRWTGRYEAHLWDNSCKKDGQTRKGRQGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKAIEAAPDHVPIGRELGATEEASAATVTGTDWRMVLHGSQQQQAAACTEATADLQKGFMGDAHSALHGIVGFEVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 4416 - protein, 910 aa, Zea mays
  misc_feature (875)..(875): Xaa can be any naturally occurring amino acid
MAPKRSNPIEVPPAASSSEEDEEVTSSEEVDEGSSTEEDPKTQSTPMSQKSPPPRKLETATPAIVKEGSDESGSDSESDTAAQIAIATEPRCNKSLASSSKRPGKSELDAKEAKRLKKKVGEEGMATAPVVEGVKKTGEDAKKLLFQRLFSEDDEIALLIGMLDYSAKKGADPCADMNEFYEFVKKSIHTDVSKVQLMDKIRRLKKKFKNNAGKNSKGEDPTFSKPHEQNAFELSKQIWGKEGISGKVESSTAKSNGKAKGKNKAEVAVKAELLSSSDKKIDDAVPVEVDEVVSKSSSNFLDKKFSLSDLEEAVVKVGLDMVDGEKKAALEAKWMKLQVAQLEAVSNVPRAPRSIRKRDRTKRVVEDSRICAFELLASLAGKLLEEGESSASSNASAGHDHVSIGKDVKLETRYDDKPLKTECVGHVSCDASVVTSDWTAENSDNSKEPKLSENNAILEPTLTKAPPACSVQINDDLKYTIQKCNVGYGSFPGNLDGCSPNFGELCDGISENGVKREVETNNYPTMDPLEVSMTFPAPINSDRDVKLPSRSDSVLNASFSRHRNDIKLGSRDDDEKFSRFNKLSNRFKVSRPATCIEDRRIRKLLTSKYWKAAPKLKDFEDSRADGGIKALQRKRKTYYDKCQYDTLYKRRKFFDRSSIVTSDGRIGSENVSNSPEKVTNENENKCRLVAMSHGACEIASLLTGHQASHKSDDSHVKLSIKSFRIPELYIEVPETATVGSLKPGPVIAPPPICSEEPLLQLPCGSAPQNLTRSLVVTPALDTGIPDATPDPPLLTNSAKSVDIPAMNVEALAVVPVNQKIRKSELAQRRTRRPFSVSEVEALVQAVEELGTGRWRDVKLRAFENADHRTYVDLKXKISPQQRRGEPVPQELLDRVMAAHAYWSQHQTKQQ

SEQ ID NO: 4417 - protein, 317 aa, Citrus sinensis
MAFNRREVDRIKGPWSPEEDEALQQLVQKHGPRNWSLISKSIPGRSGKSCRLRWCNQLSPQVEHRAFTPEEDEMIIRAHARFGNKWATIARLLNGRTDNAIKNHWNSTLKRKCSSMLTENGIFLNCNGYDADFGNSIQQQPLKLKRSVSAGSSVPVTTGLYMSPGSPSGSDVSDSSVPGLSSNYNIYKPVARSGGINVDVNVVPEPETTSSSNDPPTSLSLSLPGVDSSSEVSNKVSESTQAVNAKASVPAPVSSDSGSKGLVGFSKEFMVVMQEMIKQEVRTYMAALEQQRGGACYHGSGGGGDGVLRNVAMQRTG

SEQ ID NO: 4418 - protein, 156 aa, Oryza sativa
HQGIFFPSNIQNNEESSSQFDTKKRKSLMEAVSTSENSVSDQTLSTSSAQVSINGNISTKNNSSRRGKRSKNREEEKEREVVHVRARRGQATDSHSIAERVRRGKINERLKCLQDIVPGCYKTMGMATMLDEIINYDQSLQNQVEFLSMKLTAASS

SEQ ID NO: 4419 - protein, 341 aa, Triticum aestivum
  misc_feature (79)..(79): Xaa can be any naturally occurring amino acid
  misc_feature (86)..(86): Xaa can be any naturally occurring amino acid
  misc_feature (98)..(98): Xaa can be any naturally occurring amino acid
  misc_feature (100)..(100): Xaa can be any naturally occurring amino acid
  misc_feature (102)..(102): Xaa can be any naturally occurring amino acid
  misc_feature (108)..(108): Xaa can be any naturally occurring amino acid
  misc_feature (127)..(128): Xaa can be any naturally occurring amino acid
TVRPSPRLPPTRRAKPIRIEPSPSRIHPWTDPTPAGGPPPMPVPQHWAELGFFRPAAPPPDMRILQLQQQQAHAPPPPXPPAQPPXAKKSRRGPRSRXSXYXGVTFYXRTGRWESHIWDCGKQVYLXXGFDTAHAAARAYDRAAIKFRGVDADINFNLSDYEDDMKQMKGLSKEEFVHVLRRQSTGFSRGSSKYRGVTLHKCGRWEARMGQFLGKKYIYLGLFDNEVEAARAYDKAAIKCNGREAVTNFEPSTYDAELLSEVAAEGADVDLNLSISQPTSQSPKRDKSSLGLQLHHGSYEGSELKRPKVDAPPEMVAIPHRYPLLTEHPPIWHGNHIPSFK

SEQ ID NO: 4420 - protein, 714 aa, Candida albicans SC5314
MSKKNPGDPRVKKNAFVHKLYTMLHDPALSHLIWWTNRNGEQNTFALCPGKEFADCLTQYFKHGNVASFVRQLHMYGFHKVSDPLPITYPPNGNNNNNNNNKEVPPVWEFKHSSGRFKRGDETSLVYIKRRSSSNHTSGSTIYAEPIYNPLLTNPYNQPQFMYQDYSMGPPVEVQQFYNYQNQPLMYYQQPPGQVPPPPPPSLPPHQQPEMALQYHQYNNYQQPPPAPPAPPPQPGNVLFGYQQVAPPQQPGSTVQQIPANAPPTLDQTQPLSYTPQLEYQQQQYPQPPLPPPPPQLQLQTSPGIPKVNDNLSRPSPNEQHLQFRKIWPDENNEANSKPRNPSLMFDPLLRVNSEGSPKTQPNHSVSLLNNEVRSESSTSSSSTTVTSTALPPPSAIDRSVSLVGGSPFDLSSRMNNQQSFNRTPSISTPPTQNGRLPKISSPLIPSNTESQSPTMVTGTDNDVGVTSKGSTSIISVSKKPSVFSNSLQERLRPSMFEYHPIGNNLSKDVLTIPKISTNSNSGSRTTSQSSMSSASALSSKKSSLSSISSTHGNLSILNSTNYRSTSVGGSGSGPFSTSTSTSTTSPTLSSLLHHPQHEPQNSTIANGTSIRSSISSSQSISSPPLTTTTTTTTTDQRQLSNSPISRQQQQQPNNNTNKKVSVTSLLLPSHSQSQGYAQPLYKSSVIAEEENSTTSSGGGYRSKSDDDTDNMNK

SEQ ID NO: 4421 - protein, 279 aa, Glycine max
  misc_feature (271)..(271): Xaa can be any naturally occurring amino acid
MPENMSISVNGQSQVPPGFRFHPTEEELLQYYLRKKVSYEKIDLDVIRDVDLNKLEPWDIQEKCKIGTTPQNDWYFFSHKDKKYPTGTRTNRATAAGFWKATGRDKVIYSNGKRIGMRKTLVFYKGRAPHGQKSDWIMHEYRLDDNNTADTNIVSNVMGDAAQEEGWVVCRIFKKKNHLKTLDSPLASGEGRRSHLFDSCDEGALEQILQQMGRGCKEESSYEGNYNSYGRFAMGLNNGGGGGYNDRFMKLPSLESPKSASMENHHNTNNXCNNNMKSN

SEQ ID NO: 4422 - protein, 219 aa, Brassica napus
  misc_feature (109)..(109): Xaa can be any naturally occurring amino acid
  misc_feature (138)..(138): Xaa can be any naturally occurring amino acid
MASLFSDNEQPPTNSNSISTVLVGKKKSLSASTGDGESYARWRSEKQQRIYSAKLIQALKQVRLSSSSSASTSSPTAQKRGKAVREAADRALAVSARGRTLWSRAILAXNRIKLKFRKQKRPRQTVVPAVTTVVTTGXSSSRGRKPRVSVVGLNKKSLPTVNRKVRSLGRLVPGCKKESVPVILEEATDYIQALEMQVRAMNSLVELLSGYSGSAPPPI

SEQ ID NO: 4423 - protein, 248 aa, Misopates orontium
MGRGKVQLKRIENKINRQVTFSKRRGGLLKKAHEISVLCDAEVALIVFSNKGKLFEYSTDSCMDRILEKYERYSFAERQLVSNEPQSPANWTLEYSKLKARIELLQRNHRHYMGEDLDSMSLKELQSLEQQLDTALKNIRSRKNQLLYDSISDLQRKEKAIQEQNTMLAKKIKEKEKELAQQPQWEHHRHHTNASIMPPPPQYSMAPQFPCINVGNTYEGEGANEDRRNELDLTLDSLYSCHLGCFAA

SEQ ID NO: 4424 - protein, 370 aa, Oryza sativa Japonica Group
MDTFSHVPPGFRFHPTDEELVDYYLRKKVASKKIDLDVIKDVDLYKIEPWDLQEKCKIGMEEQNDWYFFSHKDKKYPTGTRTNRATGAGFWKATGRDKPIYARSCLVGMRKTLVFYKGRAPNGQKSDWIMHEYRLETNENGTTPEEGWVVCRVFKKRVATVRRMADGSPCWFDDHGAVGAFMPDLSSPRQLLPHHHHHHPGSSAALYHGHHHQQLQQMYGHCKPELEYHHLLPQEAFLQHLPQLESPKPPPPPPAAAAYIGGHLGSSSSTALTTHDDEASGSAAQQQPPSLEAVYMAGAGVGIGVDASVTDWRLLDKFVASQLLSKESMSSYGSHPAQVFQAADGGKHEEALDYASTSAGSGGGEADLWK

SEQ ID NO: 4425 - protein, 165 aa, Physcomitrella patens subsp. patens
GRKPRGRPPGSKNKPKPPVIITRENGNAMRPHILEVAGGCDVSDSVASFSRRRQRGVCVMGASGTVSNVTLRQPTTPGATVTFHGRFEIISLSGAFLPHPSSAPTTGLTVSLAGAAGQVLGGSVVGTLMAAGPVLVIAASFIGPTFERLPLDNDDEGLTMGGGSS

SEQ ID NO: 4426 - protein, 238 aa, Picea glauca
MEHLNTAAAQASSSLYGVGMAEYGDAGVSSMMALITQHEPHDSESIMSTRMPSSFSSFHGHADCLLSAAMFQAFQGDHKLKRQPGMDQLVSEQAGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 4427 - protein, 328 aa, Brassica napus
  misc_feature (260)..(260): Xaa can be any naturally occurring amino acid
MSSSVRKNMERIKGPWSPEEDELLQSLVQKHGPRNWSLISKSIPGRSGKSCRLRWCNQLSPEVEHRGFSPEEDETIIRAHARFGNKWATISRLLSGRTDNAIKNHWNSTLKRKCNGVASDGYDGNIGGNGGYDGNLGEEQPLKRTASGGGVSTGLYMSPGSPSGSDVSEQSCGVPHVFKPTARSGAVTEVTASTSGEDPPTCLSLSLPWNNRCETETVRVNEPTQVNENTVTDGGYTAELFPVRKEEVEEEKGISGFGGXFMTVVQEMIRTEVRSYMADLQRGNVGGGGSIGGSGGGGVGSCMPQSVNSRRVGFREFIVNQIGIGKME

SEQ ID NO: 4428 - protein, 381 aa, Zea mays
LGALHWWCARPSSVVTHSLPHIPFPPTAPLAARNNMSNRATHWCYACQRPIRLRGQDIICPNCSDGFIQEISEMGGVLNTYGLTEPDFEERQARRFGMMDAISSLMRQRLSEIGRDSLFDIHGRQGTGTEYGRRSTAIPTLVFGGIPSPAVGSSDINVVIREGRRAGAARPNFSSLVVGPSLEALFEQLLLQNNRQGPPPAPQSAIDSMPVVKINRRHLDEDPQCAVCKDKFEVGAEAREMPCKHLYHTDCIIPWLVQHNSCPVCRHPLPSQRSGSSTSSARVPSAYYNETACPPAVARADFDPVPSAYYNETATDPPAVTRADFDPAPGNYGSESQESHVPFSFLWPFGPSSSYQYEENVDEPAVYDPNQIAYSAWHYDH

SEQ ID NO: 4429 - protein, 241 aa, Cucurbita maxima
MERRMWRDKMRLKRLKEQSKVKEGIDIVKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPTGVEEWWPQLGLPKDQGPPPYKKPHDLKKAWKVGVLTAVIKHMSPDIAKIRKLVRQSKCLQDKMTAKESATWLAI

SEQ ID NO: 4430 - protein, 241 aa, Cucurbita moschata
MERRMWRDKMRLKRLKEQSKVKEGIDIAKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPTGIEEWWPQLGLSKDQGPPPYKKPHDLKKAWKVGVLTAVIKHMSPDIAKIRKLVRQSKCLQDKMTAKESATWLAI

SEQ ID NO: 4431 - protein, 345 aa, Oryza sativa Japonica Group
MASAAAATGAALGARTARACDGCMRRRARWHCPADDAFLCQACDASVHSANPLARRHHRVRLPSASSSPASSPRSAAAPRAGSDDPDAPAWLHGLKRRPRTPRTKPGGGGKHDASAATVAAAAASAVPDLEAEESGIVGDTDHDVGEEDDEDLLYRVPGFDDLGFLDDEKPHVKLDLDMDMDFASISPAPAPEREERKRKRPEMILKLDYEGVIDSWARDGASPWFHGERPRFDPSESWPDFPAGSRGGLGAAVTAVTGGEREARVSRYREKRRTRLFAKKIRYEVRKLNAEKRPRMKGRFVKRAAALPPLPLPRHQHPPPPPPRALPPVPMMLAPRGAHGRYRF

SEQ ID NO: 4432 - protein, 533 aa, Physcomitrella patens subsp. patens
MMAFNNLSHDVSLQQFPELWESSRFSQRHDTLDADQHTQGFDDTQFPKEPLEPNTNLHQVAMEIQPNATIIGDESSRGRNPVVNESDDREDDNHLLGTEDGIVKNGRTWLNSALLREQNQASEDRSGYGDHNAAERWCPVCSASGSQSCMCGMPMHAGDSSTISFPNQSTYTHWLSMQGANMLASQHRTGGEVDAKAAGFTVSPQSTKMATELNLSPAGHGRDNHALFTDPRHSVAQGGSRYAEDYERTEHQTDWEGATQKMEWEQARDKFLIVAHPLYPDLLNAHASCLRVGTPVDQLPHIEAQLTQARHVTSKYSVLHPDHLEITEDEKTELDQFMAQYIMLLCSFKDHLQQHVYYDVTEAMMSCWELEQALHNLTGVSAGESTGATMSEEDEDYDSDYGAYDAHMDPQDSGGFGPLVPTESERTLMERVRQELKYELKQGYRARIVDVREEILRKRRAGKLPEGTTTVLKAWWQAHSKWPYPTEDEKERLIQETGLELKQVNNWFINQRKRNWHSNPLSSSSELKSKRKK

SEQ ID NO: 4433 - protein, 368 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISAISSPNSCDENMTKATKPLEPQKDEKQLVPEEALIVLAGPLTRSKSKKFNQAINGLLKELKKNQEDVTQSSFIVITAQEAR

SEQ ID NO: 4434 - protein, 511 aa, Oryza sativa
MALSTLLLPSSSSSSSKTATATDTSDRRRHHHHHNHTKRKKKPPPPPLSPTPRTPPPAGSGSHRAMAASSKKSTKQVVVAAKTTTGHRPKKAAAAPTTPSRGAPSASAAPVSSSWEQLKSLLSCRSATAAARVHDPAAPSSALSRLRSHGAGACGASLCAIRDVVDAASSASAASTTAASLDRDTTPLTRSSRRAHRAATSSSGGGGGHHASLRGLSGCYECRAINVEPMSRRYPRPRELCACSQCGEVFNKADSLEHHQAIRHAVKIGWQKYIKRYLCLAIFCMLAVASASPFVEVSELGPEDSGRNIVEIIFKSSWQKRDRPICQIDRILKVHNAARTVARFEAYRDAVRTRCRATAARAAADGNELLRFHPAALACPLGLNGATSLCDDDDSCGVCAAIRHGFAPWAGAHPLGVRTTASSGRAHDCGAAAAAAQQAGGCRAMLVCRVIAGRVRRNDDDGGAEEEEGAFDSVAGDEAASSVYGNLEELFVANPRAILPCFVVIYRVVPE

SEQ ID NO: 4435 - protein, 677 aa, Kluyveromyces lactis NRRL Y-1140
MGHNDSVETMDEISNPNNILLPHDGTGLDATGISGSQEPYGMVDVLNPDSLKDDSNVDEPLIEDIVNPSLDPEGVVSAEPSNEVGTPLLQQPISLDHVITRPASAGGVYSIGNSSTSSAAKLSDGDLTNATDPLLNNAHGHGQPSSESQSHSNGYHKQGQSQQPLLSLNKRKLLAKAHVDKHHSKKKLSTTRARPAFVNKLWSMVNDKSNEKFIHWSTSGESIVVPNRERFVQEVLPKYFKHSNFASFVRQLNMYGWHKVQDVKSGSMLSNNDSRWEFENENFKRGKEYLLENIVRQKSNTNILGGTTNAEVDIHILLNELETVKYNQLAIAEDLKRITKDNEMLWKENMMARERHQSQQQVLEKLLRFLSSVFGPNSAKTIGNGFQPDLIHELSDMQVNHMSNNNHNNTGNINPNAYHNETDDPMANVFGPLTPTDQGKVPLQDYKLRPRLLLKNRSMSSSSSSNLNQRQSPQNRIVGQSPPPQQQQQQQQQQGQPQGQQFSYPIQGGNQMMNQLGSPIGTQVGSPVGSQYGNQYGNQYSNQFGNQLQQQTSRPALHHGSNGEIRELTPSIVSSDSPDPAFFQDLQNNIDKQEESIQEIQDWITKLNPGPGEDGNTPIFPELNMPSYFANTGGSGQSEQPSDYGDSQIEELRNSRLHEPDRSFEEKNNGQKRRRAA

SEQ ID NO: 4436 - protein, 283 aa, Thellungiella halophila
MGLDQESSSVPPGFRFHPTDEELVGYYLKKKVASQKIDLDVIREIDLYKIEPWDLQERCKIGYEQKEWYFFSHKDKKYPTGTRTNRATVAGFWKATGRDKAVYLNSKLIGMRKTLVFYRGRAPNGQKSDWIIHEYYSLESHQNYSPPQEEGWVVCRAFKKRSTVPTKRRQRLWDPNCFFYDATLLEPLDKNVLKRAKHNTDFAVTVPFKHIVDDEDLGSMHLHSIDDDQFSQLPQLESPSLPSDKLPEMARQSTRALEDEKRITDWRSLDKFVATQFLMSGQD

SEQ ID NO: 4437 - protein, 67 aa, Physcomitrella patens subsp. patens
YRGVRMRQWGKWVSEIREPNKRSRIWLGSFPTAEMAARAYDIAMVCLRGPSAVLNFPDSPPQSVPKC

SEQ ID NO: 4438 - protein, 85 aa, Ixophorus unisetus
ECQKVGAPPEVSARLTAMTQELEARQRTAFGGLGAATEPELDQFMEAYHEMLVKFREELTRPLQEAMEFMRRVESQLNSLFISGR

SEQ ID NO: 4439 - protein, 367 aa, Zea mays
MSISVNGQSVVPPGFRFHPTEEELLTYYLKKKVASERIDLDVIRDVDLNKLEPWDIQDKCRVGSSSGPQNDWYFFSHKDRKYPTGTRTNRATAAGFWKATGRDKAIYAAGGAARRIGMRKTLVFYQGRAPHGHKSDWIMHEYRLDAADADHHHPCCYPSPPPLPTAIVRGAAGPGDQVPQEQEGWVICRVFKKKNLVHHGAAQSSGGGGTAAAASKMESSPTSTTIIGDHASDDALDHILQYMGGGDTKPALLNHNQHLAAAADATTTTTAACPAAATSAGLYGNNKFMKLPPLEHAGGWLPPSPGPCEYGASGIADWDALDRLAAYELNGLSDASKNMAAFFDGDLWSMARSVSALHAADLAMNNA

SEQ ID NO: 4440 - protein, 317 aa, Citrus sinensis
MAFNRREVDRIKGPWSPEEDEALQQLVQKHGPRNWSLISKSIPGRSGKSCRLRWCNQLSPQVEHRAFTPEEDEMIIRAHARFGNKWATIARLLNGRTDNAIKNHWNSTLKRKCSSMLTENGIFLNCNGYDADFGDSIQQQPLKLKRSVSAGSSVPVTTGLYMSPGSPSGSDDSDSSVPGLSSNYNIYKPVARSGGINVDVNVVPEPETTSSSNDPPTSLSLSLPGVDSSSEVSNKVSESTHAVNAKASVPAPASSDSGSKGLVGFSKEFMVVMQEMIKQEVRTYMAALEQQRGGACYHGSGGGGDGVLRNVAMQRTG

SEQ ID NO: 4441 - protein, 317 aa, Citrus sinensis
MAFNRREVDRIKGPWSPEEDEALQQLVQKHGPRNWSLISKSIPGRSGKSCRLRWCNQLSPQVEHRAFTPEEDEMIIRAHARFGNKWATIARLLNGRTDNAIKNHWNSTLKRKCSSMLTENGIFLNCNGYDADFGNSIQQQPLKLKRSVSAGSSVPVTTGLYMSPGSPSGSDVSDSSVPGLSSNYNIYKPVARSGGINVDVNVVPEPETTSSSNDPPTSLSPSLPGVDSSSEVSNKVSESTQAVNAKASVPAPVSSDSGSKGLVGFSKEFMAVMQEMIKQEVRTYMAALEQQRGGACYNGSGGGGDGVLRNVAMQRTG

SEQ ID NO: 4442 - protein, 279 aa, Oryza sativa Japonica Group
MLIQWLKLVDDVAKLGDFFMAYVQQLENSRLKLTQLEQELQRARQQGIFISSSVDQTHSMSGNGALAFDMEYARWLEEHNRQINELRSAVNAHAGDNELRGVVDKIMSHYEEIFKQKGNAAKADVFHVLSGMWKTPAERCFLWLGGFRPSELLKLEPLTEQQLSGIANLQQSSQQAEDALSQGMEALQQSLAETLAGSLGSSGSTGNVANYMGQMAMAMGKLGTLENFLRQADNLRQQTLQQMQRILTTRQSARALLVISDYSSRLRALSSLWLARPKE

SEQ ID NO: 4443 - protein, 334 aa, Physcomitrella patens subsp. patens
MVEKIAVSSLHAKRGGNLLASLKLNAYSIAKKSSSKLVKPVSLHSGSPKVYKGVRKRTWGKWVSEIREPNKRSRIWLGSFPTAEMAAKAYDAAAVCLRGQSVKLNFPDSPPQGVQRCTSPRDVQAAAAAAAAACILPASALPMVNHSVTPSFESTPLNSLHSSSGMSSDDEAEDIDRSHHVTKFCSHAEFGDVEAAHADPDHSYVFPELTVDPVLATFYNDQVWAEYLTTEAHEAAAYESRKRLPSNLRRISMRAIVQGIRLDCGGVLDVVHATGCVCSVSMWGLFKVCVISQRAQQLTFHQIVTFTKFDLVNGTSHVVVDLGAAGKDSLKDSE

SEQ ID NO: 4444 - protein, 330 aa, Arabidopsis thaliana
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 4445 - protein, 659 aa, Oryza sativa Indica Group
MGLCQSRLERQEAVSRCKARRRYTKQLVQARRDMAAAHALYLRALRAPGAALLQFASAEADHPHPHHHVSAAPPPPQTPPSPPPPPPPPPPPPPPLSPTPTTTSWTTNSSSISASPILPPPPPPPPMPSSWDFWDPFAPSSSRSATEDAEWDDAATTIVDAPNAPPVVTVAAAAAPPPSVVTATTTTSTASELTVVAVPRGGGGAGKKDLAEIATELDEYFLKAADAGARVAALLEAPNCEPPETNNSSFPGKTISKSVTRLSSILLTFHLFLTNYLLHATEIDECCREGTELRQELEADGMVMGRKRVQQRDFLVLSMTAQLAQSYEGLKQEHDKKIGLLRKQEVKGVDYLKMEKNKMEIESLDSKMLVATQSIETTTSEIMRLRESELFPQLLELVAGLMSMWRGMYECHQVQTHMVQQLEYLNNSLSTNPTSNVHRQAALQLEIEVDRWYSAFCSLVKSQRDYVYSLTGWLRLSLFQSYHDPHNKAHQNSDIYSLCEEWQLAIDRIPDKVASEGIKTLLTVIHAVVVQQAEEQKQKKRSESAFKELEKKAEELRSLESKYGPYSGAEGYGDMSRKSPVSDKRAKVEALRCRADEEKSKYEKSIGVTRAMTLNNLQTGFPNVFQAMTGFASVCMEAFESVYNFKSSDRILDSKRLLT

SEQ ID NO: 4446 - protein, 219 aa, Zea mays
MAGKSRPPKRILESYTIKGSDRVIKPGDCVLMRASDASKPPYVARVEAIEAAGSRGTNVRVRVRWYYRPEESIGGRRPFHGSKEVFLSDHYDVQSADTIEGKCNVHSFRSYTKLDSVNAEDFFCRFEYKSATGSFVPDRIAVFCKCEMPYNPDDLMIQCEECSDWFHPACIGMTIKEAKKLEHFFCQTCTAENGKMVENSHEATAQSEEKPVESKRRRR

SEQ ID NO: 4447 - protein, 197 aa, Vitis vinifera
MGRQKIEIRKIEKKNSLLVTFSKRRTGLFKKAGELCVLCGVEAAVIVFSPAGRAFVFGHPTADAVIDRFLGRDTGTISRAVVPAEQVVHGQKEEGGFWWDAPIENMGLNELEQFKGSLEKLRKKVADRVEEMTSMMVMESESGAGPSSTTMVEYAVPPQAYNSSAVLHARDLAAHSHSQAVPQGFDFGFGFDEPRFW

SEQ ID NO: 4448 - protein, 241 aa, Citrullus lanatus
MERRMWRDKMRLKRLKEQSKVKEGIDIVKQRQSQDQARRKKMSRAHDGILKYMLKIMEVCNAQGFVYGIIPEKGKPVTGASDNPREWWKDKVRFDRNEPAAIAKYQADNAIPGRNDGCNSIGPTPHTLQEPQDTTLGSLLSALMQHCDPPQRRFPLEKGVPPPWWPTGVEEWWPQLGLPKDQGPPPYKKPHDLKKAWKVGVLTAVIKHMSPDIAKIRKLVRQSKCLQDKMTAKESATWLAI

SEQ ID NO: 4449 - protein, 342 aa, Arabidopsis thaliana
MDTAQWPQEIVVKPLEEIVTNTCPKPQPQPLQTQQPPSVGGERKARPEKDQAVNCPRCNSTNTKFCYYNNYSLTQPRYFCKGCRRYWTEGGSLRNIPVGGGSRKNKRSHSFSSDISNNHSDSTQPATKKHLSDHHHHLMSMSQQGLTGQNPKFLETTQQDLNLGFSPHGMIRTNFTDLIHNIGNNTNKSNNNNNPLIVSSCSTMATSSLDLIRNNSNNGNSSNSSFMGFPVHNEDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 4450 - protein, 133 aa, Brassica napus
IFDSEAMTTKFTSVDATEDISSSSDGGGGGVNSEKKSCAICGTSKTPLWRGGPTGPKSLCNACGIRNKKKKSTVRSEVKKKKKKQSSKIGDSLKQRLMELGREVMMQRKKKLGEEEQAAVLLMALSYASSVYA

SEQ ID NO: 4451 - protein, 225 aa, Elaeis guineensis
MGRGRVQLRRIENKINRQVTFSKRRSGLPKKAHEISVLCDAEVALIIFSTKGKLYEYATDSCMERILERYERYTYAEKALISSGPELQGNWCHEFGKLKAKVEALQKSQRHLMGEQLEPLNLKELQQLEQQLESSLKHIRTRKCQLMFESISELQKKEKSLQGAEQDAGEGAHGRSKKVEGTKPARPLGATRAAAKQTHSFPNLPSWIRRTLSPTLEIFGDLTNG

SEQ ID NO: 4452 - protein, 518 aa, Arabidopsis thaliana
MIAFLGFLCFLSKSGSFFSFIEMMDLQEETGEVKIEDQCVENKQSTPASCSSVSEGSAGSSHKSPTIASPATVSPTHRYLGRTSGPIRRAKGGWTPEEDETLRQAVDTFKGKSWKNIAKSFPDRTEVQCLHRWQKVLNPDLIKGPWTHEEDEKIVELVEKYGPAKWSIIAQSLPGRIGKQCRERWHNHLNPDINKDAWTTEEEVALMNAHRSHGNKWAEIAKVLPGRTDNAIKNHWNSSLKKKSEFYLLTGRLPPPTTTRNGVPDSVTKRSSSAQKRVFGSVAQTSSVTTDVNNLAEDGNGQINSSVPVEEVVAASRMTSLNEYARSPQLPNPEPLPENGGAANNGYHLYYTPQIDYYRASEVDTQRMYGNECGCSPSASPVSFFTPPPCRNVHSNGSTPRSPESYLREAGRTYPNTPSIFRKRRPRVVVQDNNNAKKTDEAKEVDQKVNDGKDSSEIQNNGSNAYNLSPPYRIRSKRTAVFKSRQLEFISREEEKADDETKSSEKDMLIDGDSQLLG

SEQ ID NO: 4453 - protein, 244 aa, Populus trichocarpa
MGRGRIQLKRIENKINRQVTFSKRRSGLLKKAHEISVLCDAEVALIVFSTKGKLFEYATDSCMERILERYERYSYAERQLLANDDPENHGSWTLEYAKLKARVDVLQRNQRHFMGEDLDSLNIKELQNLEHQIDSALKHVRSRKNQLMYESISELQKKDKALQEQNNMLAKKVKEKEKAIIAQQASWEQQNPDLDSPTILRPQPMQPLNISSSHLATGIEEEPAPIQHRANALLPAWMLRYLNE

SEQ ID NO: 4454 - protein, 134 aa, Brassica napus
RLINDCEPELSRDIIAENKHHIGSGFKKPVPPPVCSDDIDLLNDDGENFSARYTTKTFRSTLRIGDRRIKKVLASKYCKLSSKQKETTVTNSDMDLKPSYYNKKHCLKSFRSERRYPIKKRRYFDGYTASQSEE

SEQ ID NO: 4455 - protein, 693 aa, Oryza sativa Japonica Group
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITGYDVDKILESSTLLPGELARRKGKDIVSTVDAAGAPPRAPHMSMAATSLGNSREQSPDRGVGGGGGGGVLATLFAKPAAASKLYSPVPLNTWASPSPAEQRVGFAKPNSLWWCLSSQSKLKAHSRSNGGRKPSRGSEKNPPNPCMTFSASLDRTNEFEDATLHVDVILLKVHLVYTLGVSSVAASPRVTEDVALSCVFLHYSLTWELIPSAQPSFVRYVQPSSECKLTD

SEQ ID NO: 4456 - protein, 81 aa, Camelina sativa
ENSDHARMSKEIADKSHRLRQMRGEELHGLNIEELQQLEKALEAGLTRVIETKSGKIMNEISELQRKGMQLMDENKRLRQN

SEQ ID NO: 4457 - protein, 360 aa, Triticum aestivum
  misc_feature (177)..(177): Xaa can be any naturally occurring amino acid
  misc_feature (184)..(184): Xaa can be any naturally occurring amino acid
  misc_feature (205)..(205): Xaa can be any naturally occurring amino acid
  misc_feature (287)..(287): Xaa can be any naturally occurring amino acid
MCSMQAEQYQYMTEPEQMYHQQQQQFHDHRQHMSSRPSLSPEKKFFMKGQGGAGGGGGGDAGLILSTDAKPRLKWTPELHERFADAVKKLGGPDKATPKAIMRVMGIPGLTLYHLKSHLQKFRLSKNLQAQANAVNAKHVYGFGTATDKACEGHGSPADHLNRETNTSRSMHINDAXLQMQIEXRRRLHEQIEVQRHLQLRIEAXQGKYLHSVLEKAQEALGKQHVVAGLEAAEPTQRLPELASSVRRGLLQNDGSADDSCLTASEDILSMGLSASATRRGCGAPVXKPRRAATREEDQECHLFLANPEGRREARRAGCNGGAAFGKAAELDLSIGVVAASSRRRPDAGDRLDLNGSGWN

SEQ ID NO: 4458 - protein, 347 aa, Triticum aestivum
  misc_feature (208)..(208): Xaa can be any naturally occurring amino acid
  misc_feature (222)..(222): Xaa can be any naturally occurring amino acid
  misc_feature (241)..(241): Xaa can be any naturally occurring amino acid
  misc_feature (345)..(345): Xaa can be any naturally occurring amino acid
MEFAGEVDDFALDLIREHLLGGDGGVQATANHDQAGPFCDDVTFPVLPPSAAEPQAYTQQPMFFPQQQQQQQENQQMQAYMDLAHQYLNSCPAADVPETVFRAPEPVMIQFGGEPSPVTAPSSTLSISVPAKGSFGWAATAAAPAPPAPAPLEDLRKYRGVRQRPWGKYAAEIRDPKRRGSRVWLGTYDTSVEAARAYERAAFRMRGXPRPILNFPNEVGTXRGAELWAPPPPVPASQTAXATNKRKRSHEDDRDVEVTGVVINKAPKNEAPSPSSAQVSWDTPSSMSRETASSTVTSAATTPEGGLPPTPSSSGWEQYWEALLGGMPLLSPLSPHPALGFPQLXVS

SEQ ID NO: 4459 - protein, 563 aa, Zea mays
MRAMAEVMQEGCVENRQPLAASSSSVSDGSSCGGGERAGTSPPVSSSGNCISVLRRTSGPIRRTKGGWTLKEDETLRKAVEAFKGRNWKKIAEFFQDRTEVQCLHRWQKVLNPELIKGPWTQEEDEKIIDLVRKYGPTKWSIIAKSLPGRIGKQCRERWHNHLNPEIRKDAWTPEEERALIDAHQVFGNKWAEIAKVLPGRTDNSIKNHWNSSLKKKLEAYSNSSVLSVSKLFVHDDFKDKMKPVATDGHLDLNQMPSIGSKDSSGRAYHSIVSPLSQAYNLDSSCLSLSIPTMQPLTSHEMSSLIDGSAVTLVVQCLESDSVRDKDQEIDSVQEKGVEVSSTPDPVGVELESAPAKRGAELSSKNELHSTLGPLCYQILNMEDVIPISTPLCSEHNGAHQTSQQCMSPNGYTSLSPTIGKVSSQLTVDSILRMAADSFPCTPSILRKRKRNKATPGSGNELKTGGVNNDSFYTPNGTNGKDTTPRSFKTAASFSSLGSVDGLLTSVRSFDSSPPYQKRSKRMAIIKSVEKQLDFSADGLDTSGSEIMNSPCHNSQGVDSNRM

SEQ ID NO: 4460 - protein, 276 aa, Oryza sativa
MNGRTQLASWARIAMDRGDHHHLQQQHQFLMPPPAPVVPPQLCMPAMMADEQYMDLGGGGAAAAPGRGGAGERKRRFTEEQIRSLESMFHAHHAKLEPREKAELARELGLQPRQVAIWFQNKRARWRSKQLEHDYAALRSKYDALHSRVESLKQEKLALTVQLHELRERLREREERSGNGGAATTAASSSSCNGSGSEEVDDDDDKRNAAAGCLDLEPPESCVLGGATCATPADVSVESDQCDDQLDYDEGLFPESFCATPELWEPWPLVEWNAVA

SEQ ID NO: 4461 - protein, 475 aa, Aspergillus nidulans FGSC A4
MLEDPSYAEIVRWGDDGDSFVVLECEKFTKTILPKHFKHSNFASFVRQLNKYDFHKVRQNNEENGQSPYGQNAWEFKHPEFRANSKESLDNIRRKAPAPRKQAQAHDDSVPTQQIDLLNQQIVAQQQQIQHISDRYAQMSVDHQLMLQEVLRVQKTVVNHENVIHQLVNYLVSIDARQKRDNKAGSFQAQVGASPSQVTPMDDGVSTPLQQASKLLSDMNAEVQFNLVPVESMGEPPKTGVVSTPTMETAPRRVAPQPAAAATNPALVYPKMNGEMEPVVYPVGATNGIDPMYGEHVNNVPYTVPPKQDMDDRRQFPENRKKSNHVDPGWMRSPRILLVEDDATCRQIGGKFLYSFSCEIDTALDGLEAVNKVQDGSKYDLILMDIIMPNLDGVSACHLIRQFDRTPIIAMTSNIRSDDIQLYFQHGMDDVLPKPFTRKSLLEMLEKHLVHLKTVPQGMEAPPTCDRSHVGTSLN

SEQ ID NO: 4462 - protein, 376 aa, Euphorbia esula
MEGGSANSTCMIAFGDNSNGNGGGGGGLSPMMMMMPLMTASSHQHQHQHHHNHHHHNADSSSNSLFLPLPSPHPPNQEHHNRNNTSTTGGSSSMIIDDHNNTNSNSNTACYFMDTNTSTTASVKAKIMAHPHYHRLLAAYINCQKVGAPPEIAARLEEACASAATMGPSGTSCLGEDPALDQFMEAYCEMLTKYEQELFKPFKEAMLFLQRVESHFKALTVSSPHSACAEANDRNGSSEEEVDVNNNFIDPQAEDHELKGQLLRKYSGHLCSLRKEFMKKRKKGKLPKEARQQLLDWWSRHYKWPYPSESQKIALAESTGLDQKQINNWFINQRKRHWKPSEDMQFVVMDATHPHHYYMDNVLSNPFSMDISPSLL

SEQ ID NO: 4463 - protein, 370 aa, Euphorbia esula
MEGGSANSTCMIAFGDNSNGNGGGGGGGLSPMMMMMPLMTASSHNHHHHHNADSSSNSLFLPLPSPHPPNQEHHNRNNTSTTGGSSSMILDDHNNTNSNSNTACYFMDTNTSTTASVKAKIMAHPHYHRLLAAYINCQKVGAPPEIAARLEEACASAATMGPSGTSCLGEDPALDQFMEAYCEMLTKYEQELFKPFKEAMLFLQRVESQFKALTVSSPHSACAEANDRNGSSEEEVDVNNNFIDPQAEDHELKGQLLRKYSGHLCSLRQEFMKKRKKGKLPKEARQQLLDWWSRHYKWPYPSESQKIALAESTGLDQKQINNWFINQRKRHWKPSEDMQFVVMDATHPHHYYMDNVLSNPFSMDISPSLL

SEQ ID NO: 4464 - protein, 423 aa, Triticum aestivum
  misc_feature (248)..(248): Xaa can be any naturally occurring amino acid
  misc_feature (285)..(285): Xaa can be any naturally occurring amino acid
MMCSSDHFASNNHLYLQHNHQRLPGTGVVEACDLERIRHEQSRHGQEAEEHRSDPSAALTTYLTFLEHKVGQLRGILCSAPRHPQQQRAIVSAELRCIIVQLSSIANDLASDSGAGAADVAPYEPSEERSPSLSDATHDDSDDHAGADDGGEEEGEGPYEVVQIEKEAILAPHAHCCKVCGKGFKRDANLRMHMRGHGDQYKAPGALARPGSPAPGAGTERRFFYSCPYAGCKRNREHRDFQPLKTPXSCFKEAATAGRPLGPRVPVFPRLGPSRAFSVLADLRXTQEKHCGRDRWVCSCGVSFSRKDKLFAHVAIFDGGHTPALPPSDDEATGHCTAATATATAINSVLVPGSGGLLPTGGEEAVNLMEQSFSGQMLDGLNCSGAKVGIDDVRAKLSSPVGIDFCDFDGFDLLGAVAMDFNF

SEQ ID NO: 4465 - protein, 280 aa, Aspergillus nidulans FGSC A4
MAIPYATGLPADNQPLPSFRELLPPHLHEEIESTSYFNSQHNSRQPRERPASSHELGLNSVPREHASSRSSRPSPVLPPIRDLQSYPDRATGVYPDPRGLPPPPEITARPVGPHGYPHAAPAVPGPLADRNADAYRGVPPMHGQVRYHYPSMAYQSDPDHASVPSLSHAPQSNFGILGDSTDARNRRRRGNLPKPVTEILKAWFHAHLDHPYPSEEDKQMLMSRTGLTINQISNWFINARRRHLPALRNQRRTGGSDLDERQSLSDMEQTSPEPSPHRRL

SEQ ID NO: 4466 - protein, 807 aa, Zea mays
MVAAAAAAGGGADAGCGGGGGGGGKDALFVELWKACAGPLSSVPLLGEKVYYFPQGHIEQVEASTNHLAEHQGTPLYNLPWKIPCKLMNMELKAEPDTDEVYAQLTLLPDKKQDENTSARVENEEAEEEVVPHVPPATSEGLRIHSFCKTLTASDTSTHGGFSVLRRHADECLPPLDMSQHPPNQELVAKDLHGVEWRFRHIFRGQPRRHLLQSGWSVFVSAKRLVAGDAFIFLRGENGELRVGVRRALRHQTTIPSSVISSHSMHLGVLATAWHAVNTGSMFTVYYKPRTSPAEFVVSRARYCESLKRNYSIGMRFRMRFEGEEAAEQRFTGTIVGICVSDPSGWADSKWRSLKVRWDEASSVPRPERVSPWQIEPAVSPSPVNPLPVRFKRSRSSVNASPSDVSTVNREVASKVMVESQQNNLPRALHNQGRTQLTGRYRDSTDVKTAQDLTMWSSGTEQQRNNIAAQTKRCLEGWTQSRTPEGYNQLFSAFQPLKDAHNPLRPFPNKISGTRSSTWVTADARYPAQQANHNMLHGTLSFMPHSSGFRMIQQNNLVMPEAANFTGKSAFTSVQGHVTDQCSTGWFGPIESNSHTDHASSSLIRSQPLVIGNDVQKTKGTSFKLFGIPLGSPEKSEPLVSPPSVAYDGKLQTSPTDNNEPCSEATQNIQNKVPSSSTRSCKKVHKQGSALGRSIDLTKFACYDELIAELDQMFDFDGELKSPCRNWLVVYTDNEGDMMLVGDDPWNEFCDMVHKIFIYTREEVERMNPGALNSRLEDCLSESLGRGLASKEPRSGPSTSAVDSENC

SEQ ID NO: 4467 - protein, 328 aa, Vitis vinifera
  misc_feature (126)..(126): Xaa can be any naturally occurring amino acid
MDQLYGLHSPSSSDYHHPPPFPPENLISPSHYPNFNSPAPFPIFGSDQLLSASSLVVSDAASMVAEIQGGGSGEEVSSAIRAKIATHPLYPKLLHAYIECQKVGAPPEVAYLLEEIRRGSELCRRXAVSTCLGADPELDEFMETYCDILVKYKSDLARPFDEATASYMIAYKKHDLLAHVKVKPAHVSREKTHMKNNEAAGSSEEDLSGGEVEVQECLQTTENQELKDKLLRKYSGYISTLKHEFSKTKKKGKLPKEARQALLDWWNIHYKWPYPTEEDKIALAESTGLDQKQINNWFINQRKRHWKPSENMQFAVMDSIYGPFFMNE

SEQ ID NO: 4468 - protein, 356 aa, Zea mays
MEATPISMKPPAPPPVTLEPIELSTHAVGLTELERSSMNQLAIAPDPKRQRVEEAADGNGCKHCACKKSRCLKLYCPCFAGGGYCSDKCGCQPCFNKEAFSETVQTTRKVLLSRQKRMSMKINRRPEANAEPMEDAHHSSSSTPPRRGCNCKKSSCLKKYCDCYQDGTGCSLFCRCDDCQNPFGKNDGIIADDSKRYLYTGADLDHSEGEHDFVVERSPRLQSPMSKESSFHQTPPHLRASSRDAHVFPQAVSQWQALPRSWHCSNKRNGNDRAMDDSSANGNYKSSSHDWQMSKLEDGYSISRCVQILNGMVELSQVEKSVAPDVFLLPGNREIFVSLGGDVRAMWLKRKIQHLA

SEQ ID NO: 4469 - protein, 862 aa, Arabidopsis thaliana
MEDDGGSDGGEGNGGFSPNSSFGAFADTAMDLDFMDELLFDGCWLETTDSKSLKQTEQSPSASTAMNDNSPFLCFGENPSQDNFSNEETERMFPQAEKFLLEEAEVGKSWWIAPSASEGPSSSVKERLLQAISGLNEAVQDKDFLVQIWVPIQQEGKSFLTTWAQPHLFNQEYSSLAEYRHVSETYNFPADEGMKDFVGLPGRVFLQKFPEWTPDVRFFRRDEYPRIKEAQKCDVRGSLALPVFERGSGTCLGVVEIVTTTQKMNYRQELEKMCKALEFLQVYSDFYCAALPEIKDFLATICRSYDFPLALSWAPCARQGKVGSRHSDENFSECVSTIDSACSVPDEQSKSFWEACSEHHLLQGEGIVGKAFEATKLFFVPEVATFSKTNYPLAHHAKISGLHAALAVPLKSKSGLVEFVLEFFFPKACLDTEAQQEMLKSLCVTLQQDFRKTVESLTEIQMQESSWIAHMIKANEKGKDVSLSWEYQKEDPKELSSGRENSQLDPVPNNVPLEAEQLQQASTPGLRVDIGPSTESASTGGGNMLSSRRPGEKKRAKTEKTIGLEVLRQYFAGSLKDAAKSIGVCPTTLKRICRQHGIMRWPSRKIKKVGHSLKKLQLVMDSVQGAQGSIQLDSFYTSFPELNSPNMSSNGPSLKSNEQPSHLNAQTDNGIMAEENPRSPSSSCSKSSGSSNNNENTGNILVAEDADAVLKRAHSEAQLHNVNQEETKCLARTQSHKTFKEPLVLDNSSPLTGSSNTSLRARGAIKVKATFGEARIRFTLLPSWGFAELKQEIARRFNIDDISWFDLKYLDDDKEWVLLTCEADLVECIDIYRLTQTHTIKISLNEASQVKLSGSFGNTGLS

SEQ ID NO: 4470 - protein, 235 aa, Arabidopsis thaliana
MKLVQEEYRKGPWTEQEDILLVNFVHLFGDRRWDFVAKVSGLNRTGKSCRLRWVNYLHPGLKRGKMTPQEERLVLELHAKWGNRWSKIARKLPGRTDNEIKNYWRTHMRKKAQEKKRPMSPTSSSSNCCSSSMTTTTSQDTGGSNGKMNQECEDGYYSMDDIWREIDQSGANVIKPVKDNYYSEQSCYLNFPPLASPTWESSLESIWNMDADESKMSSFAIDQFPLSFEHGSGRL

SEQ ID NO: 4471 - protein, 375 aa, Oryza sativa Japonica Group
MESFASLAGGGSSSTTARLPELISPENPDHISPPPLLYQLLAGPESSARQHGHDGHHHGGGGGEAAAAAVQGQVSPAGAEAAVKAEIMSHPQYSALLAAYLGCKKVGAPPDVLTKLTAVPAAQQLDEADGHPRRRHEPQRDDDPDQLDQFMDAYCSMLTRYREELERPILEAAEFFSRVETQLDSLAESNCEGTGSSEEEQDPSDKQLKHQLLRKYGGSLGDLRQVFSKRTKKGKLPKEARQKLLHWWELHYKWPYPSVRTHHIPFDQFNHIFCTKLTRLKMREIYGVVYEQEMEKMTLAQTTGLDQKQINNWFINQRKRHWKPTPVAGTAFPTMEAAGGGFRHSGHGGGLAAAAALPLYMGSPFVVDGMNRLGS

SEQ ID NO: 4472 - protein, 642 aa, Zea mays
  misc_feature (606)..(606): Xaa can be any naturally occurring amino acid
MTDGHHFNNILLGGRGGTNPGQFKVHSGGLAWKRQGGGKTIEIDKADVTAVTWMKVPRAYQLGVRIKAGLFYRFIGFREQDVSNLTNFIQKNMGVTPDEKQLSVSGQNWGGIDIDGNMLTFMVGSKQAFEVSLPDVAQTQMQGKTDVLLELHVDDTTGANEKDSLMDLSFHVPTSNTQFVGDESRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEAVVERDLALSKELLVEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRNEYHNLFNFINGKNIKIMNLGGDGQGASGVVTDVLRDTDDDAVDPHLERIKNQAGDEESDEEDEDFVADKDDSGSPTDDSGDEESDASDSGGEKEKSSKKEASSSKPVQKRKHKGRDDEGQEKKKPKKKKDPNAPKRAMTPFMYFSMAERGNMKSSNPDLPTTEIAKKLGEMWQKMSGEEKPPXQPYIQQAQVDKKRYEKESAVYRGEATVDVDSGNESD

SEQ ID NO: 4473 - protein, 317 aa, Triticum aestivum
MDFGGDMDDFSLQYIHEQLRLQLLGADPCGLLPLPAADDFAAQPDFIPAEFLPQPLPAFVDLTATDYADAAAYRAAAEPVIIRFGGEASPVSDPARRPSLTISLPPASHAWAQAPVLAAEAAAAVDANDFRKYRGVRQRPWGKFAAEIRDPNKRGSRVWLGTYDTSIEAARAYDRAAFRMRGAKAILNFPNEVGSRGATDFVAPPPSQTARAAPTSHNKRKRQEAAEPCVEVVRDATKHSKADASASPASSLTSTPTSTVTSGTTTPSSSDAGGYYEMSFPLASPTSWTWDQLLAEGMFGSLSPRQQLGSFPEVTVN

SEQ ID NO: 4474 - protein, 449 aa, Physcomitrella patens subsp. patens
MQDPTDVSQRPGIEGMSSPQRGGMAGGFAQGLHTPALVRHQPPPSSLPAISLSQGAQVGAPGMSTSVFETGPVGPHPRSIIAARPPSSSGINMGMIATPIVGAGGETRGEQPPKRKRGRPRKFATGGELSSGALGSVYPVLPALMPASSSPYTPSPEKRGRGRPPGSGKKQQLAALGVVLAGTGQGFTPHILTVSTGEDVSTRIMQFAQHGPRAMCVLSANGAISNVTLRQQSSSGGTVTYEVNVPSDYIEDCYDMLQHWFSAFINMWFTFYIVNTCTVNYGRYEILSLTGSYLSTELGGGARQRTGGLSVSLAGSDGRVIGGGVAGMLTAASPIQVVVASFLSDTFKAQAKGESPLGSTPGGSSGAGSAPGSTPGSALGGQRPPTARSEPKTSSALGPRQVSPVPPPTGQVSVQRPQVMSMFQPMAGWQPAVPGDGRRTDINISLPGG

SEQ ID NO: 4475 - protein, 212 aa, Triticum aestivum
GRVGGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAAASRQQQQQQQQMQWEHQTQTHTLAHTISKVKK

SEQ ID NO: 4476 - protein, 635 aa, Physcomitrella patens subsp. patens
HQFNSILLGGRGGTNPGQLKINSGGFQWRKAGGGKVVEVSTSDIASLSWTRVPKGFQLGVKLKAGRDVKFNGFRESDMANLGSFFTTNMGITSEEKPLAISGRNWGDVTLEGSSLAFSVGGKHAFDVSIADVSQTQMQGKNEVMLEFHVDDTTGASEKDTLMELSFHIPTTNTTYIGDEERPPAQIFREKILSMGDVGPSGAEAIALFEEVHILTPRGRYNVELHASFLRLQGQANDFKIQYSSVVRLFILPKSNQPHTFVVITLDPPIRKGQTFYPHIVLQFPSEEIAECTLSIGEELLNTKYKDRLQPAYKDLSHDVFTQILKGLSGAKVTRPGKFRSAQDGYCVRTSLKAEEGTLYPLEKSFFFLPKPPTLILHDEIEYLEFERHGAAGTSSISSHYFDLLIRLKSEQEHQFRNIQRNEYHNLFNFISGKNLKIMNLGDAQGTSGVAAALEGSDDEGVDPHLNRIRSARESGGAGLGDEDSDEEDEDFVAEKDDAGSPTDESDGEEPDGSDDGGERPKKKREKREDVAPKSAPKKRKKKDEADGEDGGKKKRKKKEKDPNAPKRALSAFMRFQLEERKKMKADPGQASMSFGEFGKSLGEKWRNMSASDKAPYEADAKVDQERYKKAMAGYK

SEQ ID NO: 4477 - protein, 171 aa, Arabidopsis thaliana
GSHMGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQK

SEQ ID NO: 4478 - protein, 220 aa, Triticum aestivum
  misc_feature (181)..(181): Xaa can be any naturally occurring amino acid
  misc_feature (198)..(198): Xaa can be any naturally occurring amino acid
MAPKNALPVAVAAAADGGMEPRFRGVRKRPWGRYAAEIRDPARKARVWLGTFDTAEAAARAYDAAALHYRGPKAKTNFPVGTVAAYTHIPLPPPKALAVSPSSSTVESSSRDTPAAAPAAPAAAAPAAPPALDLSLAMPAMVAAQPFLFLDPRVAVTVAVAAPAPAPAPCRSAAISGMNKXASREGEQSDTGSSSSVXVTPSPPVGVGFDPDPPPPVEMA

SEQ ID NO: 4479 - protein, 156 aa, Eucommia ulmoides
KAQVVGWPPVGSFRKSTLASTSKNNEEVDGKPGPGSLFVKVSMDGAPYLRKVDLGTYTTYQELSSALEKMFSCFIIGQCASQGASAKEKLSESKLRDLLHGSEYVLTYEDKDGDWMLVGDVPWEMFIDSCKRLKIMKGSDAIGLAPRAMEKSKNKN

SEQ ID NO: 4480 - protein, 391 aa, Zea mays
MGGHGDHHRRRRQEVEVLVHDDDEDLEHQSRACGGGATSGVVVEQGAGDGGGQAASSSLGSVSAATMAPPQIFCWPPQHHHNSSNDVGGGQQPPFFPPLPPLPPTPPPFFADLYARRALQLAYDHHHPGGGPSTSSDPLGLYMAGGGSGMMMMPPPFASSLPFGDFGRMTAQEIMDAKALAASRSHSEAERRRRERINAHLARLRSLLPNTTKTDKASLLAEVIQHVKELKRQTSEITEEEACPLPTESDELTVDAGSDEDGRLVVRASLCCDDRADLLPDLVRALKALRLRALKAEITTLGGRVKNVLLITADDDSSAHDGQREEEEEEAPMSPQRTVASIQEALRAVMERTASAAAEESGAAAASTGGAAGLKRQRMTSLSAILENRSI

SEQ ID NO: 4481 - protein, 366 aa, Oryza sativa Japonica Group
MEEMLMGANPNPNGSSNQPPPPPSSAASAQRPIAPPAAGAAAGAGAAGAGAGTERRARPQKEKALNCPRCNSTNTKFCYYNNYSLQQPRYFCKTCRRYWTEGGSLRNVPVGGGSRKNKRSSSSVVPSAAASASTSAAVSGSVPVGLAAKNPKLMHEGAQDLNLAFPHHHGRALQPPEFTAFPSLESSSVCNPGGNLAAANGAGGRGSVGAFSAMELLRSTGCYVPLPQMAPLGMPAEYAAAGFHLGEFRMPPPPQQQQQQQAQTVLGFSLDTHGAGAGGGSGVFGACSAGLQESAAGRLLFPFEDLKPVVSAAAGDANSGGDHQYDHGKNQGGGGGVIGGHEAPGFWNSSMIGNGSSNGGGGGGSW

SEQ ID NO: 4482 - protein, 232 aa, Brassica napus
EDMETGNDDDEGDWDAKFENLVPPPLDVLSSEFTHGLRKPVPTLRQSSSSEVSSTIDNSLHDVKVSTLFQSSSALSVLANGSVSFPLKGTRSNLRKRPTPPTFRSLKSFASEMVQQFAPDDPDSETYLPFAKKKRQRKNKDQSSVSDSPEQFNADGTIRMCTHCETTKTPQWREGPCGPKTLCNACGVRFRSGRLLPEYRPSSSPSFIPSLHSNSHRKIIEMRRKDQDLQPG

SEQ ID NO: 4483 - protein, 290 aa, Brassica napus
  misc_feature (194)..(194): Xaa can be any naturally occurring amino acid
MMFNEMGMLGGNMDLYSSSSLGELDFCPAPQLEPDSIVEDDYTDDEIDVDELERRMWRDKMRLKRLKEQDKSSKQGVDYDSAKQRQSQEQARRKKMSRAQDGILKYMLKMMEVCKAQGFVYGIIPENGKPVTGASDNLREWWKDKVRFDRNGPAAIGKYQADNNVPGACENNGLIGPTPHTLQELQDTTLGSLXLSALMQHCDPPQRRFPLEKGVPPPWWPSGKEDWWCQLGLGKDQGPAPYKKPHDLKKAWKVGVLTAVIKHMFPDVGKIRTSVSGFIYVLCLVLLFWL

SEQ ID NO: 4484 - protein, 319 aa, Oryza sativa Japonica Group
MGGGGGVEADCDRIRGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRKLAVATTTTTTTTGAAAAPGVVADAAELVERPCKRFSPTPDSPSGSGSGSDRSDLSHGGGFGQIFRPVARTGAFEPVDCAISRRQEEDPFTSLSLSLPGTDQRFNHDSAHSHFQELPSSPSPPPPPPPAAAASTTQYPFTPGVRRRDAGDDPRRGAQVHCEPSASAPVAPTPAVPTSTCRSWWRASCAPPRSASGGCTDQKPSVH

SEQ ID NO: 4485 - protein, 408 aa, Zea mays
MSGARHDHHMLSGDFVSHDELAAMFEHQRADAAPPATQQPWFMDYLHAVASPLDCDAFVSGFDDVPPTVDEIVKRELLVDTAATGGAGATTTAPLTPNSMSMSSTSSEACGAGAGEELATAGKSKKEEGDGEGFESKDGDAAAAKGDAQGQEKSKKGAANKGKVKGEKRPRQPRFAFMTKSEVDHLEDGYRWRKYGQKAVKNSPFPRSYYRCTTQKCPVKKRVERSYQDAAVVITTYEGKHTHPIPATLRGSTHLLAASAHHPMSGLHHHHHLRVPAALGGANDAFDALGLLQQQAHHHGAVMQQLMAAVGGDGGAGLQQVNAAAMSGHVALAADDQHGWAAAIAGVGAAAGGSTTATATAAAATPAAAASAPLRMQHFMAQDYAGLLQDMFPPFVHSSDGGHHHHHH

SEQ ID NO: 4486 - protein, 305 aa, Zea mays
MEDLYSIHPGISRHGAAATSEASGVAGGPGSPPPPPPPAADLTELVKAQIAGHPRYPSLLSAYIDCRKVGAPSEVATLLEEIGRERCAAASAGGEVVGMDPELDEFMETYCRLLERYKEELSRPFDEAASFLSSVRTQLSSLCGGAASLSDEMVESSEDEPCSGDTDATTDPGQEHSSRLADRELKEMLLKKYSGCLSRLRSEFLKKRKKGKLPKDARSALMDWWNTHYRWPYPTTKYLVRQEEDKVRLAAMTGLDPKQINNWFINQRKRHWKPSEDMRFALMEGGVSGSSSGTTLYFDTGTIGP

SEQ ID NO: 4487 - protein, 172 aa, Triticum aestivum
PFRTDRHSKIRTAQGVRDRRMRLSLDVARDFFALQDQLGFDKASKTVDWLLTQSKPAIDRLSESSRLNAARAGEDGMSSLSSVEREGRRLKETELAAGSGKGEADAEKAMKARGGGTSVLMEHRRENGGLMSASMTGGEYYDLGEMMCINAGECDDDGDYDEDGDFLDGMQY

SEQ ID NO: 4488 - protein, 299 aa, Vitis vinifera
MMHSSTVLNMESNVKLSEGAKGKPYPTPANVRYSGFSGYGGLHDLGAEQCPGNWLLPLLPHSYSETTPHLMGLKPQPLYVQEEVVKSKGDGNCKLFGISLISKPAANPMHRPQGEIQLTMENPARHPEQSKSSKYMEIGGFEHEKPFQALEQQLSRDDQSKLHSGSTRSCIKVHKQGIAVGRSVDLTKFNGYTELISELDQIFEFNGELISLNKDWLIVFTDDEGDMMLVGDDPWPEFCSMVRKIFVYTREEIQRMDPRPLNPKVRENPTVLEKKGGAKEAKELETSLSSESLGQGKSA

SEQ ID NO: 4489 - protein, 489 aa, Vitis vinifera
MDFVDSEDALYKELWHACAGPLVTVPRVGERVFYFPQGHLEQVLLLSVCVADQQMPAYDLRAKILCRVINVHLKAESDTDEVFAQVTLLPEPKQDENSAEKEDVLTPTPRPRVHSFCKTLTASDTSTHGGFSVLRRHADECLPPLDMSKQPPTQELVAKDLHGNEYPLVIMNFTGQPRRHLLQSGWSLFVSSKKLVAGDAFIFLRGENGELRVGVRRAMRQLSNGPSSVISSHSMHLGVLATAWHAVSTGTIFTVYYKPRTSPAEFIIPFDQYMEAVKNHYSIGMRFKMKFEGEEAPEQRFTGTVIGTEDADPMRWPGSKWRCLKVRWDETSSVPRPECVSPWNIEVALTPPSLNPLPVSRSKRPRANMMSSSTESSVLTREGLSKVTIDHSPGSGFSRALQGQEISTLRGIFMENNNDLVTTQKSIVQPRSQVVDQMDSASTKRSFMSEDWVPQLRQGVQCANLISGMHNIHDSHFYPPTVDQNPDVV

SEQ ID NO: 4490 - protein, 180 aa, Aspergillus parasiticus
EFAKTLIPELFKHNNYASFVRQLNMYGFHKKVGLSDNSMRASERKNKSPSEYANPYFKRGHPDLLWLIQKPKNTAGQGSKSGKANVRVKTEEVDEHDNDDYDDVSGARDDRSRNRQLSLVQGGSIMPKDQLAGVYRELQAIRQQQQVISNTITKLRREHEQLYAQAANFQEQHTRHENSI

SEQ ID NO: 4491 - protein, 336 aa, Zea mays
MDLRFPPPAPSSCFGGGGVLPARGHHRRAQSETFIRLPDADLLLDPDADFGFSDIDFPSLSDDSPAASDPTPQPQAPPPQQPLPQAASPASAAPPRPPSGAHMRSLSLDAAFFDGLSLQGGGGVAGHKRSGSMDGATSPFEGESAPTSVLPDYAKKAVPDDRLAELALLDPKRAKRILANRQSAARSKERKIKYTSELERKVQTLQTEATTLSAQLTLLQRDTSGLTTENRELKLRLQAMEEQAKLRDALNDALREEVQRLKIATGQVPNINGNPFNGGLPRLPQQQQQQVPSYFSQPQGMQYFSSHQGQHQHPNHHPQSSSNGGGQSLSDSMDFM

SEQ ID NO: 4492 - protein, 152 aa, Oryza sativa
MGSSDQKVIGIAAAAAAAAEEAGRRCCVECGATTTPMWRGGPTGPRSLCNACGIRYRKKRRQELGLDKKQQQEHHPHHHQQQQQQYQRQQQQQQQEDHSDAASSVKDSSSSSSNKSSSLQVVKKRRVLMGVEEAAILLMALSSSSSPTLLHG

SEQ ID NO: 4493 - protein, 299 aa, Zea mays
MASSSPSCRGSGGKSDVDRIKGPWSPEEDEALQRLVARHGARNWSLISRSIPGRSGKSCRLRWCNQLSPQVEHRPFTAEEDDTILRAHARFGNKWATIARLLSGRTDNAIKNHWNSTLKRKYYAASDAVVADADDERPLKRTSSDGHPGLCFSPGSPSGSDLSDSSNHSLPSVMPSAASAAAVTSHQQQQHVYRPVPRAGGVVMLPVAPLAPPPPPQPPATSLSLSLSLPGRDGQKPQASQAVRTPAPAPPQPPLQIQQQQPAPPQMPPPQAQPSWPFQRQAAALEYPWRGPSLRVPEL

SEQ ID NO: 4494 - protein, 193 aa, Triticum aestivum
MRNGSTVCDAAAAVGLGVAPRYRGVRKRPWGRFAAEIRDPAKRARVWLGTYDSAEAAARAYDVAARTLRGPLATTNFPHDLVSFPTLPALPRPSPPASPGPACSASSTVESYSGPRAANAPRAVPRAPGPTPLLAKLPGGDAGCQSDCASSASVVDDAGDEAASAVVRARAPFVFNLNLPPPSDELCTELRLF

SEQ ID NO: 4495 - protein, 89 aa, Physcomitrella patens subsp. patens
TTNNLKKEKGAKSKRERKPRYAIQTRSDVDIMEDGYKWRKYGQKAVKNSPYPRSYYRCTNPDCPVRKRVERKADDHGLVVTTYEGTHNH

SEQ ID NO: 4496 - protein, 175 aa, Glycine max
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNTNNGRLPIPVHRPNGTNNAGTLPSTSTSMPQSQSQTVVVENPMSVDSSGKLVSNVVVGVTTDKK

SEQ ID NO: 4497 - protein, 246 aa, Oryza sativa Japonica Group
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 4498 - protein, 388 aa, Arabidopsis thaliana
MYYQNQHQGKNILSSSRMHITSERHPFLRGNSPGDSGLILSTDAKPRLKWTPDLHERFIEAVNQLGGADKATPKTIMKVMGIPGLTLYHLKSHLQKYRLSKNLNGQANNSFNKIGIMTMMEEKTPDADEIQSENLSIGPQPNKNSPIGEALQMQIEVQRRLHEQLELRIEAQGKYLQSVLEKAQETLGRQNLGAAGIEAAKVQLSELVSKVSAEYPNSSFLEPKELQNLCSQQMQTNYPPDCSLESCLTSSEGTQKNSKMLENNRLGLRTYIGDSTSEQKEIMEEPLFQRMELTWTEGLRGNPYLSTMVSEAEQRISYSERSPGRLSIGVGLHGHKSQHQQGNNEDHKLETRNRKGMDSTTELDLNTHVENYCTTRTKQFDLNGFSWN

SEQ ID NO: 4499 - protein, 1039 aa, Cryptococcus neoformans var. neoformans
MSRVPSGSQQPQYTQQPLYHPSSVHSQSTPIQQTHQQYHPHTGQPMTFQGDAHAYSYDRQSQINTWQANPGAAGSMEYHSAVAGSSRGADPYQPYSQSHRSSPSQSVTASRTQPASAQQYTPWAPVQTSATTPSSRGGGVKLEDLMSSDSRAGGKNQPLSGIPLSVSASFDTRSQFSAGPQGASAEKEKDKERDKATQQQGPSEFIKKLYKMLEEEQAQYGNSRTKKGEKGKRGSVGWGANGTSFVVWDMNDFTTKILPQTFRHSNFSSFVRQLNKYGFSKIKHVDAGTGSIKENIWEFQHPNFQAGGKSDLESIKRKPVAPKKANNQEGDENSPRHIGLSNEDQTRMHLMEDRINMLEDALAKSRSEADEARMREMAMMGLVRDMIGHIAASESEAIGSPAATTGHSPRVLHLLKSLDNLARAYPPEMYHSNIARQPTTMPYTPAQPQSHQSFLNAAYNPAFSGNSVGGAAQAQASPHTDGTGSRGSFSGPSTGEIKPPASSSRLRAASNAGAAPSGSVNASVPLASQPTGNPPAGPVARAEDPAEDVIEIPNQMQDMYGGESVGIAPLFVETPAWLTEGTTVPLTMYRKQSDGQVLKAVYQAFAAGGKLPAGEGQDEDGNAIASGSSTSAAEIMAGSSQMGLQQSYGAGSSTSTGIPLPMEGSPSSESSSRKGKGKKSRGTSLKEQRESKLKPHWAQTPRILVVEDDIVYRTLSKKFLQKFGCETETVENAQGAVDKMNGTKYDLVLMDIFFGPNMDGRKATSLIRQFNNYTPIISMTSNAQPQDVDSYYQSGMNDILAKPFTKNHLFTILDKHLVHLRHAQLYERLIPLGVGVPPLSDQHVQEALAVSAANLQNTNGQLQLENGPTAETQNEQQDSNGELELGIRNPLAGSGWSDEAYQLVLAQFLQTGVMPDITTISAVSSSPNPNGIDGTIGTSIVFGESSGFSRKRSIEAISDDNWDGQAQTSASAQAQTQAQVQNTIMQGDQQQGMSLQMPMNVGMGMEVNMGNMPESGMMNQDISNGSDGREAKRARGMAG

SEQ ID NO: 4500 - protein, 400 aa, Sesamum indicum
MGDRVFQHRNSSSILNCPSSVMATTSISDNVAGMSICSESMFKPPNGIDPFYSSSGWDPVISQDQSGNFGNSSMVLQNEFANPNYPVLLENQTMGSSSHLVHFPSDSGLVGMVPKIPSFGSGSFSEIVSSFGHSNFAQNNGAGVQNTVKNVEDAQDHRQDSENGVLGASPNGKRKRKNVEVEKQKDQTRDLAELPKEYDEKKNSGPSSRSRQAVKEAKDNSSGAEASKENYIHVRAKRGQATNSHSLAERVRRERISERMRLLQELVPGCNKITGKAVMLDEIINYVQSLQQQVEFLSMKLATVNPELNVDIERLLSKDILHSRGSNATALGIGPGLSSSHPFQGLPQGTLNAFPGTAPQFQSLPQNLWNNELQNILQNGYDSNPSVGSLGPSGLSKMEL

SEQ ID NO: 4501 - protein, 402 aa, Zea mays
MESGGGGDDQLHGLKFGKKIYFEDAAGSSSGSSSGGGSAPAPPATQQPSPPAASPRAPAGGGRRGRAAAGGAGPSTAPAPARCQVDGCNVDLTDVKPAYYCRHKVCKMHSKEPRVLVNGLEQRFCQQCSRFHQLPEFDQLKKSCRKRLAGHNERRRRPPPGPLASRYGRHAASLGEPGRLRSFMLDFSYPRVSSAMRGGFPAVRPGGERVPGGIQWQAGLDPRHHQGAVAGYGAHYGSEGGSSSSARPPVFPGPELPPGGCLAGVPADSSCALSLLSTQPWDAAHSHSHSHAAPTAGFDGGSPVAPSLMAASSYIAPSPWTETDSWGHEGGRSVPQLPPDDVPLGEVHSGSSSHHGQFSGELELALQGNRPAPGSAAPPAPRNNQGSAGTFDQAGNTMDWSL

SEQ ID NO: 4502 - protein, 179 aa, Brassica napus
MNIGICDDDRDATAPFELSFDYESHNTYEEEVIKNIEGSGECVKVKEEEQKNVLMLRLNYDSVISTWGGQGPPWTSGEPPERDIDISSWPFVSMGGNVRESQQKHHVGVCLPSSGFGDGGREARVSRYREKRRTRLFSKKIRYEVRKLNAEKRPRMKGRFVKRASLAVSAMNSPLGVNY

SEQ ID NO: 4503 - protein, 432 aa, Ostreococcus tauri
MRAGARETRDRAWRNAQYCLFILFGFSAVRRRARHRAGDGDETLETDHFFSLDSQEDEMLREQIERLGGPGNWTAIAEALPGRSSKSCRLRWCNQLNPNVKRGPFTPEEDNTILMQHAIHGNKWAVISRYMPGRTDNQVKNRFNSTLRRLIASQKKEGGGATSMQSGSGSAPASPRGKAPSRPQSRLGDANAPMTPSRSKRERSLSPGETVDQAGGSPKRSRSSAEASKLSERRSGDRSSGDSRLDNVRKAGESSATERQGLDNLIQASLMELKRLKDIKGEIHEWGAMPYGAVRDCGTPEPVRSEPDDGVVPTLQKPQPKRGGFSVSAASDMYDWRSHSPALSATFLAGLKRVDSLASLNEDEKAPSRPVSAMGAHMMTASNMLESDGWYARMLDNLGKRKGDNTEVSSKSVAVVNTESFVKPVQIGAEAA

SEQ ID NO: 4504 - protein, 995 aa, Arabidopsis thaliana
MKREMKAPTTPLESLQGDLKGKQGRTSGPARRSTKGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSNGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDNGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCDLVPSNSDLRQEYSPFGIRQLMISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNDQETSGSFFELRLCSPGMTRARPDNKVNASAKDLSNQHKISLGDFPTEEMSSEPLCTVDSIPLSAIDKTNTAETSFDIENFNIFDGTPFRKLLDTPSPWKSPLLFGSFLQSPKLPPEITFEDIGCFMSPGERSYDAIGLMKHLSEHSATAYADALEVLGNDTPESILKKRQLNKSIQGKENQHQPHDQLGNRSQVECRALDFSDCGTPGKAKVPSASPGGYSSPSSYLLKSCR

SEQ ID NO: 4505 - protein, 332 aa, Glycine max
MNQKFIGKPPATVDLDRMPERGSHHRRSHSDTSFRFAANFDDLLLFDPSDFDISGLPSPLPLPSPVSAGLVPMSVDSDESGKQPRPAGASAGGHLRSLSVDSDFFDGLGFGVGGDERGAGKGGGGERRVGHHRHSNSMDGSSTTSFEADSAMIMDGVKKAMAPDKLAELALMDPKRAKRILANRQSAARSKERKIRYTSELERKVQTLQTEATNLSAQLTMLQRDTTDLTTENKELKLRLEALEQEAQLREDLNEALKEELQRLRAQSTRLGAIGGNPSFGGIFNQLASQLAMQQLSNSAPHQQTQHQPQVGMPPPPSGQNHPNFMDFNQQK

SEQ ID NO: 4506 - protein, 70 aa, Picea abies
ERVERHELFGKWRSRLTMAGFKSYPLSAHVNSTIKVVLNSYNQNYRLLEKDEALYLGWLDRDLIVASAWK

SEQ ID NO: 4507 - protein, 220 aa, Arabidopsis thaliana
MVSPFSMPFIAQTSGFVNYSQVFITQTIAKRYHALIPTSNMVIVQNDNDRVNRFMTSYPPILKSTVNPPNDFDKQYETFTPKPIDFFCSQQDYACRQHLDIFSSSPKHYHEQYVHKNGRSVKYICKPTEVLEEIHDEIDYEKDGGWIYSLPFEKDSSFICLKCNSLFDTSQMLVVHTELIHSKNETKKRLKLHHQEFHGKSHKINKDQTGGQSCRRKLRQ

SEQ ID NO: 4508 - protein, 549 aa, Vitis vinifera
MEESKNSVADIVPIVSKITEHKLNGSNYIEWSKTIKIYLRSVAKDDHLTEEPPNDHTRKLWMQDDARLFLQMKNSINSDIVGLLSHCEFVKELMDYLDFLYSGKGNVSRMYDVWNAFHCPEKGAKSLTAYFMDFKKLACARLRCPGAIFQPQMFLSNSNGNNPISYPDQTILHAPFITDVSHNSQQEDPPSSFFYFPSPFIHYEDDAFLQHNDLIPQLQALMPGDTLADTMVNMVNSNKNSNELIGDRKQSNSVTEPIMQKRSSKRDRHSKINTARGPRDRRMRLSLEIARKFFDLQDMLGFDKASKTVEWLLIKAKSAIKELSRGVPQMKHSCSISVKSASSTSDCEELSGIDTINGDQQGSISKGKRSKCLTKERKTRQSRKNAFQPLARESREKARARARERTREKMWSRRLDESKVCAEANSHDLNHLGSISSFETGEESGSQSHNLIPSLELLPEVEEPSSNEQHHSGITEAMLDNSLVIMSKQWSPSSIFNYLNFGISQEVSSNNSFLIYRNWRTLIVCTKMHYSYWAVTNMQQSRSSLQHGT

SEQ ID NO: 4509 - protein, 241 aa, Zea mays
MAMLREHLDLIRAHLLDDNHDAVSSDDSAPSPSPSPPGRRPLPALSVSLPPRPAVVLQQQHLRAAAPPLQIPQQEQHCCPEPEEDDFRRYRGVRQRPWGKYAAEIRDPARKGARVWLGTYDTAVEAARAYDRAAFRLRGSKAILNFPNEVALSTAAWWATPAPPPQPSATVAGNKRARSPQEQDARCMVREVKKERIQEPASGGADYFWEDESLKGAICSLPPLSPLSPHPHLAVPQLYVS

SEQ ID NO: 4510 - protein, 268 aa, Arabidopsis thaliana
LRWCNQLSPEVEHRAFSQEEDETIIRAHARFGNKWATISRPLNGRTDNAIKNHWNSTLKRKCSVEGQSCDFGGNGGYDGNLGEEQPLKRTASGGGGVSTGLYMSPGSPSGSGVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFRESVVNQIGIGKME

SEQ ID NO: 4511 - protein, 225 aa, Oryza sativa
PCTHVGSAPGTLQAELGRMTAKEIMDAKALAASRSHSEAERRRRQRINGHLARLRSLLPNTTKTDKASLLAEVIEHVKELKRQTSAMMEDGLLPTEDDQLEVDAAADQGGRLVARASLCCEDRADLIPGIARALAALRLRARRAEIATLGGRVRSVLLIAAVEEEDPDEAGHELVASIHEALRGVMNRKAASSDTSSSGAGGGGGSIKRQRMISAHDQQGSFNSS

SEQ ID NO: 4512 - protein, 599 aa, Physcomitrella patens
MSDTVEFYLITRSIIKVKNFRRTGGPTRRSSKGGWTPEEDETLRRAVQCFNGKNWKKIAEFFTDRTDVQCLHRWQKVLNPDLVKGAWTKEEDDRIMELVNKYGAKKWSVIAQNLPGRIGKQCRERWHNHLNPSIKREAWTQQEDLALIRAHQLYGNKWAEIAKFLPGRTDNSIKNHWNSTMKKKVDPLTANDPISRALAAYQAQQEQSMNSGSGVGQVDSGSIGGRTGPPMSETTTSSDPSRHNSNTRGLGRTSHYVEQDTKSTGSAPPPPYPDTYPNRGKDQQRNASHLQPKKEESDHDLIGQSLGFSGWSSGQLPVYSGGFSGVSLGTSSLSNSVTEQLVPSVQHKRAMSNIELTRIASFSNSFPRIPAPESSSQAYRSSSMSVPLPDLGSLFASSHMPMAAHNDTQPLSSFNGTGVPPGEETLAMMGSKQNYEPLRRCNLPPSQPSEGDAAFEDSGASVRCDSQMAEPMDKAMDQDVSEFPSDNLLRDSSEAVNEYQSQSPMLTEEDLEDKGDSSRVQDRDGLFYEPPRIVDPPFMNYDLVSSLNAYSPLGVRQMIMPAGNCITPPNYLQSPFQGKSPQSKLRSAAKSFSGSPSIL

SEQ ID NO: 4513 - protein, 197 aa, Hordeum vulgare subsp. vulgare
ECFPGRTDVQCLHRWQKVLNPELIKGPWSKEEDDIIVEMVKKYGPKKWSTIAQALPGRIGKQCRERWHNHLNPGINKDAWTQEEEITLIHAHRMYGNKWAELTKFLPGKTDNSIKNHWNSSVKKKIGSYMSSGLLAQVSRLPLVEHHAHFSSSPAITQQNSEDSESNAVREVEDSSGCSQSSLGIVSSRKCRHASLG

SEQ ID NO: 4514 - protein, 456 aa, Nicotiana tabacum
MASKIGTAGNRSGTTGMPSFISQIPVSNPMGTEANNTNTSRMSDFGVLEQYLGFRIGDGANVNRSPLFNSTSATNPAVGFEVSGTINRTLAPSNTSLPTATPRSQTMLLQSNLVSASGTHHENWGESNMADSGSRTDTSTDMDGDDKNQLIEAGQSSDKSKEKVLDQKTLRRLAQNREAARKSRLRKKAYVQQLENSRLKLSQLEQDLQRARQQGKYISNIADQSNGVGANGPLAFDAEYSRWLEEHNKHINELRTAVNAHASDPELRSIVNNVTAHFDEVFRVKGNAAKADVFHVLSGMWKTPAERCFMWIGGFRPSELLKLLVNQLEPLTEQQLAGIYNLQQSSHQAEDALSQGMEALQQSLAETLANGSPAPEGSSGDVANYMGQMAMAMGKLGTLEGFLRQADNLRQQTLQQMHRVLTTRQSARALLAINEYFSRLRALSSLWLARPREQLV

SEQ ID NO: 4515 - protein, 459 aa, Schizosaccharomyces pombe 972h-
MAEEKKEELFTSIGNAAQNVSTAEDREGNGVQEVESLCMECGKNGTTKLLLTVIPYFREVVLMSFECPHCGFKNAQVQHAETIQPEGSKITFHVEDKEDLNRTVVKSQEAIVSIPEIQLEIPGRLGQLTTIEGILSNVVDDLSKEQESRKESAPQLYDQINAFIEKVNSLRSGSVPFTITVDDITGNSWIEMKPGRDGDRWSQVSYKRTLEQNTKLGLVDTDQPEDVKTQTNNASNTLKHDATAVEVDPNEVHTFHATCPSCSHQCDTHMKLLDIPHFKEVIIMSTVCDRCGYRSNEVKTGGEIPPKGRKITLKVMDAEDLSRDILKSETASLKIPELGLDLFPGTLGGRFTTIEGLLAQVYDELYGRVFSQETDSMTPEQVANWQQFLCNLTAAREGATQFTLILDDPLSQSYLQNYYAPDPDPNMTIEEYERSFQVNEELGLNDMKTENYEKDGGKK

SEQ ID NO: 4516 - protein, 511 aa, Oryza sativa Japonica Group
MALSTLLLPSSSSSSSKTATATDTSDRRRHHHHHNHTKRKKKPPPPPLSPTPRTPPPAGSGSHRAMAASSKKSTKQVVVAAKTTTGHRPKKAAAAPTTPSRGAPSASAAPVSSSWEQLKSLLSCRSATAAARVHDPAAPSSALSRLRSHGAGACGASLCAIRDVVDAASSASAASTAAASLDRDTTPLTRSSRRAHRAATSSSGGGGGHHASLRGLSGCYECRAINVEPMSRRYPRPRELCACSQCGEVFNKADSLEHHQAIRHAVKIGWQKYIKRYLCLAIFCMLAVASASPFVEVSELGPEDSGRNIVEIIFKSSWQKRDRPICQIDRILKVHNAARTVARFEAYRDAVRTRCRATAARAAADGNELLRFHPAALACPLGLNGATSLCDDDDACGVCAAIRHGFAPWAGAHPLGVRTTASSGRAHDCGAAAAAAQQAGGCRAMLVCRVIAGRVRRNDDDGGAEEEEGAFDSVAGDEAASSVYGNLEELFVANPRAILPCFVVIYRVVPE

SEQ ID NO: 4517 - protein, 216 aa, Oryza sativa Japonica Group
CGAFPWDASPSCSNPSVEVSSYVNTTSYVLKEPGSNKRVRSGSCGRPTSKASREKIRRDKMNDRFLELGTTLEPGKPVKSDKAAILSDATRMVIQLRAEAKQLKDTNESLEDKIKELKAEKDELRDEKQKLKVEKETLEQQVKILTATPAYMPHPTLMPAPYPQAPLAPFHHAQGQAAGQKLMMPFVGYPGYPMWQFMPPSEVDTSKDSEACPPVA

SEQ ID NO: 4518 - protein, 92 aa, Malus x domestica
AEDLFSDVWAWRKYGQKPIKGSPHPRSYYRCSSSKGCSARKQVERSCSNPETFIITYTAEHNHVHPTRRNSLAGSTRSKFPSSRNKDKCSSS

SEQ ID NO: 4519 - protein, 840 aa, Oryza sativa Japonica Group
MAAAATAAASPVEGLTGGGGGGGGGVDGLFVELWRACAGPLVTVPAVGERVFYLPQGHIEQVEASTNQVAEQQGAPLYNLPWKIPCKVMNVELKAEPDTDEVYAQLTLLPEKQDGNGSGNGNVSKDKVEEEEVVPPAATERPRVHSFCKTLTASDTSTHGGFSVLRRHADECLPPLDMSQHPPTQELVAKDLHGVEWRFRHIFRGQPRRHLLQSGWSVFVSAKRLVAGDAFIFLRGENGELRVGVRRAMRQQANIPSSVISSHSMHLGVLATAWHAVNTGTMFTVYYKPRTSPSEFVVPRDLYKESLKRNHSIGMRFKMTFEGEEAAEQRFTGTIVGVGDSDPSGWADSKWRSLKVRWDEAASVPRPDRVSPWQIEPANSPSPVNPLPAPRTKRARPNVLASSPDLSAVNKEVASKVMANSQQNGLPRAFHSQENMNLRSRFGDSNELNTSQKLTMWSSGSNQEKNNVSVQRELGSQSWMQMRRPDGSSEILSGFQPLKDTRNPLSSFPSQISGNRSNTWNTINVHYPDQNANHNMYPGTWSLMPPNTGFGVNQQNYLMTPDITLPQRSLNAKFGGNGAFTSLRAHGIDQRSSGWLGHIEPSSHIDDASSSLIKPQPLVIDHNVQKAKGSSCMLFGISLDSPAKPELLISPPSVAFDGKLQQDALEEDECSDPSKTVKPLDGAQHDSAREKHQSCPDGTKNIQSKQQNGSSRSCKKVHKQGIALGRSIDLTKFTCYDELIAELDQMFDFNGELNSSSKNWMVVYTDNEGDMMLVGDDPWNEFCNMVHKIFIYTREEVQKMNPGALNSRSEDSRSTSVERGLVGEGLQGGLSTPSLNSENC

SEQ ID NO: 4520 - protein, 501 aa, Glycine max
  misc_feature (232)..(232): Xaa can be any naturally occurring amino acid
  misc_feature (353)..(353): Xaa can be any naturally occurring amino acid
MEARSAFSIDRSNAKQLNNMGMSEAFPSSLPALPSPLEETYPKLSDSKPVFMEKELKTKPYTHSSHLTSSGAVGHMFSSSPGYSTDLHHSSFSSHEKQPRNTHFISQSLSNITSFPLSYSSNTGPPTSATPSHYSKESSVSWHTDSLPSFLDFPENGSIDNNRVESSACPIMASEEYSKQNDWQEWAERLISDDDTLTTNWNDLLADNIQDLEPKVPFQVSKPLSQIPGHQXEPIEPQLPASSGENRIGVAPTSSTNSAPAKPRMRWTPELHEAFVEAVNQLGGSERATPKGVLKLMKVDGLTIYHVKSHLQKYRTARYRPESSEGAAEKKLSPIEEMSSLDLKTNYPNLITXLEKRTDRWTKSGIEITEVLRLQMEVQKRLHEQLEIQRNLQLRIEEQGRCLQMMFEKQCKPGNETFKAPSSIIETPSGGSSNATKDSLAKNEMEASQVNHGRSGPDQVKGSTTFEEGSLEKCGKPDSPKTEHAIASEDSAQAPKRQRTE

SEQ ID NO: 4521 - protein, 549 aa, Malus x domestica
MWDLNDSPDQRPRGEESEGCSSQKTSADGDEEKRKRVGSVSNSSSSAVVIEEDGSDQEEDQDDGPTKLAKKQGGGGGKIFGFSVAHEESMDSDPPATVTRQFFPVELDYSSSSNLDVMGPAEGGGSIPPPPSTSSSFPRAHWVGVNFGQSDSGSPGNPPPAGEASHQPMKKSRRGPRSRNSQYRGVTFYRRTGRWESHIWDCGKQVYLGGFDTAHAAARAYDRAAIEFRGVEADINFSIEDYEEDLKQMRNLTKEEFVHVLRRQSTGFPRGSSKYRGVTLHKCGRWEARMGQFLGKTYVYLGLFDTEVDAARAYDKAAIKCNGKEAVTNFDPSIYDNELNSSESSGVIAADHNLDLSLGSTNSKKNNQALGNDHHSQNVAMEHQHSVSMQLDANWRSQGLRPKLNIQRDRSRDDIDAQRRDGYSESEAMQLLLRTNLQSQAPAEVHKYGQFNRRLTAGDIQMSHNFPPNFNSPNYHHIQFPSSSEGGGRIGSDLSLSTSDHQQQWQSATPTSNLFATAAASSGFPPQLRPLPTQNSWLQKNGFHTLARR

SEQ ID NO: 4522 - protein, 455 aa, Candida albicans SC5314
MSNRGRQPSGPPPSRKRETKWSGKPKRYANFGAQSFDTVITGHLTQEQLDAYQRYFRIEEISNFLSVAKQQHKSIVDVLPSAKVDETDHYKRDPSPPPKYDKNGNRTNTRERRVTEALEKERHELVELAASSIKNYMIPSNYRRPSRTVERLYVPVKDYPDINFVGFLIGPRGNTLKKLQEDSGARLQIRGKGSVKEGKSSDGFGSSQTGTDIQDDLHVLITADSPLKISKAVKLVNEIIDKLIFSPQGMNFMKRDQLKELAVLNGTLRETKPFDPEAHEKKQQQQMDITKIVCKICGNIGHIARDCKQNNGKRPLDDNAENEPTTINKKARTDVPPPPPPPPPPAPPSSSTEISKQVPPPPPPPPPPAPSAAASGFATTENYKQGLVPPPPPPPPPPPPPVRSALVNFENNSKVLLTKEKEESGSSELKNTGESSSSSSGVPPSPPPPSSNVPR

SEQ ID NO: 4523 - protein, 162 aa, Solanum tuberosum
  misc_feature (86)..(86): Xaa can be any naturally occurring amino acid
  misc_feature (160)..(160): Xaa can be any naturally occurring amino acid
IMERLLERYERYSYAERQLNATDIETPGSWTLEHAKLKARLEVLQRNQKHYAGEELDTLSMKELQNLEHQLDSALKHIRSRKTQLXHESHFCDAKEEALQEQNNNLSKQVKEREKEMAQQTPWEQQSHDHLNSSNSFVLPHPFNNLHIGSIPNCRRQRTXEG

SEQ ID NO: 4524 - protein, 367 aa, Arabidopsis thaliana
MEDPSNSQPNQSNLSQCPPLATAPTPAPVRGPYHRRAHSEVQFRLPEDLDLSEPFGGFDELGSEDDLFCSYMDIEKLGSGSGSASDSAGPSAPRSDNPFSAENGGAEAGNSRPRHRHSLSVDGSSTLESIEAKKAMAPDKLAELWVVDPKRAKRIIANRQSAARSKERKARYILELERKVQTLQTEATTLSAQLSLFQRDTTGLSSENTELKLRLQVMEQQAKLRDALNEQLKKEVERLKFATGEVSPADAYNLGMAHMQYQQQPQQSFFQHHHQQQTDAQNLQQMTHQFHLFQPNNNQNQSSRTNPPTAHQLMHHATSNAPAQSHSYSEAMHEDHLGRLQGLDISSCGRGSNFGRSDTVSESSSTM

SEQ ID NO: 4525 - protein, 237 aa, Vitis vinifera
MSAMVSALSQVIGTRDNNPSATRMVQSADSSSALSESSQLPPQDQGNVRRRHYRGVRQRPWGKWAAEIRDPKKAARVWLGTFDTAEDAALAYDQAALRFKGTKAKLNFPERVQQQTSQIGYFMDHAGMFDDQSHRPPAMPAPPPPLPPPSLPHEFLQYGQLLSSSSDADFAYFSSNLYNQPQQQPPYFPQPSSTTTTTTSSSSTTTSDQYYSSQSSSSFYYPHYGEDFNTSYHPPSE

SEQ ID NO: 4526 - protein, 292 aa, Thinopyrum intermedium
MLLNPASEALVLDSIRQHLMEETAAVAAPAEARRQRPAYCRSTSFGSLVADQWSESLPFRADDSDDMVVYGALRDAFSCGWLPDGSFAAVKPEPLPSPDSYACDGPSCFGFLEPETPPATPPGEGEEATAFMGEAAAAVARGKHYRGVRQRPWGKFAAEIRDPAKNGARVWLGTYDTAEDAAVAYDRAAYRMRGSRALLNFPLRIGSEIAAAKAAAAAAGDKRPSPEPATSDSSSSSSGSPKRRKRGEAAAASMAMALVPPPSQLSRPAQAWYPAAPVEQVAMAPHVQQLVS

SEQ ID NO: 4527 - protein, 501 aa, Oryza sativa Japonica Group
MASSGEEGRVVVDLRSAAESAGGGGGDEEAHAAPLHEIESLCMRCGDNGTTRLLMTMIPHFREVVLMAFECPHCGERNNEVQFAGQLQPKGCCYRLEVPRGQNEILNRQVVKSDSATIKIPELDFEIPPEAQRGSLSTVEGIIMRAVDELQALQDERKKVDPQKAEAIDKFLAKLRSLGLGEAAFTFVLDDPAGNSFIENQNAPSSDPLLSVRFYERMREQQAALGFLVEPSTEEPGDQPVNHASTVEGNSEVLQEPHGSVGAVAGRRAIAQGNPDEVAAALCRYSAPEEVDTLPSTCGACGTECVTRFFATKIPYFREVIVMATTCDMCGYRNSELKPGGEIPAKGKKITLRVQNGKDLTRDVIKSDSAGVKVPELELELASGTLGGIVTTVEGLIVKICEALQRVHGFHLGDSTLEWKKKKWEDFNDRLSKLLSLQEPWTLIIDDGLAASFVAPATDSLEDDNQLTIEEYVRSWEQNEELGLNDMDTSSADAAYNTTNP

SEQ ID NO: 4528 - protein, 192 aa, Triticum aestivum
  misc_feature (83)..(83): Xaa can be any naturally occurring amino acid
  misc_feature (93)..(93): Xaa can be any naturally occurring amino acid
  misc_feature (100)..(100): Xaa can be any naturally occurring amino acid
CYVNDAKMQGFFHACTETHLEKGQGIAGRALKSNLPFFSPNIREYGIKDYPLAHHARKFGLHAAVAIRLRSTYTGDDDYILEXFLPINCTGSXEQQMLLXNTCPLLSKRICKSLRTFPEAKVDKLTLVLHNNHGIASYGHGILTWPAQKRINFNNKGHSNRTSNHCGENHREMEGVNTFGAKVLKTCLNVPK

SEQ ID NO: 4529 - protein, 378 aa, Arabidopsis thaliana
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEDDTKIRQENSPMFFHLKNLITIKVINNTFSTFQIIYNSTSVCYDVYLGL

SEQ ID NO: 4530 - protein, 326 aa, Arabidopsis thaliana
MYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKKQVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 4531 - protein, 70 aa, Picea abies
ERVERHELFGKWRSRLTMAGFKSYPLSAHVNSTIKVVLNSYNQNYRLVEKDEALYLGWLDRDLIVASAWK

SEQ ID NO: 4532 - protein, 540 aa, Oryza sativa Japonica Group
MSARPPPPPRPRLALPPRSAAESLFTGAGDASPGPLTLASALFPSDPDGGGGGGGVMTSSSSSAAGATSFTQLLIGNLSAPPPPPPPPQQQQQREAARGGGVARAGPALSVAPPPTAGSVFTVPPGLSPSGLLDSPGLLFSPAMFDAFDVLDMFIPDKILPKRATRIKLDIYFVKTSPEGGFGMSHREALAQVTAQASHSPLRMFDHTEQPSFSAAPTSSEAMQHMNAAVNMTGISDMVMGPTNNENVAFQPAEASQRYQVNAPVDKPADDGYNWRKYGQKVVKGSDCPRSYYKCTHPNCPVKKKVEHAEDGQISEIIYKGKHNHQRPPNKRAKDGSSSAADQNEQSNDTVSGLSGIKRDQEAIYGMSEQLSGLSEGDDMDDGESRPHEADDKESDSKKRNIQISSQRTSAEAKIIVQTTSEVDLLDDGYRWRKYGQKVVKGNPHPRSYYKCTYAGCNVRKHIERASSDPKAVITTYEGKHNHEPPVGRGNNQNAGNAAPSSSAQQNMQNLSSNQASLTMADFNNINQRPIGVLQFKSEE

SEQ ID NO: 4533 - protein, 281 aa, Zea mays
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEEVVNAELRLEEPLLWE

SEQ ID NO: 4534 - protein, 201 aa, Methanopyrus kandleri AV19
MKYKMELSDLECPVCGEKALMVHGRVDEIPHFGRVLEQFIHCKACGYRHSDVMCLEDREPAEYRYRVNSPEDLRVRVVRSPSGFVEIPELGIEVKPGPAAQGFVSNIEGLLRRIRERVETAAKWADKEESKKRAEEILRRMDAAVSGEDEITIVLKDPYGHSAIVPEEDDKLEVRELDEEEAEELRSRIFRPLVPSGEYSN

SEQ ID NO: 4535 - protein, 89 aa, Physcomitrella patens subsp. patens
EETPSASPKYRGVRMRQWGKWVSEIREPNKRSRIWLGSFPTAEMAARAYDAAVVCLRGPHAALNFPDSPPQSLPECHSPKDIQVAAAAA

SEQ ID NO: 4536 - protein, 724 aa, Cryptococcus neoformans var. neoformans JEC21
MDNHQHLQQHPPPPVFSMTIAMPGPAPPRSSPPADGSDAHQAADSNQGPAQESTIYWTFHIGPGSVRSPNDNQSSNEHPAVPGPNGRSGEPRGPAEGGGDANNNAPPPWLFPPFFQFLMPRREPQPNPEKAAELLRSLPTVGKRLLNRVNNVVAAQDIDSYEDDDDKGWKCGICLEGIHKEKLEKGEGKAVGDGKTEGEKEDKGTGVKALPCNHLFHGDCLEPWFTTHHTCPTCRLDLDPLQTLNSPLRPGPARNNSFRPARTGAGRSTSNAHPYSRDQSRDQSRNGERDQNDTAGDQVSADASGSGDNSRSNTPQERGQRSSLTPHLFIFAGPNHPREPQQEHSPEAANDAAAVPHDPTSQPAEPPSANVPTGGEAPTTPGGNSRPSASHRPFFDPAEILGAIFGGPPSASPLPMHRHSSPFPSSPGENATQSSNVPLSGNTGSTPTSQSGGSEPQDASSVESQPASEQSAQPPPSDRPQPERRAHIQIIQEALEQLPFIFNNHPIVPPLPTAFPFPGMVPVGERPSTPNAVDHTTDGSTAGAPSNGDTATAADEALGAGQAQSQTSAKQPFVPQSLESWTEEKEKSLGWRCDAPECVYGPSTSEEDDDSDGYPPTTDELEEDQKNKEMVSIFSAVQPPLSSAEAKEAHENDHDFTLLACTHRWHRGCLEIAERSAGRMSKDDGEGRIWVRCERCRKDGWIPPVAESTGSGVGRKRKEAEMTV

SEQ ID NO: 4537 - protein, 315 aa, Glycine max
GSLVKISSRIPKKKRCKLEPGEGESCKRCNCKKSKCLKLYCECFAAGVYCIEPCACHDCFNKPIHVETVLQTRQQIESRNPLAFAPKVIRNSDSVPEIGDDPNKTPASARHKRGCNCKKSSCLKKYCECYQGGVGCSISCRCEGCKNAFGRKDGSAPVGIETDPEETEASDKGMVEKTLQKTEIQNTENHPDSATVSTPLRLSRPLLPLPFSSKGKPPRSFVTTISGSALFANQKLGKPNPLWSQAKHFQTVPDEEMPDILQGDSSPITCIKTSSPNGKRISSPNCDLGLSPSRRGGRKLILQSIPSFPSLTPHP

SEQ ID NO: 4538 - protein, 614 aa, Glycine max
MMMFEDMGFCGDLDMLCVSLGEGDIAVRQTEPDPVVEDDYSDEEIDVDELEKRMWRDKMRHKRLKEQTKSKEGTDATKQRQSQEQARRKKMSRAQDGILKYMLKMMEVCKAQGFVYGIIPEKGKPVTGASDNLREWWKDKVRFDRNGPAAIVKYQADNAIPGKNDGCNSIGPTPHTLQELQDTTLGSLLSALMQHCDPPQRRFPLEKGVPPPWWPTGNEEWWPQIGLPKDQSPPPYKKPHDLKKAWKVGVLTAVIKHMSPDIAKIRKLVRQSKCLQDKMTAKESATWLAIINQEEALARELYPDYCPPFSSAGGNGSLVINDCSEYDVDGAEEELNFDVEDRKPDHLLPSNLGMERMRGRMPIQQPSHPMKGDVVTNLDFIRKRKISSDFNMMMDQKIYTCEHPQCPYSEVRLGFHDRSARDNHQLNCAYRNSSADYGGGPNFHATEDKPVIFPQSFVQPNTTTQSASLVAPSFDLTGLGVPEDGQKMISDLMTIYDTNVVGNKNLSSSNCVAVENHNLSQASLQQQESYFPGQGMVLEGNFFAREEGQFDRFKATMNMNTHTPFDTNHSNNNNIHLMFNSPCDLSSFDFKEDIQGGVGMDPLHKQQEVSIWYQ

SEQ ID NO: 4539 - protein, 368 aa, Zea mays
MVVKEFGREVVMSMDKVKRGGEALMAAGAGAGDEEKDDAVLPGFRFHPTDEELVTFYLRRKVARKPLSMEIIKEMDIYKHDPWDLPKASTAAGGEKEWYFFCLRGRKYRNSIRPNRVTGSGFWKATGIDRHIYPATANPVESVSVGLKKSLVYYRGSAGKGTKTDWMMHEFRLPPAAASPSPTPTSMQEAEVWTICRIFKRNIAYKRQPQLPAWRQQQQSSSNTGSFESDGGGGGDEYMNRCLPVPATATATAHQIGGMLNGGGVVSATGSSSSSFFRDRESVHGGQQFHFHEQWLSRFPAAPAVEQKPQLLDPSAMAIAFHQNDDQSVATAAAAAASECCKDGYYWDEIARFMEVNDPTVLHDCRYA

SEQ ID NO: 4540 - protein, 76 aa, Chlamydomonas reinhardtii
LQGCGLPLADAKLYLRRYSVCEAHFKAEYVLLSGGRYRFCQQCNKFQPLDNFNGSRRSCKARSEDRNLRRRKQRTD

SEQ ID NO: 4541 - protein, 299 aa, Arabidopsis thaliana
MMKKGTKRKIEIKKRETKEQRAVTCSKRRQTVFSKAADLCLISGANIAVFVTSPSDSSDVVYSFSGYSSAYEIADCYLNRKPPPKIVNPAGSKLGFWWEDPDLYHSCDDLSELSIIEDRLQRMKKHVMACLEKEEKSQLVSSFDQNPNSTCSLDVEDCDGSSYSQIASTFTPNSVNEYCSDQTFSSFHGDQNPNLSSPSFDQDCYSSLYQICGESSSQVASFDQNPSSEIQGFETEEEINQINLLLQETQTEANVNLDDEICFWNDLSNDDVFGLNSYFGLDNTNAMINFGDSDFRRHV

SEQ ID NO: 4542 - protein, 387 aa, Arabidopsis thaliana
MTRRCSHCSNNGHNSRTCPTRGGGTCGGSGGGGGGGGGGGSGSSSAMKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 4543 - protein, 641 aa, Oryza sativa Japonica Group
MTDGHLFNNILLGGRAGSNPGQFKVYSGGLAWKRQGGGKTIEIEKSDLTSVTWMKVPRAYQLGVRTKDGLFYKFIGFREQDVSSLTNFMQKNMGLSPDEKQLSVSGQNWGGIDINGNMLTFMVGSKQAFEVSLADVSQTQMQGKTDVLLEFHVDDTTGGNEKDSLMDLSFHVPTSNTQFLGDENRTAAQVLWETIMGVADVDSSEEAVVTFEGIAILTPRGRYSVELHLSFLRLQGQANDFKIQYSSIVRLFLLPKSNNPHTFVVVTLDPPIRKGQTLYPHIVIQFETEAVVERNLALTKEVLAEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRSEYHNLFNFINGKHLKIMNLGDGQGATGGVTAVLRDTDDDAVDPHLERIKNQAGDEESDEEDEDFVADKDDSGSPTDDSGGEDSDASESGGEKEKLSKKEASSSKPPVKRKPKGRDEEGSDKRKPKKKKDPNAPKRAMTPFMYFSMAERGNMKNNNPDLPTTEIAKKLGEMWQKMTGEEKQPYIQQSQVDKKRYEKESAVYRGAAAMDVDSGSGGNESD

SEQ ID NO: 4544 - protein, 438 aa, Pinus radiata
MVLENFGGVGAREASCRIRHELRGIGGWRMSMPKLCDVCQVSSSVIYCRAHTAQLCLVCDAKIHGGSKASLCHERVWVCEVCEQAPAVVTCKADAAALCVACDTDIHSANPLASRHERAPVIPFYECPNMPTNNTVTHANNDNLDCNVLLNEDGGGDDPLKHDYVDDDYGDYDDDENDQNNLLNNQEDNNDAEICCAEEAATASWLIPEANRNNLTIINGGNSEGEDKMVKDKLKFKAYMQSMDFLQDVDNYADLEYLGTTTITTPINPTANMGADSMVPVHTPEVIEHSSTKVSIDTAGSMDVDAASKCNHVYRTTSLNHCVSSSPIDVGIVPDSNITSDISTPYHDPRGVFEIPPRVVHPGGQGEVMGREARVLRYREKRKNRRFEKTIRYASRKAYAETRPRIKGRFAKRTEVEVEQIYSSSLLPDQGYGVVPSY

SEQ ID NO: 4545 - protein, 247 aa, Brassica napus
IVREVNFPPLQPPRVEPCVCSSQDRTKTTSKKIVSASASPALRPKKRVGVRQRKWGKWAAEIRHPITKIRTWLGTFDTEEAAYQAYIEKRREYDALVGITNDSVSETSQCSRSSPLEQDTSASALTCVKPNEEEEVKIPTTDVDSGKEVLFDFNFADLPIPDFGFFEEPMGPAGVDEQDLDFDCFFTDDQLDDFGLLDDINGFGDCGPSALPDFDFADLGLELPGSGFLGDQNVPQHITCTRKSFAT

SEQ ID NO: 4546 - protein, 458 aa, Zea mays
MASLIAGRVVALHRSLPPPVEGTVADIIVISSRPVLLNTPKYHLLGKKSEESEIQSTRRRIWNAPARRTYEAHASAHVPEPSPRAGAPPERMTRRCSHCSNNGHNSRTCPVRSAGGGSGGGGVRLFGVRLTTAPAPAVMKKSASMSCIVSSLGGGFGGSSPPVEGVGAGRGGEDSGTGYVSDDPAHASCSTNGRAERKKGTPWTEEEHRMFLMGLQKLGKGDWRGISRNFVVSRTPTQVASHAQKYFVRQTNSSRRKRRSSLFDMVPEMPMDESPAAVEQFTLQNTQDEDTSSNHVPTLHLGQRKETEFAKQLQTFQPGHHEKSEYAEPSLLLPDLEMNPSVPFKTITDPTGPAFYPSLVPVPLTLWPPSVSHVEEAARTHEILKPTPLNGKGVVKADDVVGMSKLSIDEASSGSMEPTALSLELIGSTDTRQSAFHVSPPMNRPELSKRNSSPIHAV

SEQ ID NO: 4547 - protein, 216 aa, Brassica napus
PRVRSQKHLGNTLPFLPDPSTNSQPPSAVESARSPSIFSEDMSNPFDGDNTLVKDFFNLSGDACSDGAFHDLDCSNDSYCLSDQMELQFLSDELELAITDRSETPRLDEIYETPLASSSNPVTGLSQTQRSLSGAMTIEAVSSHPSPGSAAASNLKPRMRWTPELHESFLKSVDKLEGPEKATPKAVLKLMNGEGLTIYHGKSHLQKYRLAKHIPK

SEQ ID NO: 4548 - protein, 315 aa, Medicago truncatula
MALEPTLLYPQDPFTYGFNKDHYNYNLLTDSEANFDYTNFNLQNEEQGFVSTFLKNQQTENYPYENWSNNCPSLDSSISTRSRSKKRRVKTSKNKEEIENQRMTHIAVERNRRKQMNEYLSVLRSLMPESYVQRGDQASIIGGAINFVKKLEQKLQFLGVQKQKEGKFDTIVENKNKPFSEFFTFPQYSTSDGVCESSETKMGGEVQSRNIADIEVTMVESHANLKIRTKKRPKQLLKMVSSLHGLCLTILHLNVTTADEFVFYSLSVKVEDDCKLGSVDEIAAAIYQILEKFEKLQVIEGVYKNFVIKFVILSS

SEQ ID NO: 4549 - protein, 783 aa, Cryptococcus neoformans var. neoformans JEC21
MTTNLYAIAGPSKPTTPTSTPSPRSEPPSPLKSLTSLPTNPLNSHGTSTPNTLTNQLSSTGIGISKPGLSVDENGEVMKVPAFLNKLYTMVSDPEVDDLIYWGESGDSFFVPNAELFGRELLPRWFKHSNFSSFVRQLNMYGFHKVPHLQSGALKNETPIELWEFANPYFKRGQPQLLTKVTRKNNRPSNSGVGPSSSVGGSGAGGGMSTRSASAAAASGSASGQIQQAISQGHEAGNHSTSGKYLITDGTTPGSVPPSHTSAGPLIAPQTLDLSAINSGIAAIRQTQASIATDLRKLQASNEALWRQAYETQEKQRKHEETIDLIVSFLERLFGTEGEGLKGLKEAMRRGVGVRRDRDGREGRDSRDSRFAEDDDGGQKKRRRVGIDRMIEGGTGDGTGEHGEIESPTSDDRLVEIGSNSEYSIPSVKRTSSSSHPISLGQLGSSRFTALPSEDPSPSASGPGSTSYEGLHTTQTNARGAGADVNVTDPTLGMNHLSPLSDTDPLLPSSSNALAPYSSHLPFPSSNSNQSNSFNPSNPSSAWASNPSQPLLSPTSAAAAAHAYNLDPSLLQTTIGSLLQSPAAAQMFLNSLSASAQGQALASHSHPHNPSPLNPNPNGNASTSASASAHGMNTGGMGTGSGTKDVDPTLALFSPLPSHSSLTSQSNDLLKSYSDALTVGEGVDNLQESIDSLVRSMGLDLPNGGSSVGVDVGDGAGVGTETGEGDGEFNVDEFLQGLAKEGEEEGEREVEGDGGVSSSGAGAGAENGRKEDVIAQSGLKSES

SEQ ID NO: 4550 - protein, 467 aa, Triticum aestivum
LGLINQCLRNLKVAGNGESNEASLQLSNVIMIESEDFKTNVHFENSEGFRESPEGDTHGGAHEFDKANSKVSEGHLLADDNSQNNGVSVSRPNGSAASDSSLLHKNGKPPERRRGKAETTISLEVLQQYFSGSLKNAAKSLGVCPTTMKRICRQHGISRWPSRKINKVNRSLSKLKQVIESVQGSDAAFNLTSITGPLPTIPVGPSSDSFNKEKASESKAEHSNRAVDGDRDSSLQKSQETGSHFGALMSQQGFADTGNNVQLEADKASLSRSSSGEGSINSRTSEGSCQGSPANQTFVCQPIASMFLEPQEPQLNPEGFTKEPFQEPELPLSRMLIEDSGSSKDLKNLFGSAIGQPMLAPPSNFGPMRNSGTVTIKASFKEDIVRFRFPCSSSVMALKDEVAKRLRMDAGMFDIKYLDDDHEWVKLACNADLEECIEISRHSGTHVIRLLVSDVAAHIGSSCGSSG

SEQ ID NO: 4551 - protein, 226 aa, Physcomitrella patens subsp. patens
KRKRNLPGTPDPEAEVIALSPKTLMATNRFVCEICNKGFQRDQNLQLHRRGHNLPWKLRQRTSKEIRKRVYICPEPSCVHHDPSRALGDLTGIKKHFCRKHGEKKWKCDKCSKRYAVQSDWKAHSKTCGTREYRCDCGTLFSRRDSFITHRAFCDALAEESARVSAGKQGGEQPNGLMGPRSSSLSVVVSPLFNAQQQQQQQQHHNSSAQMSATALLQKAAQMGAT

SEQ ID NO: 4552 - protein, 859 aa, Arabidopsis thaliana
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 4553 - protein, 301 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDSAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGEGRRGEFMTVVQEMIKAEVRSYMAEMQKTSGGFVVGGLYESGGNGGFRDCGVITPKVE

SEQ ID NO: 4554 - protein, 259 aa, Picea sitchensis
MFEVITGSLRDLKMAKTMKECELCELSARLYCESDEASLCWDCDAKVHSANFLVARHCRSLLCQICQSVTAWRASGAKPGLTVSVCERCAGGSRAKSDGDDDEGNNDENQVVPLASGYSGPPLSCSSADQEESSGDERHCAESPLSIAPPDAASHKRPHESLALNTYEGDCGCSSSGVNNSNNNISGCEDDATSSRIRVLKKTKADQGLKDDLVKTLEVIRREDHDNSTVLAICKLCRDSHTRELVSVDCPSNSSRYAG

SEQ ID NO: 4555 - protein, 356 aa, Populus tomentosa
MFHTKKPSTMNSHDRPMCVQGDSGLVLTTDPKPRLRWTVELHERFVDAVTQLGGPDKATPKTIMRVMGVKGLTLYHLKSHLQKFRLGKQPLKDFSDHSIKDASALDLQRSAASSSGMMSRSMNEMQMEVQRRLHEQLEVQRHLQLRTEAQGKYIQSLLEKACQTLAGDQNLASGSYKGLGNQGIPGMGAMKEFGSLNFPAFQDLNIYGGDQLDLQHNMDRPSLDGFMANNDNICLGKKRPSPYDGSGKSPLIWPDDLRLQDLGSGPACLEPQDDPFKGDQIQMAPPSMDRGTDLDSISDMYEMKPALQGDGLDEKKFEASAKLKRPSPRRSPLAAERMSPMINTGAMPQGRNSPFG

SEQ ID NO: 4556 - protein, 752 aa, Chlamydomonas reinhardtii
MDKAERAAGGPNAASEDDWLLEFWPEPAADFPAPVAPMLSQHQDAAQLPEAMPQQQGLALGGYGLTQQPSDFMQTGMPGFDAFSSGKAATLGLPLLADPQRASTDGASALMNAAQQSSEYMLAPGMGGMPHLLAPSVGTALPGTGHTGFADLSMGGMAGGIPGLGGPGIMHGQYFMQPQRAATGPAKSRLRWTPELHNRFVNAVNSLGGPDKATPKGILKLMGVDGLTIYHIKSHLQKYRLNIRLPGESGLAGDSADGSDGERSDGEGGVRRATSLERADTMSGMAGGAAAALGRAGGTPGGALISPGLAGGTSSTGGMAAGGGGGGGLVTEPSISRGTVLNAAGAVATAAPAAAAPAGGSAAVKRPAGTSLSSGSTASATRRNLEEALLFQMELQKKLHEQLETQRQLQLSLEAHGRYIASLMEQEGLTSRLPELSGGAPAAAPVAAGGAAGGMIAPPPPQQQLQHQPQLLQPQGSLPAGGSSEAHAAAGAGTMVVHQQQQQHVHHHHQQQQVQMQQHARHCDTCGAGGAGGAPSGGSSMQQLQAAEQQRTELVVAGRLGSMPAPASSSPLAGQAHQQQPLAGGAAHLVHVHSHTPGGQPHVQHQDAFAGAATAAAHASPGLPQSHSHLLPADLSSNAGPDTSAGQIKPEPDMSQQQQQQEQQEAEQLAQGLLNDSSAGAGAVSGSDGGGLGDFDFGDFGDLDGGAQGGLLGPGDLIGIAELEAAAAHEQQQEQEHDPLDADRAKRQRVEP

SEQ ID NO: 4557 - protein, 199 aa, Oryza sativa Japonica Group
MRRGGAAEEDAEAARFRGVRKRPWGRYAAEIRDPAKKARVWLGTYDSAEDAARAYDAAARALRGAKAKTNFPLSLPHAQPQLHHHHHHHLTYPAAAVVAARPATSSLSSTVESFGTRPRPVLPPRPPPPPPIPDGDCRSDCGSSASVVDDDCADAAASPSCRLPFQFDLNLPPGGGGGGGGGFGCAYDDEELRLTALRL

SEQ ID NO: 4558 - protein, 238 aa, Picea glauca
MEHLNTAAAQASSSLYGAGMAEYGDAGVSSMMALITQHEPHDCESIMSTRMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDGNSPHFNVDNEEYAIKSKILAHPQYPSLLGAYIDCQKIGAPPEAVARLDALTREYQNQQRRTVSIGMDPELDQFMEAYCE

SEQ ID NO: 4559 - protein, 224 aa, Vitis vinifera
  misc_feature (7)..(7): Xaa can be any naturally occurring amino acid
  misc_feature (71)..(71): Xaa can be any naturally occurring amino acid
MEKDGSXLLSPISDGEHGDSAGTSVEKKLRLFGFELDPYKKGESCLKESVERDESVNSSNTDSSGREKPSXEKNSTVEPEDKKFECQYCFKEFANSQALGGHQNAHKKERMKKKRLQLQARKASINHYLQPLQNNHSFTYHGSALWFYDPSCQSPDDESQISFTPFDQDAHLKKSQFSKWYAPPANLPLQQDTCMFTLTHPEWIRTEQACHHQAFPLARFKAKL

SEQ ID NO: 4560 - protein, 129 aa, Brassica napus
MVRMKQVKISVKKDVDSYTIRGTNKVVHVGDCVLMRASDSDKQPYVARVEKMEADGRGSVRVQVRWYYRPEESKGGRRQFHGAKELFLSDHFDLQSAHTIEGKCVVHSFKNYTKLDNVGPEDYFSRFEY

SEQ ID NO: 4561 - protein, 227 aa, Brassica napus
KHSFILLTKKNLNPPSFLQFLDQNADGRSLEAQSFAFKEEEEEESMQNTVPFLQMLQSEEDPLPFTSFKELLSLRNLHNHWELDSYLSHNETYPVSTTSMEVTRQALSSQELPFSRQQDMTVPSSSSTPNSRRKRKIISNNPPEVTRGKRRKTKPSKDIEEIENQRINHIAVERNRRRQMNEHISSLRSLLPPSYIQRGDQASIVGGAINYAKVLEQVIKSLELQKR

SEQ ID NO: 4562 - protein, 342 aa, Oryza sativa Japonica Group
MGRSPCCEKEAGLKKGPWTPEEDQKLLAYIEQHGHGCWRSLPTKAGLRRCGKSCRLRWTNYLRPDIKRGKFTLQEEQTIIQLHALLGNRWSAIATHLPKRTDNEIKNYWNTHLKKRLARMGIDPVTHKPRVDADADVAAGGGAAGGGARSRAAAHLSHTAQWESARLEAEARLAREAKLRALASPPPATAALSGVDSPTSTLSFSESALFGAGSAAPDIHGAARAAAVQAVQSSYGEACQEHHFGGATAETSFAGAGTLAGVLLDCSVTGADQRFAERTEACSGELQGEDDDDKGYWNSILNMVNSSMSSSSSSLTSEVVTDTEMFLPATAAAAASATPVEF

SEQ ID NO: 4563 - protein, 552 aa, Oryza sativa Japonica Group
MEEELCGNNWDLDAVVRLGCCRRRISPAAVAQQVDPFASFLQQGVAMEVAAEKEVGVEAAWSFPELTVRDGGGGGLGRDADELLKAFCAAFPSSSSSKSSPLPTPPPPPPTQPQPEQQKPVTVQENLPAPTTAPARASQPAAARQVPAGGVPRSKRRKNQQKKVVRHVPADGVSADVWAWRKYGQKPIKGSPYPRGYYRCSSSKGCPARKQVERSRSDPNTFILTYTGEHNHSAPTHRNSLAGTTRNKLPSSSAASAASAQPQPPPPSVVVVGAGGGGAEAAGLSPTTPLRTPSMEEDEEEEEEEELLVEDMEMAGEDELLFLNGGDDNAALDGTPIRGALPFLALPFSVQQPNLSACSSLGMFDWDLNSHHSSLFLHPQLLMVGDDGGIADVASLGDGNAITTEDDGGGADPVRGDGGGGGCSDAVRGGGSGSNVARGGGGCAVAASGGNDCTVVAYVGVGGVSLGGWIWDPSSSLSPGSGIHAGCAIRVELKLLRFNGELRGEVWLSPFLWRRPKGINGSSSGLHAKGDPRLQLSWLCRCSLSIRAFCTV

SEQ ID NO: 4564 - protein, 164 aa, Oryza rufipogon
MEELEGHRGEGRLPPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPTPEDPELDQFMEDYCKLLVECKEELSRPLQEAEEFL

SEQ ID NO: 4565 - protein, 578 aa, Vitis vinifera
MEADSAISAHSAGSCLNQSNDALQSLQSGFTDSNNTTARFFDKKNISVDKKRELDASPALLEQAEDELQGKSAFNVKPVPTDGKQRGGERTSTEVLNVESNLSVDYASEQLYESSTAGGNQDELDCTPHLMPEALQIVRMDENCAQQAGEISNGPVENTASQQTQHQRGMLRRCLQFGEAQLNIITNNPTGSKPSGIGLHLNSIVNAVPMGFSSTTSLKVEEKDYSSAWRISDSIPSNVIENSAGTEDRRNENKASIAMSSATSQSSHGLEPSKDPLLTNDGDGCKRCNCKKSKCLKLYCDCFAAGIYCAEGCACVGCFNRAEYDDRVLETRKQIESRNPLAFAPKIVPPVNGSPINSGEDGRSTPSSARHKRGCNCKKSMCLKKYCECYQVSYVDTTGCKNVYGRKEEYGAFKEMMSRRANDDRLESSFDKKLEMVAARSDFLRPELCNPHNMTPMTPSFQCSDHGNDAANFQIPSRRYAQSPESDFSILSSYGKSPVSPKNSDSHNILPEPGKEIWDMACYEHEFEYGNAEKQAPLSRNGFLLQKFNRMSLLGNLEKWPEVHIAGCSFFPTSHPMH

SEQ ID NO: 4566 - protein, 331 aa, Oryza sativa
MDAFSHVPPGFRFHPTDEELVDYYLRKKVALKKIDLDVIKDIDLYKIEPWDLQEQCKIGNEEQNEWYFFSHKDKKYPTGTRTNRATTAGFWKATGRDKPIYVKNCLVGMRKTLVFYRGRAPNGQKSDWIMHEYRLETNEYGAPQEEGWVVCRVFKKRVAAVQRAAGDGGDSPFWFNEHVAFMAPAPGLDSPYHGHRQSHPCKLEVEYHHHLLPQEAAPFMHLPRLESPKLPAADIIVATAASSALQPCGHTTAQQLQLQIEPVYVTADASAADWRDLDKLVASQFGHGDSTAKEPSYCNPVQLFQFEGKQEDSLDYVSTSASCGGEEDLWK

SEQ ID NO: 4567 - protein, 288 aa, Oryza sativa Japonica Group
MAGAGDWPFAADEAYADSSAIFAELGWANGLAVVDAVGELLPPLDPPGELATPPPPPLDLPETPAGSSADGAASSCSTDDADGGKPAAASTEAASKSLTPGKKRARQPRFAFMTKSEIDHLEDGYRWRKYGQKAVKNSPFPRSYYRCTNSKCTVKKRVERSSDDPSVVITTYEGQHSHHTVTFPRAAATAAGFSHIHAMAALAAAPFSAHQQLYSNLQPPPPTMPLAATTPASSSSLLQLPLHCNHELQVVASCGGYPSSSSSPPASVLPVDKGLLDDMVPRAMRHDG

SEQ ID NO: 4568 - protein, 206 aa, Glycine max
MTRKRIQIKKIDNISSRQVTFSKRRKGLFKKAQELSTLCDADIALIVFSATSKLFEYASSSMHQVIERHDRYSAIHRLDRPSIELQIESDSNNILRKKVEDKTRELRQMNGEDLQGLTLQELQKLEEHLKRSLTNVSKVKDAKFMQEISTFKRKGVELMEENQRLKQVPSLIHAHSYRQSSESILSNSSNLPEDGGSNTSLKLGLP

SEQ ID NO: 4569 - protein, 253 aa, Oryza sativa Japonica Group
MSISVNGQSCVPPGFRFHPTEEELLNYYLRKKVASEQIDLDVIRDVDLNKLEPWDIQERCKIGSGPQNDWYFFSHKDKKYPTGTRTNRATAAGFWKATGRDKAIYNAVHRIGMRKTLVFYKGRAPHGQKSDWIMHEYRLDDPATDTAAATPTVTSAAAAAAAMAAAADGGQEDGWVVCRVFKKKHHHKEAGGGGGKHGGDGSAGAKAAHAYSSSDDALDQILQYMGRSCKQEHELPPPPTTCCSTTTTARTGP

SEQ ID NO: 4570 - protein, 346 aa, Oryza sativa Japonica Group
MDGDAWWYPGGGGGGGSNNWDLGAVVRFGCGGGRVSPAAALLGEAWEYDDDPFSSFLAPPMTAQQAALPAVWEEGDDGDAAWMAPLPGLQTGGGWGDQAPMVVDELCGALVVAPPPPPKQQEVLQVQQQPPPADNTQPTTYQQGSGGDGESTRAGGSRKKQTRKEVVRVAASGPAPDLWAWRKYGQKPIKGSPYPRGYYRCSSNKNCAARKQVERCRFDPSFLLLTYTGAHSGHDVPLHRNSLAGTTRHKPPPPPPLPSAADKSPATAAEAATASQSPGLSPTTPLRASSMELHGEDDAEAELQVEEDDMAIDDEDDDDVADETISTVPWGTPISDAIIAASYEWR

SEQ ID NO: 4571 - protein, 264 aa, Zea mays
  misc_feature (243)..(243): Xaa can be any naturally occurring amino acid
MDADVGAGATNQPWPEPDDAHLSPPPPPPPPPASAPTPAAEAAAPTASAAVSPPAPAEANGNSDRKRRRKADDGDGCKACSCKKSRCLKLYCVCYASGSHCTELCGCEPCHNKPPQGAPWTAPVLPLKPVQTLEAGQEIVEQLIRSPMDLIRRKCTCKKSGCLKKYCDCYQGGAGCSINCKCDDCRNPFGRKVGVILDGKSSGLPAPVHVHERNGTEADSSGDDEEDDDLYMNRQLSPSPVSXESSFQQETLVGVEVQTMKRHL

SEQ ID NO: 4572 - protein, 94 aa, Ashbya gossypii ATCC 10895
MAAAATTKKRTQRKKKDPNAPKRAMSAYMFFANENRDIVRAENPGISFGQVGRVLGEKWKALSDDEKQPYEAKAEADKKRYESEKELYNATKAA

SEQ ID NO: 4573 - protein, 255 aa, Triticum aestivum
  misc_feature (228)..(228): Xaa can be any naturally occurring amino acid
MVRAPCCEKLGLKRGPWTAEEDMTLVAHIEKHGHSNWRALPKQAGLLRCGKSCRLRWINYLRPDIKRGNFTSEEEEAIIQLHAMLGNRWSTIAARLPGRTDNEIKNVWHTHLKKRLESSSKPSGQAAPKRKAKKPAVAGSAIEGPTSEPASSSPGQSLSMSPEQSLSTSSAADYSMASSLENTGSSSSESEEFQIDDSFWSETLAMSVDSSGSGMETGDTFGADSASXPSSSNDEMDFWVTLFMQAGDMQSLSQI

SEQ ID NO: 4574 - protein, 252 aa, Oryza sativa Indica Group
NSEVLQEPHGSVGAVAGRRAIAQGNPDEVAAALCRYSAPEEVDTLPSTCGACGTECVTRFFATKIPYFREVIVMATTCDMCGYRNSELKPGGEIPAKGKKITLRVQNGKDLTRDVIKSDSAGVKVPELELELASGTLGGIVTTVEGLIVKICEALQRVHGFHLGDSTLEWKKKKWEDFNDRLSKLLSLQEPWTLIIDDGLAASFVAPATDSLEDDNQLTIEEYVRSWEQNEELGLNDMDTSSADAAYNTTNP

SEQ ID NO: 4575 - protein, 232 aa, Picea sitchensis
MGRSSCYEKARTNKGTWTKEEDHRLVTHIRLHGEGGWRSLPKAAGLLRCGKSCRLRWINYLRPDLKRGSFTEEEDELIIKLHSVVGNKWSLIAGRLPGRTDNEIKNYWNTHIKRKLLSKGIDPQSHRPLGQPYNSNNIAVSRSLPDHEIPALQNPRTPEIADFFRHDRSESSPIEPAALDAEEHAELNLNLCMSLPSTSAPAANSPSSADRTAVSNSTSGRGLLTPEMVEWR

SEQ ID NO: 4576 - protein, 524 aa, Zea mays
  misc_feature (487)..(487): Xaa can be any naturally occurring amino acid
MSARPPPQPRPRLALPPRSTAESLFTGAGDTSPGPLTLASALFPSDADGGGGPGGASSSAAGAATFTQLLTGSLAPPPPQQQRHDAERGRGGGVARAGPALSVAPPASASAGASVFTVPPGLSPSGLFDSPGLLFSPAMGGFGMSHQQALAQVTAQATHSPLRMFDHLEQPSFSTAATTSGALQHMNSAASMAGISDMTMATANNENPSFQSAEASQRYQVNAPVDKPADDGYNWRKYGQKVVKGSDCPRSYYKCTHPNCPVKKKVEHAEDGQISEIIYKGKHNHQRPPNKRAKDGNSSAFDQNEQSNDTTSGLSGAKRDQDNIYGMSEQAYGLSDGDDMDDGESRPHEVDDADNESKRRNIHISSQRTLSEPKIIVQTTSEVDLLDDGYRWRKYGQKVVKGNPHPRSYYKCTFAGCNVRKHIERCSSDPKAVITTYEGKHNHEPPVGRGGNQNAGMSSQQKGQNNVSSNQASFSRPDLSNANQMPXWDLTVQERAIVTCIWMTFFWQIQDACNSYSHMASKVS

SEQ ID NO: 4577 - protein, 318 aa, Oryza sativa Indica Group
MGAPKQRWTAEEEAALKAGVAKHGTGKWRTILRDPEFTALLRLRSNVDLKDKWRNLSVTAGGYGSRERARVALKGGKRGPKALAEPMDADEKNPDIDDNAIIDAQPLAVVVEPMQLESTPEKEKSVARLDDLILEAIKKLKEPSGSNRTTISSYIEEQYWPPEDFQRLLSTKLKALVATGKLIKVNQKYRIAPSSNSSGGKSIKVYSTGEMNIENNNVRQLSKPQVDAELDKMKSMSKEEAAAFAARAVAEAEAAIAEAEEAARAAEAAEAEADAAKAFLDAVVTTMQNRNHASAIGFQPVKLVKTTLVFCYKAFVDR

SEQ ID NO: 4578 - protein, 167 aa, Zea mays
  misc_feature (156)..(156): Xaa can be any naturally occurring amino acid
MEGCDRIRGPWSPEEDGALRRLVELHGARNWTAIGRGVPGRSGKSCRLRWCNQLSPGVERRPFTAEEDTVIARAHVRIGNRWAAIARLLRGRTDNAVKNHWNCSLKRRLGDLGADGVTEGDLDERPCKRASVTPESTSGSGSGSGSGSDRSDLSHXGAFGLGQVYRP

SEQ ID NO: 4579 - protein, 653 aa, Mycobacterium avium subsp. paratuberculosis K-10
MYDPLGLSIGTTNLVAARNGSPPVSRRCVLTLYPHCAPKIGAPEENPLLAEPGVPMKGFVERIGDSVALVSPDGSAHDPELLTVEALDAMVLAAGADAASSEISIAVPAHWKPGTVQALRDALRTHLGFVRSGMAPRLVSDAIAALTAVKSELGLPDEGVVGLLDFGGSGTSATLVNVAGDFELVSATMRYTALSGDEIDQELQLRAFEELGHGSGLDPASTAGVGQLAALREQCRAAKERLSTDVVTEITAELGGRSCSLTLTQDDLEELMQDRLTGFIYAFDDLLVRYRKSWSDLAAVVTVGGGARIPLVTERLSMHGRTPILTPSQPAFAAAAGALLLASRGGELDMRTRTSIGLLAAADAAGDVVDLGAGDVLVIDDEALTDRELAWSQTEYPGDLRMRFGGETYDEDGPAGWSMRLNVIDPPKPRRPWRRLRFSQLIIGMSAAVAMTAIGGVAYTLTGIENRQAPPAPSVAPLPPVSRVVPPSAVAPPTAVPPPPPPSAQPVPSPAPPPPQPPPPPPSPPPAPPPPVVVTTAPPAPTYTPRHTAPPTAPPALTTTAPTPSPTPTTTPPPPTTTQEPTTTSTTTTVPMTTEWIHVPLLPVPIPVPVPQKQAPATPQYPSNEYPQYPQYPGNEYPQYPGNSQNPYYGPGY

SEQ ID NO: 4580 - protein, 564 aa, Glycine max
LKRLKEQSKPKEGIDAVKQRQSQEQARRKKMSRAQDGILKYMLKMMEVCKAQGFVYGIIPEKGKPVTGASDNLREWWKDKVRFDRNGPAAITKYQADNAIPGKNDGCNPIGPTPHTLQELQDTTLGSLLSALMQHCDPPQRRYPLEKGVPPPWWPNGNEEWWPQIGLPKDQGPPPYKKPHDLKKAWKVGVLTAVIKHMSPDIAKIRKLVRQSKCLQDKMTAKESATWLAIINQEEALARELYPDYCPPLAASSGGSGSMVINDCNEYDVEGGDDEPNFDVEDRKPENLHAPNLGMDRMMGRLPSFPIKGEAVTNLDFIRKRKISGDFNMIMDQKIYTCEQPQCPYSEIHHGFADRNSRDNHRLSCPYRGSASTDYGGSNFHVNEAKPVIFPQQSFVQPKPTTTPSVVNLVPSVIDLTGLGVPEDGKKMITDLMSIYDTNVQSNKNLSSSNHVSAENPNLPQPGIQQQHDNFFRSQGISMEGNFFEEANMSNNNHHMFAREEGQFDRFKALNAPPFETNHNNNNFHLMFGSPCDLASFDFKEDMQGGVVGMDALQKQPDISIWYQ

SEQ ID NO: 4581 - protein, 239 aa, Arabidopsis thaliana
  misc_feature (108)..(108): Xaa can be any naturally occurring amino acid
MMQEEGNRKGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHFXNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSG

SEQ ID NO: 4582 - protein, 406 aa, Hordeum vulgare subsp. vulgare
MGSPDSSSGSAQKPPRHQHQHQPPPPRRQGSAPELPPGFRFHPTDEELVVHYLKKKAAKAPLPVTIIAEVDLYKFDPCELPEKATFGEHEWYFFSPRDRKYPNGARPNRAATSGYWKATGTDKPILASATGCGREKVGVKKALVFYRGKPPRGLKTNWIMHEYRLTGASAGSTTTSRPPPVTGGSRAPASLRLDDWVLCRIYKKTSKAAAAVGDEQRSMECEDSVEDAVTAYPPYATAGMAGAGAHGSNYVQLLHHHDSHEDNFQLDGLLTEHDVGLSAGAASLGHLAAAARATKQFLAPSSSTPFNWLEASTGGSILPQARNFPGFNRSRNVGSMSLSSTADDMAGAVDVSDGGNTVNAMYLPVQDGTYHQHVILGAPLAPEAIAGAATSGFQHHVQISGVNWNP

SEQ ID NO: 4583 - protein, 250 aa, Oryza sativa Japonica Group
MKVQCDVCAAEAASVFCCADEAALCDACDRRVHSANKLAGKHRRFSLLQPLASSSSAQKPPLCDICQEKRGFLFCKEDRAILCRECDVTVHTTSELTRRHGRFLLTGVRLSSAPMDSPAPSEEEEEEAGEDYSCSPSSVAGTAAGSASDGSSISEYLTKTLPGWHVEDFLVDEATAASSSSDGLFQGGLLAQIGGVPDGYAAWAGREQLHSGVAVAADERASRERWVPQMNAEWGAGSKRPRASPPCLYW

SEQ ID NO: 4584 - protein, 798 aa, Aspergillus nidulans FGSC A4
MSSQGITRKRPAPGTSPAVHPQLGQLPNYPPTSGSPLSNDQFLQWGQNPSPNTVAPGSFPDANTYNTGALPASAHDISGVSTANNQVARRTPSTQIVNRSRSYEQPPAPLSDPSNVPSEPGGWSESLEELYKRALAAKREAQAKRKQIPPFVQKLSSFLDESKNTDLIRWSDDGNSFIVLDEDEFAKTLIPELFKHNNYASFVRQLNMYGFHKKVGLSDNSMRASERKNKSPSEYANPYFKRGHPDLLWLIQKPKNTAGQGTKSGKGYVRVKTEDAENENEDFGDENAGASRDDGARNRQLSLVAQQPSLPKDQFATVYRELQAIRQQQQIISSTINKLRREHEQLYAQAANFQEQHTRHENSINAILTFLATVYNRSLQGQEGQNLANSFAGAISQDQGNVVDMGDGYSFGPLGAPSMNSPGGPRSMKKQPLLLKAPPGSERHGRAATLSPAATAYDRSQSRNNSRQTSTSQSGQVEEVFDNNSPRSKETSSSQAQQYPQRDIMSVIQNANARNGIPTSYSDFPNVLSSLETSNGNVPLTSNQRADMLRLMANESGTNDSGVTVSQNNALISPVPPPMPNNYSARLADTRSEIDNLMKMQAEQDRSVQNLTNLLQPLSPSGTIPGIGSDGTIPPPPLELDQIFNNDYFTDFGDYDQQNRANVDLGDSTGAGQAPPSTEPPAPPDDIAIKHDGNDLFDFDHLAGEGELFAGTNNQSSPGYFPQFDSGYGHSAANTTGASTGVSGSGRVVETLTDSESTSPSNTVDDPTHYSADVFDAGDGSQGGKSSSGGGSKRRRKA

SEQ ID NO: 4585 - protein, 272 aa, Oryza sativa Indica Group
MSPPLEPHDYIGLSAAAASPTPSSSSCSSSPNPGGEARGPRLTLRLGLPGSESPEREVVAAGLTLGPLPPTTTKAASKRAFPDSSPRHGASSGSVAAAAAACQDKAAPAAAPPAAKAQVVGWPPVRNYRKNTLAASASKGKGEDKGTAEGGPLYVKVSMDGAPYLRKVDLKMYSSYEDLSMALEKMFSCFITGQSGLRKSSNRDRLTNGSKADALQDQEYVLTYEDKDADWMLVGDLPWDLFTTICRKLKIMRGSDAAGIAPRSIEQSGQSR

SEQ ID NO: 4586 - protein, 302 aa, Pinus taeda
MERFANDGDEHSLKETELRLGLPGVCESDTGLGQTRNGKRAFSEVMDSTKASSFNDNKWIFPSVKCQPPTSAITETAEACKGSQPGLFSATPGQKIMMQGGCGAPQSWAGDNGLSKSTAPKDELHPKTPRGGPTEKTNAASQSQAATDPAMAPAPKAQVVGWPPIRSFRKNTLAANSKPNDEGSSSNALYVKVSMDGAPYLRKVDLKMYSTYHELSSALEKMFSCFTMGQCGSPGLSESKLIDLLNGSEYVPTYEDKDGDWMLVGDVPWEMFVDSCKRLRITKASEAIGLAPRAMEKSRSKN

SEQ ID NO: 4587 - protein, 340 aa, Capsicum annuum
MGHHCCSKQKVKRGLWSPEEDEKLIKHITTHGHSCWSSVPKLAGLQRCGKSCRLRWINYLRPDLKRGCFSEQEERIIIDVHRILGNKWAQIAKHLPGRTDNEVKNFWNSCIKKKLISQGFDPNTHNLLSRAAAAATPPHRNNKKKTNNNHTTSSVFTIETSLSPSSTKELVSMDMIKASLAALSPFPHTNSSTTVLTMPQFQTSWSHLYESACNYYNHVPIKTNIVYQNHSTSTGTFGIINENCMWGVTGFEPHHEFGPSNNIGHEEMQQGAQVQLQEENCLEEVYKVNDLHEFNKHGRIAENVTFDDSSDFDFEFVDSELIPCGIYTNVNSIDQLAWDC

SEQ ID NO: 4588 - protein, 316 aa, Saintpaulia ionantha
MFGKNSYLHPPQVSQPLQTQGPTSSVDLSDGAEILLHHHQDDVLSGHYLAENTPFLGVSTLYSQDLGVGSEDPSSLSNTLSRRQVVKKDRHSKIVTSQGPRDRRVRLSIGIARKFFDLQEMLGFDKPSKTLEWLLTKSKVAIKDLVLAKKSSSSRSTSSPSECEVVLNGETFEDGSCLLPPDFKRKSASTARDPAQSASTLAKESRAKARARARERTKEKLCIKKLNESRNMNNNLFASNSQPVLHCPITNEATATQQDLIQESSVIKRMLRHHQSFFGFHCAALPSPDVDENWDAGSLTSQSNLCDILDQHKFNH

SEQ ID NO: 4589 - protein, 231 aa, Pinus taeda
MSCSVGGMEKSSTGAQQENKCSLDIFAETELRLGLPGVAAGERQRICGKRSFSEAMESRNFSIPQEEAHKFHEPNLGTEKQMVRPANDPPKMGPTPPKAQIVGWPPVKDFRKVRTIAASSSLYVKVSMDGAPYLRKVDLKMYSTYHDLSSALENMFGCLITMGKCGSSGIKESNLMDVVNGSEYVATYEDKDGDWMLVGDVPWQMFVDSCQRVRIMKASEAIGLAPRAMEK

SEQ ID NO: 4590 - protein, 327 aa, Zea mays
MEDLYSIHPGISRAGGAATAASEVSGVAGGPGSPPPPPSQPPPPPPADLTELVKAQIAGHPRYPSLLSAYIECRKVGAPPEVATLLEEIGRERCAAASAGGEVGLDPELDEFMEAYCRVLERYKEELSRPFDEAASFLSSVRTQLSSLCGAAASLSAIYYTTANPETTSSFNIALVYEMVGSSEEDEACSGGDTEATEPGQQEHSSRLADHELKEMLLKKYSGCLSRLRSEFLKKRKKGKLPKDARSALMDWWNTHYRWPYPTEEDKVRLAAATGLDPKQINNWFINQRKRHWKPSEDMRFALMEGVTGGGPSSGTTLYFDTGTIGP

SEQ ID NO: 4591 - protein, 300 aa, Triticum aestivum
SELMSYMHLLYDICPFFRFGYMSANGAIAEAVKGENFIHIIDFQIAQGSQWVTMIQALAARASGPPYLRITGIDDSDSAYARGGGLDIVGRRLCNIAQSCCLPFEFNAVNAASHEVTLEHLDIRKGEAIAVNFAYQLHHTPDESVCIENHRDRILRMVKSLSPRVVTLVEQEANTNTAPFFSRYMETLDYYTAMFEAIDVACPRDDKVRMSTEQHCVARDIVNLIACEGAERVERHEPFGKWRSRFAMAGFRPYPLSALVNNTIRTLLNDYNSYYKLEEKDGVIYLGWKNRKLVVSSAWR

SEQ ID NO: 4592 - protein, 181 aa, Zea mays
  misc_feature (98)..(98): Xaa can be any naturally occurring amino acid
QRPSGRYAAEIRDPAKKSRVWLGTYDTAEDAARAYDAAAREYRGAKAKTNFPYPSCVPLSAAGCRSSNSSTVESFSSDAQAPMQAMPLPPSLELDLFXVRFPFGSIPVTHPYYFFGQAAAAAAEAGCRVLELAPAVTVAQSDSDCSSVVDLSPSPPAAVSARKPAAFDLDLNCSPPTEAEA

SEQ ID NO: 4593 - protein, 215 aa, Zea mays
  misc_feature (140)..(140): Xaa can be any naturally occurring amino acid
  misc_feature (164)..(164): Xaa can be any naturally occurring amino acid
MAKTKQGKRDVDAYTIKGTNKVVRVGDCVLMRPADTDNPPYVARVERMESDGRGSVRVRVRWYYRPEEAKGGRRPFHGAKELFLSDHFDTQSAHTIEGKCIVHSFKSYTKLDNVGPEDFYCRFDYKAATGAFTPDRVAIXCKCEMPYTPDDLMVQCEGCKDYIXWFHPSCMGMTIEQAKKIDHYMCSDCAKENGAKRPSNSYSVSPNSDSKSVLF

SEQ ID NO: 4594 - protein, 322 aa, Nicotiana tabacum
MEKMYEFVSSSSDVYSVEDNLQPPYFGSPPAFCDGLAPMGFGSGNMSWACPETSAANLVVDKSGTSSSNLQLEDHPETDIRAKISSHPLYPKLLRTYIDCHKVGAPSDEIVDMLDNINIVHENDLSRRSNRLSDDSELDAFMETYCDVLAKFKSDLERPFNEATTFLNDIETQLTNLCAAPATTISNISDEGAAGTEEEEEVADTSGGGGNTNDMCRSENEIKDKLMRKYSGYISSLKQEFSKKNKKGKLPREARQILLNWWTTHYKWPYPTEGEKICLAESTGLDPKQINNWFINQRKRHWKPSENMQYAVMESIYGHFSE

SEQ ID NO: 4595 - protein, 164 aa, Oryza rufipogon
MEELEGHRGEGRLPPPPPLLPFPKVSVQVYTVPSSSTAASAAAAGGARQAVAPATRDGGDGGGRAAGVLDDPVKARIVSHPRYHRLLAVFLDCHKVGCPAEAAEEIAAAARVREARQRAAAAASRMPPAPEDPELDQFMEDYCKLLVECKEELSRPLQEAEEFL

SEQ ID NO: 4596 - protein, 253 aa, Vitis labrusca x Vitis vinifera
MVRAPCCDKVGLKKGPWTTQEDQNLTAYVLQHGHGNWRALPKQAGLLRCGKSCRLRWINYLRPDIKRGNFSREEEDTIIELHEKLGNKWSAIAASLPGRTDNEIKNVWHTHLKKRLKKKLATPDSKGHFTPAASACDSDSFNSSGKMSPQPSSSEFSSFTDSSTRTMETHSTGVKNEQMEEYSPESFPEIDESFWSDALSSDNSSMASDFPAVADELQLQTPELACGQISNMMDDGMEFWYDVFIRAGGLQEL

SEQ ID NO: 4597 - protein, 365 aa, Oryza sativa Japonica Group
MEELEGHRGEGRLPPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFLRTVESELNSINSGPPLTALISESKAGLDSSDDDEHEDGSGMEMMEAAEDEDLGIIDPRSDDKALKRHLLRKYSGYLGGLRKELSKKRKKGKLPKEARQKLLTWWELHYRWPNPSEMEKIALAESTGLEQKQINNCFINQRKRHWKPTEEMEFAVMEAYHHQSTDAAAAFYVDVDARLVGATAAAPASAVYTARPDHGVWRA

SEQ ID NO: 4598 - protein, 319 aa, Nicotiana tabacum
MDDEIYGFHSTSEYADKALMSPENLMMQTEYNMTYHNYNTLSTPPMMFGSDDVQLSSEAANSENNNIHHQIRGSCSRRDDTEDASNIIKAKVVSHPFYPKFVRAYIDCQKVGAPPEIATVLEEIRQQNDFRKPNATSICIGADPELDEFMETYCDILVKYKSDLSRPFDEATTFLSKIELQLSNLCKDDGGVSSDEELSCGEVEGQDASQRSEDNELKDRLLRKFGSHLSTLKLEFSKKKKKGKLPKEARQMLLAWWNDHYRWPYPTEADKNSLAESTGLDPKQINNWFINQRKRHWKPSENMQLAVMDNLSGQFFSDD

SEQ ID NO: 4599 - protein, 253 aa, Vitis labrusca x Vitis vinifera
MVRAPCCDKVGLKKGPWTTQEDQILTAYVLQHGHGNWRALPKQAGLLRCGKSCRLRWINYLRPDIKRGNFSREEEDTIIELHEKLGNKWSAIAASLPGRTDNEIKNVWHTHLKKRLTKKLATPDSKGHFTAAASTCDSDSFNSSGKMSPQPSSSEFSSFTDSSTRTMETHSTGVKNEQMEEYSPESFPEIDESFWSDALSSDNSSMASDFPAVADELQLQTPELAYGQISNMMDDGMEFWYDVFIRAGGLQEL

SEQ ID NO: 4600 - protein, 365 aa, Oryza sativa Indica Group
MEELEGHRGEGRLPPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFLRTVESELNSINSGPPLTALISESKAGLDSSDDDEHEDGSGMEMMEAAEDEDLGIIDPRSDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPASAVYTARPDHGVWRA

SEQ ID NO: 4601 - protein, 527 aa, Vitis vinifera
MDLKDRLSVDTWTQSSSSGNELPKDQQSFTNFSLQQQQHQHKWEDPSVLDYSVRIEPAFQEFNQTSATSSSLPCNPNSQIKNLNREDCQMNEMLEPNRIQDWDPRVMLSNLSFLEQKIHQLQDLVHLIVGRRSQVLGRTNELVAQQQQLVTADLTSIIVQLITTAGTLLPSVKNTLSTASPSVGQLGQLGGVLFPSGTGMNGGGVAQSSGGSKVSDQSNQIDLTGACVIEQNNATEEHELKDEDDADEGENLPPGSYEILQLEKEEILAPHTHFCMICGKGFKRDANLRMHMRGHGDEYKTPAALAKPNKESSSEPVLIKRYSCPFAGCKRNKDHKKFQPLKTILCVKNHYKRTHCDKSYTCSRCNTKKFSVIADLKTHEKHCGKDKWLCSCGTTFSRKDKLFGHIALFQGHTPAIPLDETKGSVGPSDRGEGNGAANKVGSVGFNFSSNASSGSGVQDMMMDVKRGADEPTGFFSPLTFDPCSLVGFHEFPRPPFEDSESSFSFLVPGSCSYTRKTGGESSSNDLE

SEQ ID NO: 4602 - protein, 689 aa, Petroselinum crispum
MVLKKSQEYGFRGYQVPAIPRGPRSLRRRASFKKPVDDGEICAFELLATVAGKLLQESESSTSSNVAELKDQIRIHKDGIKKELPEGSGVRSECLDQGSCIESVLVPDFAALERNSKATVEVPHIESVYVPERVSAVPSSEFLVKGRYNVKPEKRTSDDAAGSLASKLKGTFSSDGPLYESNIEKEPRRQIEVVKKQRGHLDMVKTSASKNPTEFYVNNTHMLINSENSVDLPLYRAQEPDAPSPRHRSDVKIVNRDDDENYFRSNVLNTKTRAFRPQARMNYRRMRKLQTARYWKAYPKMKDYELSNISRGARAFYHKRKTVYAEERYQYDVQTKRRRLFGHRSDQEASSESISNCPDKAVKGHKSGTPSIWHKVSGVSSSGTGHKSSMHSKDPRVNFSIKSFEVPELYIEVPETATIGSLKRTVMDAVTSILGGGIRVGVVLQGKKVKDDSRTLQQSGISQNEDLESLGFTLEPSFVEAASPLSQEGSPLLLPCDVNQELSRTPAPILDSGFSKSFDQTPLAKLDNHVESNPAPSVTDVSTEETAMDSKALVAIPPINAEALAMVPMSQKTKRSDLSQRRTRRPFSVSEVEALVEAVETLGTGRWRDVKMRSFDDANHRTYVDLKDKWKTLVHTASIAPQQRRGEPVPQDLLDRVLAAHAYWSQHQSKQHGKHHQMEPLKLAGEVVV

SEQ ID NO: 4603 - protein, 333 aa, Vitis vinifera
  misc_feature (121)..(121): Xaa can be any naturally occurring amino acid
MGVPETDPLSQLSLPPGFRFYPTDEELLVQYLCRKVAGQGFSLEIIGEIDLYKFDPWVLPSKAIFGEKEWYFFSPRDRKYPNGSRPNRVAGSGYWKATGTDKVITTEGRKVGIKKALVFYXGKAPKGTKTNWIMHEYRLLENSRKNGSSKLDDWVLCRIYKKNSNSSKPIAAVLPSKAHSNGSSSSSSSHLDDVLESLPEIDDRFFSPNRMNSLRVSQPDEKVNFHNLGSGNFDWATLAGVSSLQELVSGVQSHAQPPAAVNNSNEMYVPSLPPLIQAEEEVQSGLRTQRVDPVMNQGFFPQNSNAFSQSFSNSLDPFGFRYPTQPSGFGYRQ

SEQ ID NO: 4604 - protein, 393 aa, Zea mays
DCSGEMAPGASTGFMTRQLFPSPTPPAEPEPEPVAAPVPVWQPQRAEDLGMAQRPVAPAKKTRRGPRSRSSQYRGVTFYRRTGRWESHIWDCGKQVYLGGFDTAHAAARAYDRAAIKFRGLDADINFSLSDYEDDLKQMRNWTKEEFVHILRRQSTGFARGSSKYRGVTLHKCGRWEARMGQLLGKKYIYLGLFDSEVEAAWAYDRAALRFNGREAVTNFEPSSYNAGDNNLRDTETEAIDDGDAIDLDLRISQPNVQDPKRDNTLAGLQPTCDSPESSNTMASQPMSSSSPWPGYHQNPAVSSHHQRLYSSACHGFFPNHQVQERPVERRPELGAQPFPSWAWQAQGSPHVPLHHSAASSGFSTAAGANGGMPLPSHPPAQFPATTNPFFFP

SEQ ID NO: 4605 - protein, 216 aa, Zea mays
MAPRTSERAMTSAAAGLARGAGPHYRGVRKRPWGRYAAEIRDPAKKSRVWLGTFDTPEDAARAYDAAAREYRGAKAKTNFSFPACLPLAAADVAGACRSGNSSSTTTTTTVDSFGGDVQAPPMQAMPLPPSFCASGAVRFPFSSYPVTHPYYFFGQAAAGCHMLKLPPTTVTVAQSDSDSSSVEDLSPSPPAAVSATRSATFDLDLNCPPPAEAEA

SEQ ID NO: 4606 - protein, 585 aa, Petunia x hybrida
MAVLPGENPIAVHNNKEMGKIPPLNSLPVGYRFRPTDEELVNHYLRLKINGADNEVSVIREVDICKLEPWDLPIWSVVESNDNEWFFFCPKDRKYQNGQRLNRATERGYWKATGKDRNIVTKKGAKIGMKKTLVYYIGRAPEGKRTHWVIHEYRATDKSLDGTHPGQGAFLLCRLFRKNDLKQDEHVESSNLDDAEQNATAAKSPTDDELSEAATPLVAGQPLGDSDKSYAAKFPKGEPYGKQLPLESHSNSCIADDTEDQMVDITSIPPDLELEKALGNFCDQSSQPLDWKIFSPLHAQMQVEFGSSYLQAPMNNDMSAFQKDVQFQYGTNALDINDFLDSVIVSSDEFSCGDSGQEVGLHNFDTTIHSFTGAPVKDSGSCSESEAEVTQRLVEPDFFEPEILLGNFDQATDVKGGVNSIQTTVQDAAGAPYFSNDHVMGNVGFLQNTYIGQNDFSAGYGGIQVPNFLTVQESGGYNNVVSSDSGSGTGIKLRTRQMQNQPDDRQSRMQGTANRRIRLQMKLQVGPVKSRIHSDSSQGAESDEAATEGERVSDEHSSTTSAAITSDEARDATHEEFKSKLVKEA

SEQ ID NO: 4607 - protein, 489 aa, Oryza sativa Japonica Group
MEGDQAGGDLTDIVRAGGGAMPGSVVVDLPSTAAEWQLPAEPMLFPPPPSLSSTTDGCGAGGAAGADIFGGGGGDLFSGLVDPFSSDYSSGADFLDAMPDAMAKVGFDTAVGGGCGGGGGGGGGSGGHLLDMSRKPLLPRGMPMAAVGGLAAPRVMPSPLSPRAIRPYPPISAGDMMKLGITAGQAAGCAIDAAVAGMQMSSPRSGGIKRRKNQARKVVCIPAPTAAGGRPSGEVVPSDLWAWRKYGQKPIKGSPYPRGYYRCSSSKGCSARKQVERSRTDPNMLVITYTSEHNHPWPTQRNALAGSTRSHHSKNSGGGGGSGSKGSQNDKSQQQPSVKEEQKDQATTATTTTTSTITTTNSASPVVVKEEEAALAGSSEALELERVMDTTAAGVVDHSELMDHVFSESYKPMIPETGQPDDFFADLAELESDPMSLIFSKEYMEAKPSGGDHAQEKAMAKELDPFDMLDWSTTTNSSAGSSFEQGKRG

SEQ ID NO: 4608 - protein, 410 aa, Vitis vinifera
MITDKKVANAMGGKTARACDNCLHKRARWYCGADDAFLCQACDASVHSANQLAERHERVRLQAASCKNADSMRDNSTPAWHQGFTRKARSPRNVKRTSVQPSKHENKFPTPPPLVPEIGSEEASPDENEEQFLFRVPTFDPFVAELNNDGIREIGMENDSKPLSDYGHEEIGDLDSLTGFLPSEMDLAEFAADVESYLGAGLDEDSCGIKGIGVLDCEQGDMDACFGDQKVKVKEERVETDATFHLDPELDMTKELLAWNLDYESTVMDEEEHEEKMVAAVEMRRKISLSLNYEDVITAWASQGSPWTTGNRPEFDPNDYWPDYMGACPTNVHGPCGDVGGVGGNFGGRDGGREARVLRYREKRRTRLFSKKIRYEVRKLNAEKRPRMKGRFVKRASFAAGPCFPILNVK

SEQ ID NO: 4609 - protein, 177 aa, Chlamydomonas reinhardtii
MSVWMPPGGGSGSMAPPSQSHLVCGGCRCLLMYPQGASNVRCSRCGHITSAPASAGADSSQIVCNGCRVLLSYPRGAQSVQCSLCHAVTQVPVYGHLVCNGCSIMLMYPVGAQSVKCSVCHYVTPVTAATAAAGGASGSVPAARPKTKQTVVVENPPSYDEKGNEVANIAVGVKADT

SEQ ID NO: 4610 - protein, 386 aa, Capsicum annuum
MEGTSSIDQESTTSDSLSIAPMTTTKPPESLCRMGSGTSSVIIDGENGVEAESRKLPSSKYKGVVPQPNGRWGAQIYEKHQRVWLGTFNEENEAARAYDVAAQRFRGRDAVTNFKPLLENQESDDDVEIAFLNSHSKAEIVDMLRKHTYIDELEQSKKLFGYTKDGTMAKNKDGLIDISSFFGGGGTIDKVNNKVREQLFEKAVTPSDVGKLNRLVIPKQHAEKHFPLQNGNNSKGVLLNFEDLNGKVWRFRYSYWNSSQSYVLTKGWSRFVKEKNLKAGDIVSFQRSTSGDKQLYIDFKARNMAPTNPVVTNQVQAQVQVPRVQMMRLFGVNICKIPATINNVVDNNNNNNNNMANCSGGKRMMEMELLTFESCRKKQRVIIDAL

SEQ ID NO: 4611 - protein, 330 aa, Zea mays
MAAAIDMYKYYNAHQIASSSPSDEELAKALEPFITSASSSSPYHRYSSSPSMSQDSYMPTPSYTSFATSPLPTPAATTSSSTPFSQLPPLYSSPYAAPSMVGQMGLNQLGPAQIQQIQAQFMFQQQQQQQQRGLHAAFLGPRAQPMKQSGSPPLAPAQSKLYRGVRQRHWGKWVAGIRLPKNRTRLWLGTFDTAEGAALAYDEAAFRLRGDTARLNFPSLRRGGGARLAGPLHASVDAKLTAICQSLAGSKNSSSSDESAASLPDSPKCSASTEGDEDSASAGSPPSPTQAPPVPEMAKLDFTEAPWDETEAFHLRKYPSWEIDWDSILS

SEQ ID NO: 4612 - protein, 347 aa, Zea mays
MWDGGVEHGSQEAAHQLLPWLGAAPFSEPAAVAGLGAAMGAYACDGVGGLGHGGVFGFGFDAAVQQQQQQQRAADGSGKAVVVSGLLGSLQAELGRMTAREMMDAKALAASRSHSEAERRRRQRINGHLARLRSLLPNTTKTDKASLLAEVLDHVKELKRQTSAMMAATDADADADDEGAGRTQAQAQAQLLPTEADELCVDAGADGAGRLVVRASLCCEDRPDLIPDIVRALAALQMRARRAEITTLGGRVRSLLLITADRRADVQRGGGGGGDGDDDEEEEDEEEGGERAASHRRHECIASVQEALRGVMDRRTASSCDTSSSGGGGGSIKRQRMNYGSQEQCSV

SEQ ID NO: 4613 - protein, 243 aa, Citrus sinensis
MGRGRVQLKRIENKINRQVTFSKRRAGFLKKAHEISVLCDAEVAVIIFSHKGKLFEYSTGSCMEKILERYERYAYAERQLIAPDPESQRNWPLECNNLKAKIDLLQKDQRHYLGEDLESLSLKDIQQLEQQLDTALKHIRSRKNQLMQESISELQKKEKSIEEQNNLLVKQIKEREKAAAQQAQWGNQIQNQVPNTLSFLLPQPPPCLRLGGAYQEQASEMRRNELNLTLEPVCSCSLGCFAG

SEQ ID NO: 4614 - protein, 334 aa, Zea mays
MDPRFPLPAAAAPSTGGGGGARGHHRRAHSETFLSFHDADLLLDPDGDFFSDLDFPSLSDDSPAASDPTPPPHPQQQPPQASPAPRPPGGTHTRSLSLDAAFFEGLAFQGPSGSAGGGGGPGHKRSGSMDGDTSPFEGESALSSGLPDYAKKAMPAERIAELALIDPKRAKRILANRQSAARSKERKIMYTSELEKKVQTLQTEATTLSAQLTLLQRDTTGLTAENRELKLRLQSMEEQAKLRDALNEALREEVQRLKIAAGQVGNMNGNPFNGGLQQQIPSYFVQQQQQQQTPYFGGHQAQLHNQNQNHRHQISSNVGQTLSGQSLNDSMDFM

SEQ ID NO: 4615 - protein, 298 aa, Triticum aestivum
MGAEAKCDRIKGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRKLATATGGGAAWEEASDSGDSPRPCKRASPGPESPTGSDRSELSHGSGQVFRPVPRPGGFDAISADVRPPPPRQDEDPITSLSLSLPGLEHGFHHDSARSHFQELSPSPRSPSPPPAPAPQPSSSYPFSGDLVAAMQEMIRAEVCKYMSGVGLPAGCGAGPVGEACIPQLVEGVMRAPAERVGVMTRQ

SEQ ID NO: 4616 - protein, 320 aa, Saintpaulia ionantha
MFGKNSYLHPPQVSQPLQTRGPTSSIDLIDEAEILLHHHHQDGVLASHYLATNTPFLGVSTLYSQDAGEGTEDPSALANALSRRQTVKKDRHSKIVTSQGPRDRRVRLSIGIARKFFDLQEMLGFDKPSKTLDWLLTKSKVAIKDLVLTKKSSSSKSTSSPSECEVVLNGEAFQDGNCLRHPDSRKSSSTNANKCKDPAQSASNLAKESRAKARARARERTKEKMCIKKLNESRNMDNNLFASNSRPVLQCPITNEATATHEDLIQESSVIKRMLRHHQSSFFGYHCGLPSPNVNENWDVGSLTSQSNLCDILDQHKFNH

SEQ ID NO: 4617 - protein, 252 aa, Saccharum officinarum
MGRSPCCEKAHTNKGAWTKEEDERLVAYIRAHGEGCWRPLPKAAGLLRCGKSCRLRWMNYLRPDLKRGNFTDDEDELIIRLHSLLGNKWSLIAGQLPGRTDNEIKNYWNTHIKRKLLARGIDPQTHRALGADAATAPGVAAHHRATAAALLHHAGAAVVVVPAPVKLAAVKPAPAESSSDDGGSSSGSSSGGGAGEPRCPDLNLDLSVGPPAVVADTPTLHLAVCLGYRLCLRPGRFAVTMLKLYCVSIWFY

SEQ ID NO: 4618 - protein, 451 aa, Coprinopsis cinerea okayama7#130
MTTEQKPEQLFPAIGQVVDKEEEEERPPVDEIDSLCMKCHEQGKTRLLLTSIPYFKEVVVMSFRCEHCGWSNNEIQSAGTIREVGTLYTGKMLDRSDLDRQIVRSSSCEVNIPELDLTLPPTERGQLTTVEGLLRDIVNDLSFDQPLRRIQTPEAYEKIEELIKKIKAILGDHEDEGEKEDGQPTKASEKDLPMPPFTLKLDDPAGNSFLEFMGSMADPKWHLRTYPRTFQQNVQLGLVDKDEGDEAENQPPPEEITKDEILVFPGKCSSCGHGLETYMKRVDIPYFKEILIMSTNCERCGYRDNEVKSGSAISPQGKKIILKVEDQEDLSRDILKSETAGLEIPEIDLVLTSEHLTKRSAHAFLQVLNVEKPFTVILDDPLANSYIQSLYAPDPDPNMEAEFYDRTWEQNEELGLNDIKVEGYEGDPNLVKDESEKKDEQKKEEAPATTA

SEQ ID NO: 4619 - protein, 180 aa, Populus trichocarpa x Populus deltoides
MGISFVAVKMPKCFGLQFLLEFLTFIKLLFLLTLSNLLMSRPRRQPYNTDQDQHPTEDYVLVMGELSPSPIPVPVSVLTRLIKKKLPVMAFSSLLERLVKLEDDQESMCPVCLDCIQERDEVRELCNCSHVFHMKCLDSWVDQGQVTCPTCRSMLFPKKMEAAEMFIFAHDDSAMVEQVS

SEQ ID NO: 4620 - protein, 366 aa, Zea mays
MDLPLYQQLQLSPSSPKTDQSSSFYCYPCSPPFAAADASFPLSYQIGSAAAADATPPQAVINSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAASGPSDRPSSNNLSHHSSLSMNMPCAAAELEERERCSSALSNRSAGRMQEITGASDVVLGFGNGGGGYGDGGGNYYCQEQWELGGVVFQQNSRFY

SEQ ID NO: 4621 - protein, 180 aa, Medicago truncatula
MDAAAYSSGEDVVLKTRKPYTITKQRERWTEDEHNRFLEALKLYGRAWQRIEEHIGTKTAVQIRSHAQKFFSKVDCGEPTQVALLLVMLCLKGAFRHPNECHLGETRNYTKKCNLEIHSLLASFFRGSQRTSPSSDGSFTPVMVKVPHALAISIISEPIQDPLGHLLSGHPPFLSTDQAQ

SEQ ID NO: 4622 - protein, 240 aa, Arabidopsis thaliana
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLTYGG

SEQ ID NO: 4623 - protein, 618 aa, Hordeum vulgare
MKREYQDGGGSGGGGDEMGSSRDKMMVSSSEAGEGEEVDELLAALGYKVRASDMADVAQKLEQLEMAMGMGGPAPDDGFATHLATDTVHYNPTDLSSWVESMLSELNAPPPPLPPAPPQLNASTSSTVTGGGGYFDLPPSVDSSSSTYALRPIISPPVAPADLSADSVRDPKRMRTGGSSTSSSSSSSSSLGGGAARSSVVEAAPPVAAAAAAPALPVVVVDTQEAGIRLVHALLACAEAVQQENLSAAEALVKQIPLLAASQGGAMRKVAAYFGEALARRVFRFRPQPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEEDPNEEPEVIAVNSVFEMHRLLAQPGALEKVLGTVRAVRPRIVTVVEQEANHNSGSFLDRFTESLHYYSTMFDSLEGGSSGGPSEVSSGGAAPAAAAGTDQVMSEVYLGRQICNVVACEGTERTERHETLGQWRNRLGNAGFETVHLGSNAYKQASTLLALFAGGDGYKVEEKEGCLTLGWHTRPLIATSAWRLAAP

SEQ ID NO: 4624 - protein, 185 aa, Glycine max
QEQSSTTGMPTTNPDWSNFQTYSPIPPHGFLASSPQAHPYMWGVQHIMPPYGTPPHPYVAMYPHGGIYAHPSIPPGSYPFSPFAMASPNGIADASGNAPGSIEVGGKPPEMKEKLPIKRSKGSVSGGNLSMWITGKNNEPGKTPGESANGIHSKSGESASDGTSEGSDENSQNDSQLKSGEKQDS

SEQ ID NO: 4625 - protein, 266 aa, Solanum tuberosum
MSIEALKSPTAAALPPLEEIDDSHNLDSWAKGKRSKRPRIENPPTPDQYLALCLLMLANDDGTGFGKGKGTGSIGVVIEQQQEKKLLKPVFIKEKTEQLFKCSECPKVFTSYQALGGHKASHRIINVPATGDGDNNPSTSTSTSGNISALNPSGRSHVCSVCQKAFPTGQALGGHKRRHYEGKLGGNNRYISGGGCGEGLHSGSVVTTSDGGGASTPVARDFDLNMPASPGCQLDLTIDCGGRSQHPIEQEVESRMPAKKPRLFFD

SEQ ID NO: 4626 - protein, 353 aa, Arabidopsis thaliana
MPTLYKKAGCRSPGIAMMELLMCSGQAESGGSSSTESSSLSGGLRFGQKIYFEDGSGSRSKNRVNTVRKSSTTARCQVEGCRMDLSNVKAYYSRHKVCCIHSKSSKVIVSGLHQRFCQQCSRFHQLSEFDLEKRSCRRRLACHNERRRKPQPTTALFTSHYSRIAPSLYGNPNAAMIKSVLGDPTAWSTARSVMQRPGPWQINPVRETHPHMNVLSHGSSSFTTCPEMINNNSTDSSCALSLLSNSYPIHQQQLQTPTNTWRPSSGFDSMISFSDKVTMAQPPPISTHQPPISTHQQYLSQTWEVIAGEKSNSHYMSPVSQISEPADFQISNGSVSPYSPPSLLSLVCYLRPL

SEQ ID NO: 4627 - protein, 154 aa, Glycine max
PRVRDHEKVLQTSQTHLKDIQAKSHSGSARSCTKVHKKGIALGRSVDLTKFSDYGELIAELDQLFEFGGLLTSPQKDWLIVYTDNEGDMMLVGDDPWQEFVAMVRKIYIYPKEEIQKMSPGTLSSKNEENQSASEGATDTQEIKCQLNNSASDT

SEQ ID NO: 4628 - protein, 361 aa, Oryza sativa Indica Group
MEEELCGNNWDLDAVVRLGCCRRRISPAAVAQQVDPFASFLQQGVAMEVAAEKEVGVEAAWSFPELTVRDGGGGGLGRDADELLKAFCAAFPSSSSSKSSPLPTPPPPPPTQPQPEQQKPVTVQENLPAPTTAPARASQPAAARQVPAGGVPRSKRRKNQQKKVVRHVPADGVSADVWAWRKYGQKPIKGSPYPRGYYRCSSSKGCPARKQVERSRSDPNTFILTYTGEHNHSAPTHRNSLAGTTRNKLPSSSSASAASAQPQPPPPSVVVVGAGGGGAEAAGLSPTTPLRTPSMEEDEEEEEEEELLVEDMEMAGEDELLFLNGGDDNAALDGTPMSSLFDIADEPFLPSPWTEPTAAGS

SEQ ID NO: 4629 - protein, 254 aa, Buchloe dactyloides
MERVEVQGGDSSSGDQVRKKRMRRKSTGPDSIAETIKRWKEHNQKLQEEYGARKAPAKGSKKGCMAGKGGPDNGNCVYRGVRQRTWGKWVAEIREPNRGKRLWLGSFPTALEAAHAYDEAARAMYGPTARVNFAESSADGNSGCTSALSLLASNVPPAAQRSEDKDEVESLETEVHEVKMEVNDDLRSIHVESKTLEVFQSEESALRKERDVNFDYFHVEDVLEMIIVELNAAKTIEVHEEHQVGDDGFSLFSY

SEQ ID NO: 4630 - protein, 295 aa, Picea sitchensis
MKVQCDACQSADASVFCCADEAALCMKCDSKVHDANKLASKHRRLSLLEPNSSSSTDSLRCDICQERRAFFFCQADRAVLCRDCDLSIHSANELTAKHNRFLVPGTRVSLKPMETLSCPEKAVATVTKALMPPAQRMPNHAQPSMDLPVETVTSTSNSDFSQYLNEVEQFLTSASPERLDWGGSSEGDAIGKYMDSDWAPNLGLLPEGFYGDSLAEVPHMPSPITDSGFCMYSRLGITMKPKAKQQQQVQQVPYFLPGFDTGDDNFTVPDIVFAPSAKRMRMSNTTLHDQQLFTM

SEQ ID NO: 4631 - protein, 88 aa, Chlamydomonas reinhardtii
MLRGSPTLSCPGLYTSQVDGCGRDLSAEKAYLQRYSVCEGHFKAEVAVVHGQEMRFCQQCNKFQDLREFEGSRRSCAARSKDRNMRRR

SEQ ID NO: 4632 - protein, 337 aa, Oryza sativa Indica Group
MAKSRRIAAAHLTCMEIFNRALDWALERELHTSRRGADDDRQILKLVHAATARGRRSRGRGSTSPPRLEFIKDHILKLEPTSTQRWKKSKKTGSEPIQVREETRKGPWTEQEDLQLVCTVRLFGERRWDFIAKVSGLNRTGKSCRLRWVNYLHPGLKRGRMSPHEERLILELHARWGNRWSRIARRLPGRTDNEIKNYWRTHMRKKAQERKSNMSPSSSSSSLTYQSCHPETPSMIIGIEEQELHGGSGCITSIMKSTPVDMDGYPMDQIWMEIEAPNVLPGPCFDEAKDSASNSLSGPLLPYPMWDYYCPETCLRMDDEIKVAPQFGYGKGVGPCY

SEQ ID NO: 4633 - protein, 332 aa, Glycine max
  misc_feature (77)..(77): Xaa can be any naturally occurring amino acid
  misc_feature (88)..(88): Xaa can be any naturally occurring amino acid
MEASGGVSSGVTVVGSDAPSDYHVAPRTDNPAPASGSTTQIPATAGSALSPSHPPHTAAMEAYPATMPAKKKRGRPXRKYAPDGSGTXPLSPKPISSSAPLPPVIDFSSEKRGKIKPASSVSKAKFELENLGEWVACSVGANFTPHIITGNSGGDVTMTVISFSQQGPRAICILSANGVISSVTLRQPDSSGGTLTYEGRFEILSLSGSFMPSESGGTRSRSGGMSVSLASPDGRVVGGGVAGLLVAASPVQVVVGSFLAGNQHEQKPRKQRHEVITSVIPAAVVPISTLDPVPILSAASSIRNDNWSAMPAEAKNKPADINVSLPAGFVFM

SEQ ID NO: 4634 - protein, 205 aa, Glycine max
  misc_feature (202)..(202): Xaa can be any naturally occurring amino acid
SYVGPPPECVTRFFATKIPYFREVIVMATTCDMCGYRNSELKPGGEIPAKGKKITLRVQNAQDLTRDVIKSDSASVKVPELELELSCGTLGGMVTTVEGLIVKICEALERIHGFQLGDSTLEWKKKKWDDFKERLSKLLSLQEAWTLVIDDGLAASFVAPATDSLEDDSQLTIEEYQRSWEQNEELGLNDMDTSSADAAYNXTNT

SEQ ID NO: 4635 - protein, 366 aa, Oryza sativa Japonica Group
MTRRCSHCSNNGHNARTCPARGGGGGGGGVRLFGVRLTSPPEVAMKKSASMSCIASSLGSGGGSGGSSPAGTGRGGGGGGEGAAGYASDDPTHASCSTNGRGERKKGTPWTEEEHRMFLMGLQKLGKGDWRGISRNFVVSRTPTQVASHAQKYFIRQTNSSRRKRRSSLFDMVPEMPMDESPVVVEQLMLHSTQDEATSSNQLPISHLVKQKEPEFARHLSDLQLRKHEESEFTEPSLAALDLEMNHAAPFKTKFVLTMPTFYPALIPVPLTLWPPNVANVGESGTNHEILKPTPVNGKEVINKADEVVGMSKLTIGDGSSNSIEPSALSLQLTGPTNTRQSAFHVNPPMAGPDLNKRNNSPIHAV

SEQ ID NO: 4636 - protein, 274 aa, Arabidopsis thaliana
MKTTPLPRLHYLVSLLCFFLSSKIKEDRPNYVRAVSPINLTSSLEKTREKKKRLLLRSTISKPQPMNPSNNPKKTRHQSHMPQERDETKKEKKLLHRNIERQRRQEMAILFASLRSQLPLKYIKALSSQGKRAMSDHVNGAVSFIKDTQTRIKDLSARRDELKREIGDPTSLTGSGSGSGSSRSEPASVMVQPCVSGFEVVVSSLASGLEAWPLSRVLEVLHGQGLEVISSLTARVNERLMYTIQVEVNSFDCFDLAWLQQKLIEQLVLSTTRH

SEQ ID NO: 4637 - protein, 317 aa, Zea mays
MQRGGDQAGASLGMEMGVGYAGGGGGGECSSSSAAAAAAAAAEGEERQLLKGEIAVHPLCEQLVAAHVGCLRVATPIDHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEAPMLEVGLDMGSDGHDMMGFGPLMPTDSERSLMERVRQELKMELKQGFKSRIEDVREEILRKRRAGKLPGDTTSILKQWWQEHSKWPYPTEDDKAKLVEETGLQLKQINNWFINQRKRNWHNNSQTSTLKSKRKRWPNNNAR

SEQ ID NO: 4638 - protein, 157 aa, Nicotiana benthamiana
VRAPCCEKMGLKKGPWTPEEDQILISFIQTNGHGNWRALPKQAGLLRCGKSCRLRWTNYLRPDIKRGNFTKEEEDTIIQLHEMLGNRWSAIAGKLPGRTDNEIKNVWHTHLKKKLKDYKPPQNSKRHSKNHDSKGPTTSRSSNNSDLTTQKHIDSPV

SEQ ID NO: 4639 - protein, 393 aa, Oryza sativa Japonica Group
MATGGSGGGGGGGGGGDDVHGLKFGKKIYFEQDAAASASAAAVESSSTSSGGGGKKGKGVAAAAAPPPPLPPRCQVEGCGVDLSGVKPYYCRHKVCYMHAKEPIVVVAGLEQRFCQQCSRFHQLPEFDQEKKSCRRRLAGHNERRRKPTPGPLSSRYGRLAASFHEEPGRSRSFVVDFSYPRVPSSVRDAWPAIQPSDRMSGSIQWQGGHELHPHRSAVAGYSDHHAFSSHGGSAAGAPMLHHPAFELTSGGCLAGVATDSSCALSLLSTQPWDTTQSTSSHNRSPPMSSTASAFGGGNNPVSPSVMASNYMAASPGWNSSSRGHDGARNVHLPPPHGVVLNEVPPGSVHHGHFSGELELALQGGAPSNRPEAEHGSGSGAFSHSTNAMNWSL

SEQ ID NO: 4640 - protein, 255 aa, Populus deltoides
MGRGRVQLKRIENNISRQVTFSKRRTGLLKKAHEISVLCDADVAVIVFSTKGKLFEYSTDSSMESILERYERCSYAEQQFVPHGPEHQGSWFLEHPKLRARVELLQRNLRNYTGQDLDPLSYKELHHLEQKIDTALKSVRSRKNQLVHESLAEMQKKEKALQDQNNILVEQVKKKLKALTEQAQWEQQNLGQNSSSFMLPQAQPPLQPSMLSHPPPTLGGSFQIRGFLNGNKDVEVQTQPSTMPHWMLRHVNDRI

SEQ ID NO: 4641 - protein, 317 aa, Arabidopsis thaliana
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 4642 - protein, 264 aa, Zea mays
MMKNYPGPASSSSVAVEVKKGSWSPEEDALLTRLVEQHGPHRWSLISAPIPGRSGKSCRLRWCNQLSPDVHHRPFTPHEDALILAAHARYGNKWATIARLLPGRTDNSIKNHWNSNLRRCRRRAAAAAVASRPQVQDSDDAPAAAAAHDDQPAAVVAAGGLGGGNSSSGLPPAAAGAATAEAEPSLSLSLGLPLPAAEPAEAAADDESRNSQGQASPLLEEGEGNAQLLAVVRRMVREEVQRQTGQLAYSLMAAAAARAKGHHR

SEQ ID NO: 4643 - protein, 283 aa, Arabidopsis thaliana
MGATVGGDGDTAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 4644 - protein, 294 aa, Rosa hybrid cultivar
MSSGTCSTTVDPAAGAAKEFMLFGVRVVVDSMRKSVSLNNLSQYEHPTEASNNNNDAVAGYVSENDVVHNSGGNRERERKRGVPWTEDEHKLFLLGLQKVGKGDWRGISRNYVKTRTPTQVASHAQKYFLRRSNHNRRRRRSSLFDITTDSVPATPMEEEQVHHQDNTSHLHSLPPPPPQSESCNPNGFSMVPIFPMNVGPAVVQSRHYRNNRKSKTGTRKSGVPSPKIVHPVALHSAPHATEASDLNLNATIDTSPLALNLSLSMNSRESSSRHSAFQAMSSFGNGDNIISVA

SEQ ID NO: 4645 - protein, 229 aa, Euphorbia esula
MADTPVSAPVVPEVTERKSKRGTKAAAVKVPKEKKKVIAAKKPKSKGTSSHPSFFEMISDAISTLKERTGSSQYAINKFVEDKHKQLPSNFRKLLLFHLKKLVASGKLVKVKNSFKLPSARAAPAPALAKKPTIPKPKVAAKPKTAKIGAKPKAKAKVAAKTKATTKTVAKKIPAAKPKAKTAGKPKTVAAKPAKVAKTAAVASPGKKKAVPVKKVKTVKSPAGKRTRK

SEQ ID NO: 4646 - protein, 138 aa, Triticum aestivum
  misc_feature (100)..(100): Xaa can be any naturally occurring amino acid
MPKEKTTRKTKRAAGEGKRKKDPNAPKRGLSAYMFFANENRERVRDENPGIAFGALGRKLGELWKGLSDSERKPYEDKAAADKKRYEGQKGNYLAGGDDXEKSSQLFLLTFLPSEAQWERTKRGQESTKGRIFGFIRR

SEQ ID NO: 4647 - protein, 602 aa, Medicago truncatula
MASGGLGLSIDSDPNSSFLYHKQIEFSTLFLNTTTPKTSSGNLYSHKMDTTNNKNKNKNKNKSPFQVNHEISHQPFDHEMRPIINELDFFSQNNNHHNHSSASASASTSTPPSLNLHHHHINDHYTDPSLLEFKVNTSLNLLTTNTSNDQSMMEEDIASDSEDKRAKLELVVLQAELERMKVENHQLRNMLDEGNRKYNTLQMHWMSMVQDKKVEDCNEEQKQVMGGKLDEEKQNGNGGVLVPRQFMELGLPANHSDAIDEPRSQDQSKSLANNNEEGSKDEELVLDHDKKESDRGNERNGSPADRVLAANNNNNVANFSPQTNVEQAEATMRKARVSVRARSEANMINDGCQWRKYGQKMAKGNPCPRAYYRCTMALGCPVRKQVQRCAEDKTILITTYEGHHIHALPPAAMEMVQTTSSAARMLLSGPMTSADGLMNPNYLTRAILPYSSSIATISASAPFPTVTLDLTQSPNQNQFPNNHSNQFQFPFPQNFLPQVFGQTLLNQSKFSGLQMSQDAANSSQQTPQNLADTVNAIAADPNFTAALAAAITSIIGAAQPNNNNGTSNNGNGTIANNSNGNVTSSNNTNGSPKINNPNSSVE

SEQ ID NO: 4648 - protein, 305 aa, Petroselinum crispum
MALDLMNNNSYKFRSKMEETAVQEAAAAGLQSVENLIKAISQSNHQTAYLSSSSSSETGDTDYRAVTDVAVNKFKKFISLLDKNRTGHARFRRGPVQEKTGVEMLVNPIQNQIQNHGSDGFQVYRPTAVHPVQPVQPVQIQPVQLVQPVQRLPPVPKKENISTTINFAAPAVAVAAPATSFMSSLTGDTDGSGFQITNMSGFSSGSRPVSSLKRKCSSMNDVSAKCSGSSSGRCHCPKKKKLRVKKVVRMPAISMKTSDIPPDDFSWRKYGQKPIKGSPHPRGYYKCSSVRGCPARKHVERAVDD

SEQ ID NO: 4649 - protein, 603 aa, Nicotiana tabacum
MMMFEEMGFCGDLDFFPAPLKEVEVAAPHTEPEPELVVDDDYSDEEIDMDELERRMWRDKMKLKRLKEMTKSKEGVDPAKHRQSQEQARRKKMSRAQDGILKYMLKMMEVCKAQGFVYGIIPEKGKPVGGASDNLREWWKDKVRFDRNGPAAIAKYQADHAIPGMNEGSNPVGPTPHTLQELQDTTLGSLLSALMQHCDPPQRRFPLEKGVSPPWWPTGQEDWWPQLGLQKEQGPPPYKKPHDLKKAWKVGVLTAVIKHMFPDIAKIRKLVRQSKCLQDKMTAKESATWLAIISQEEALARELYPDRCPALSSAGASGTFILDDSSEYDVEGAQDEPNFDVHEQKPNHLSLLNIGVERFKETLPLQQQSHPNKDEFITNLDFTRKRKQANELTVMMDQKIYTCEFQQCPHSELRNGFQGKSARDNHQFACPFRNSSQFGVSNFNFNEVKPVVFPQQYVQPKSASLPVNQGPPTFDLSGVGVPEDGQRMITELMSFYDSNIQGNKSQNTGNVALTKEQPHQQPRVNQDNYLHSQGIMEGNIFKDANISTSHSMLPQASPFNAGPNDNFHFMFGSPFNLQSANYTGNLPGIGYDTTPKQNLPTWY

SEQ ID NO: 4650 - protein, 538 aa, Oryza sativa Indica Group
MVVAVASPSSAPGPGAAGRPHPTYKEMILRALKELPDPIISSRRAIAKYISDNFSGLPSHHDALLTVHLRRLRSQGLLLMSGHSYLLSTSATAARGRGRGRPPKKASSSAPPQKRGPGRPRKNTALFPVPVLEAKPGRGRPRKNPLPVASSTSSAAAAATALSLRVKRGPGRPRKNAAATPLRLGVKRGPGRPRKNAAATPLRLGAKRGPGRPRKNATATPLSLGVKRGPGRPRKNAAAAASPVAPPPASPLKRGVGRPRKNATPLVKPGPGRPSGFKRGPGRPRKNATPPVLSVPPTAAAVLGVKRGRGRPRKDKPLQSWSVLSGGAAMTKRGAGRPRKKRPLEAGGVVAAQVDTADGGEAGAVQNGGEVRCLLSDGASSMGNRGPGSPRKEVLLENEPTVSTLVGKRGRGRPKKEKPSAARPAETGDAKSMGIKRGRGRPRKDSSFQAVFAEAAGQVSRDVTAAQPEGDADLLARKEPETAAVVSVENKETRPADAGGVVVSEEKTSIDPVEAGSVMPCVNAEVDRMNSDLRTANP

SEQ ID NO: 4651 - protein, 608 aa, Nicotiana tabacum
MMMFEEMGFPGNFEFMSDPLGCGGDVAQEVEHKPTGVEENYSDEEMDVDELERRMWRYRMLWRRLKEKNKNKEVGGDGAKQRQSQEQARRKKMSRAQDGILKYMLKMMEVCNAQGFVYGIIPEKGKPVTGASDNLRAWWKEKVRFDRNGPAAIAKYQADNQIPGRIEDSSVIVSTPHTLQELQDTTLGSLLSALMQHCDPPQRRFPLEKGVAPPWWPSGKEEWWGQLGLPNDQVPPPYKKPHDLKKAWKVGVLTAVIKHISPDIAKIRKLVRQSKCLQDKMTAKESATWLAIINQEEALARKLYPDSCPQGSLAVGNGSYFISDTSDYDVEGVDDERNNEVECKPHDINLLTGIMVPKERILMPALAPVKGEIIDLTSDFIQKRKHPSFEESVDQKLYTCEYLHCPYSNYQAGFLDRTSRNNHQMDCPFRFNSAQRLGMPPKYQINNENNTVFPTQTATPKPATSSVTASSSMTVSGLGLPEDGQRMISDLFTFYDNNLQQNSSICSGNSKILANQNMQQNQTVELPMDDNFNLGHMEAEAQETSMTMNSAYTSTEFQYDQCKLPFDAPFTGNLNDITDYRFGSPFNMGGSDYSMDQLTKQDISTWYL

SEQ ID NO: 4652 - protein, 254 aa, Vitis vinifera
MADFTADLQGFKTSSYPLFEADPNTGLISTQSTEQNQGFFDNPSLNFQALETFFSQQPPEFPGNLSEIFQQKVAVPMAQAEVSAGDSLCENKKRKARVDASESSSGNSSTPACESGLKRGKNVMVYSGRGKRAMKSIEKEDEKPREVVHVRARRGQATDSHSLAERVRRGKINERLRCLQDIVPGCYKTMGMAVMLDEIINYVQSLQNQVEFLSMKLTAASQYYDFNSDTDTLETIQVKLKPNSTHEILQILNI

SEQ ID NO: 4653 - protein, 131 aa, Brassica napus
  misc_feature (59)..(59): Xaa can be any naturally occurring amino acid
MLQDSPVFNFINNLSPFEPVKSFSSAQTFSSLSFTSPPPPVFASPHPIFHRESRFFRCXSVDRSKALGDGSVSKEDREVDLNKDATLEDDEEEDTETFCELPQILSSDGQGPPHHGDNIVTQTLLPSFDPP

SEQ ID NO: 4654 - protein, 340 aa, Thellungiella salsuginea
MAVYDHSGDINRTQLDTSRKRKSRSRRDGTTVAERLKIWKEYNDTVEAASTKKRKVPAKGSKKGCMKGKGGPDNGRCSFRGVRQRIWGKWVAEIREPNRGSRLWLGTFPTAEEAASAYDEAAKAMYGPSARLNFPESTVSDVTSTSSQSEVCTIEPSGDVHVKTEDADCESKPFFSDAWTMHHMEENGACGGVEEIMKDVKADANVGVTDKDWLSEYEHKYWSAVLKEREKHKEQAVADTCQQQPLDSLSVSDYGWPDDLAQGHWDSSEMFDVAELLGDLNGDIFTGLNPGNNVVSGLCELEKQQIGLQGLNSDYGLPPLQLEAQDGNELFDLSFLDMAK

SEQ ID NO: 4655 - protein, 328 aa, Vitis vinifera
MSTLSKSASSSSEEDAELRRGPWTLEEDTLLIHYIASHGEGRWNLLAKCSGLRRTGKSCRLRWLNYLKPDVKRGNLTPQEQLLILELHSKWGNRWSKIAQHLPGRTDNEIKNYWRTRVQKQARHLKIDSNSRAFQDVIRCVWMPRLLQKIEGSSSTSSTTSQVSIIPQSLNHADSQQHSAAAPPPVVAQAPVQGPLSINETINNLEHNEKNSSSENCTSPSICSSESMNISQISQIPDYPTSPFQAMSNSDDYSTLLKGYYNVDNSNYEMETFNLASMSAPQGDFENPVGDCPMVESNWVDSDLADSLWNMDELWQFWKLQEGAPRLF

SEQ ID NO: 4656 - protein, 217 aa, Euphorbia esula
MEGGSANSTCMIAFGDNSNGNGGGGGGGLSPMMMMMPLMTASSHHHQHNHHHHNADSSSNSLFLPLPSPHPPNQEHHNRNNTSTTGGSSSMILDDHNNTNSNSNTACYFMDTNTSTTASVKAKIMAHPHYHRLLAAYINCQKVGAPPEIAARLEEACASAATMGPSGTSCLGEDPALDQFMEAYCEMLTKYEQELFKPFKEAMLFLQRVESQFKALT

SEQ ID NO: 4657 - protein, 63 aa, Malus x domestica
EQVKALERNFEVENKLEPERKVKLAEELGLQPRQVAVWFQNRRARWKTKQLERDYSILKTDYD

SEQ ID NO: 4658 - protein, 378 aa, Triticum aestivum
  misc_feature (264)..(264): Xaa can be any naturally occurring amino acid
  misc_feature (346)..(346): Xaa can be any naturally occurring amino acid
GENDVGADDDEEEATPTHLLPPPRHYHQHLLQPQQLVTQELFPAAAAAGGPPPMPVPQHWAELGFFRPAAPPPDMRILQLQQQQAHAPPPPPPPAQPPVAKKSRRGPRSRSSQYRGVTFYRRTGRWESHIWDCGKQVYLGGFDTAHAAARAYDRAAIKFRGVDADINFNLSDYEDDMKQMKGLSKEEFVHVLRRQSTGFSRGSSKYRGVTLHKCGRWEARMGQFLGKKYIYLGLFDNEVEAARAYDKAAIKCNGREAVTNFEPXTYDAELLNEVAAEGADVDLNLSISQPTSQSPKRDKSSLGLQLHHGSYEGSELKRPKVDAPPEMVAIPHRYPLLTEHPPIWHXQSYPIFLNNEDAARVIAGGQSGHRGCSTGHGV

SEQ ID NO: 4659 - protein, 171 aa, Nicotiana benthamiana
DQVYGTSEGEEVGDAETIADGNDERESKRRAIEVQTSEAASSASHRAVAEPRIIVQTTSEVDLLDDGYRWRKYGQKVVKGNPYPRSYYKCTSQGCNVRKHVERAPSDPKSVITTYEGKHNHDVPAARNSSHNTANNSVSQMSPHTPVVDKQDATRRIGFSNNEQQPIALLR

SEQ ID NO: 4660 - protein, 270 aa, Tradescantia fluminensis
MGRSPCCEKAHTNKGAWTKEEDQRLIAYIKVHGEGCWRSLPKSAGLLRCGKSCRLRWINYLRPDLKRGNFTEEEDEVIIKLHALLGNKWSLIAGRLPGRTDNEIKNYWNTHIKRKLISRGIDPQTHRPVNSGAQFTISSANNQANSTKIPVNEALKQSTDSSSSQDMQSSNSVLDVVERCPDLNLDLSINIAYSTDRKPFSSSTEMQITPAATEATTPTSVSPYFQPICLCYRLGFSRTEACSCKAISNSNSQNVFRYYRPLKEEGHQTN

SEQ ID NO: 4661 - protein, 498 aa, Arabidopsis thaliana
MDNGNDQQIDVGSVVEAVSADHSFGAPLYVVESMCMRCGENGTTRFLLTLIPHFRKVLISAFECPHCGERNNEVQFAGEIQPRGCSYHLEVSAGDVKTFDRQVVKSESATIKIPELDFEIPPEAQSGSLSTVEGILSRAADELSALQEERRKVDPKTAEAIDQFLSKLRACAKAETSFTFILDDPAGNSFIENPHAPSLDPSLTIKFYERTPEQQATLGYLTNPSQTGQSERSLGTPSTQTTALPHGTIGATAGHRAIAQSNSTDISDNLFRYSAPEEVMTFPSTCGACTKLCETRMFVTSILSKLCSRSLEVIVMASTCDDCGYRNSELKPGGAIPEKGKKITLSVKNITDLSRDVIKSDTAGVKIPELDLELAGGTLGGMVTTVEGLVTQIRESLARVHGFTFGDSLEQSKINKWKEFGSRLTKLLSLEQEWTLILDDELANSFISPVTDDIKDDHQLTFEEYERSWEQNEELGLNDIDTSSADAAYESTEPTKLP

SEQ ID NO: 4662 - protein, 276 aa, Tradescantia fluminensis
MGRSPCCEKAHTNKGAWTKEEDQRLIAHIKAHGEGCWRSLPKAAGLLRCGKSCRLRWINYLRPDLKRGNFSEEEDELIIKLHAMLGNKWSLIAGQLPGRTDNEIKNYWNTHIKRKLVSRGIDPQTHRRMNNTEHCEVSSPQHDTKSVVLDETRKLQSTDQSSETSGVTIADNFEHQLPDLNLELTISLNNSSYHYSSSSKKSSTALQGVLKPSNSVVSASAEEAVREKSSCAQVICLCYQLGFQSAEGCNCKSISANYQQVFKYHNPLFKEEQQIN

SEQ ID NO: 4663 - protein, 766 aa, Ostreococcus tauri
MTTVKDRAQIQRGDGKGCNCKNSRCLKLYCECFAAGALCASARCRCANCMNTVEHAGERTAAIETVLDRNPNAFRPKIAAVASPSRDVALRHNRGCHCKRSGCLKKYCECFQAAIYCAETCRCVSCENYEGSDAHEEVKRVYGSGARFHDHASAAASPSPSRRKLLAQRAARDSIDGAGAGLARARAPPLMHNLVQQGAVEELARILLVVADETKKALELIDKAKSTKRLDLSGLGLRALPVEALELTELLELQVSNNNLYDLPSEMFERCTKIERLGLAGNRLRRLPKSVGNLKSLRGVWAHGNCLRTIPREIGACESLRNLVLGGNYLAELPEEIEKLKNLEELSAPGNRLRAIPDLGSMPLLREIDLHGNFIERLPEDMSGLRALETLSLQGNRVREVPKSLTKLRRLRALNLAENAMTTLPDEIADMTMLTSVWLYSNALTSLPGTSVRKMPSIRQIWIEGNDGLSGESLDAFVAAVDGSKTLKTLGVDSRQAGKMRTRGAAIVATAEIPENNPRGYFKLVRWPKGDGSTRAPVLVVSFGSAPGVPNWGGLLKKLQKNVRDGDSYDVLYVCDVDRSWYASSDASGDQELEFERWSAPLREACEKYERVLYVGDSMGASAALMFAEHATKVLAFCPQVDLYDASIRPSRSNVWFKRFKGVMMSGLNQSTADIDVHTGSWDHDKDQAALLPRDKVKHIVHQVDSHRLALALDGEEKLLPIIKSAFESELTAARGGGSAEESSSSSSSSSASLNAFAPWQSLGLK

SEQ ID NO: 4664 - protein, 312 aa, Vitis vinifera
MAATRKDADRIKGPWSPEEDDALQKLVQKHGPRNWSLISKSIPGRSGKSCRLRWCNQLSPQVEHRAFTSEEDDTIMRAHARFGNKWATIARLLSGRTDNAIKNHWNSTLKRKCSAITEDGSFGGDYPPHPLKRSVSAGAAAPVSGLYLSPSSPCGSDVSDSSLPVVSSSHVYRPVARTGGIIPPETTSSSNDPPTSLSLSLPGVDSCEVSNRAPEPNHAPPANPIQMIPTMAPLQQIPMHQHNQPATVPATVLSQGEKPFIPFSAELLAVMQEMIRKEVRNYTAGLEQNGVCLQADGIRNAAVKRIGISKIE

SEQ ID NO: 4665 - protein, 237 aa, Triticum aestivum
MVTVREETRKGPWTEQEDMQLVCTVRLFGERRWDFIAKVSGLNRTGKSCRLRWVNYLHPGLKRGRMTPHEERLILELHARWGNRWSRIARKLPGRTDNEIKNYWRTHMRKKAQERKRNMSPSSSSSSVTYQSIQPQTPSIMGIGEQELHGGSSCITSILKGTPADMDGYLMDQIWMEIEAPSGVNFHDGKDNSYSSPSGPLLPSPMWDYYSPEAGWKMDEIKMAPQVSYSKGIGPSY

SEQ ID NO: 4666 - protein, 368 aa, Populus tomentosa
MEDYNQMSENTTPRGNFLYASQLLAPNSSPYGRTSSGSTVSNQQTQMPLNPFHLQSNDQCFQSDTHPIVKTEASTSHAQKFHYPLLRGYQTINQQQQGSESSSEVEAIKAKIIAHPQYSNLLEAYMDCQKVGAPPEVVARLAAARQEFESRQRSFITSRDNSKDPELDQFMEAYCDMLVKYREELTRPIQEAMDFMRRIETQLNMICHGPLRIFNSDDKSEGVGSSEDDQDNSGGETELPEIDPRAEDRELKNHLLRKYSGYLGSLKQELSKKKKKGKLPKEARQKLLSWWELHYKWPYPSETEKVALAETTGLDQKQINNWFINQRKRHWKPSEDMQFMVMDGLHPQNAALYMDGHYMGDGHYRLGP

SEQ ID NO: 4667 - protein, 154 aa, Zea mays
ADLPAGRGGGAPLPADLLQQRGHLRRRAHLAALDVERSRPPAGSDLTELVKAQIAGHPRYPSLLSAYIECRKVGAPPEVATLLEEIGRERCAAASAGGEVGLDPELDEFMEAYCRVLERYKEELSRPFDEAASFLSSVRTQLSSLCGAAASLSG

SEQ ID NO: 4668 - protein, 638 aa, Oryza sativa Japonica Group
MVLQKRLDYGSHGHRAPIKPRVATLAPVKRSTRIRKKQMYALDLLATAAEKLLADQDNLSSGPNINETPEGYVTSMKPVKAEQFDEAFPLRSVAVKKDDCKGCTVGCAGICGFLRQANMCLAENSSTQNLADSVLESLTAKPDVLAKDSFVSSKKSCRLGFGLGTIPEYGSVGVCQPWSTRSAEVKQVHRARPTAIRSQEDSDAAALCALVETMDLDTKPLAEASSGSNSGVHICGPDRGHNSHPSCLAKVQHAADRDDDENSSGCVHPSTSGNNRGYIPHYIGDRRIRRLFASRLRKAARNRICGEMSCKGNKLSLCEKKMPTTRRRVQQTTLKRKRLAQLYSEKSSDEVKLTIKSFNIPELLIEIPENATVGSLKKTVSDAVTTIIERGLRVGILLQGKNIQNDNKTLRQAGICRGKKLNDIGFTLECEAGQDSHPGVIVPEEMDFVGASVVDKSATVKCEEPAENQQLMQDFPGCSLSDPGSVDYPVEWSTQETSASSQAIVPFADPNSLALANVPLSRSKRPDFGQRRIRRPFTVAEVELLVEAVEHLGTGRWRDVKFRAFENVHHRTYVDLKDKWKTVVHTASIAPQQRRGAPVPQELLDRVLAAQATGRSSRQSSMAIPLFLKSALPDPDDD

SEQ ID NO: 4669 - protein, 193 aa, Arabidopsis thaliana
MRPSDAGKAPYVARVEKIEADARNNVKVHCRWYYCPEESHGGRRQLHGAKELFLSDHFDVQSAHTIEGKCIVHTFKNYTRLENVGVEDYYCIFDYKAATGAFTPDRVAVYYKCEMPYNSDELMELLLCHYRVHLACVGVTIEEAKKLEHFVCVECSSDEDGVKRFQNGFASSTTNDLKPSAEKMIDVRASYEL

SEQ ID NO: 4670 - protein, 644 aa, Oryza sativa
  misc_feature (425)..(425): Xaa can be any naturally occurring amino acid
  misc_feature (442)..(442): Xaa can be any naturally occurring amino acid
MTNSNNGNGGTNAAASGWLGFSLSPHMASSTMDEHHHVHHHQQQQQQQQQQQHHQQQQHGLFFPSVTTAAAAAAYGLAGDVVAATNGYYSQLASMPLKSDGSLCIMEALRRTDQDHHGPKLEDFLGAAQPAMALSLDNTSSFYYGGGGAAAAGHGQHGYLQACDLYGGPAAPSLVTAADEEAAAAAAAMASWVAARGAATAYATGAADANAAENVLPSATAAQHLHHPLALSMSSGSLSSCITAGEYGMAAVAAADGGRKRGGAGGGGQKQPVHHRKSIDTFGQRTSQYRGVTRHRWTGRYEAHLWDNSCKKEGQTRKGRQVYLGGYDMEEKAARAYDLAALKYWGPSTHINFPLEDYQEELEEMKNMTRQEYVAHLRRKSSDPRADASMYRGVTRHHQHGRWQARIGRVSGNKDLYLGTFSTQXSEAADAYDVAAIKFRGXLNAVTNFDITRYDVDKIMASNTLLPADLARRNAATTTSKDDHSAAGAGAIVSVHSAADIAVADTLWKATTAPRQQQQHHDDVVLSGADQAAFSVLHDLVAVDAAAAHQQQQQQQHMSMSAASSLVTSLSNSREGSPDRGGGLSMLFAKPSPAVAASAQQQASTKLMAAPLPLGSWVSSPPASARPPAVSIAHMPLFAAWTDA

SEQ ID NO: 4671 - protein, 386 aa, Physcomitrella patens subsp. patens
MNSSQPPAEGTRPAPASAPAPVLPMPSALVMSMGMALGGVSSRGETVKRKRGRPRKYVGNEPGGAASAAGGTPVNMQLALHTPNSGPSGSPFTPTGVKRGRGRPLGSSRKLHQLVSFPSAGSWAGQNFTPHIITIAAGEDIAAKIYSFAQHGPRAVCVMSANGAISTAILRQQSSSGGNVTYEGRYEILSLMGSFLPTEQGANSRQRTGGLSVSLACSDGRVIGGGVAGVLTAASPIQVVVGSFIFEPEKAAVKVGNGQQPSMGYSLGADFSAALTPASAPRPLKTSPVSATPGSGFAVNPSLRQLSLVSRQYSRDCSSSSETCVTAASTPAHQQAVTPPSHPSSGQSSQQLFHQSMGLFQQPMPWSNPPLAEARRTDINISLPGG

SEQ ID NO: 4672 - protein, 418 aa, Oryza sativa Indica Group
MSGGGGGGEGFPFHDELASLFAERPPNGAMPGMLQQQQPWSFIDYHHHLMQESAPTTPPLDYEAFAGEFDDDVAPLEEVKRELVVDGVGLFPGGGASAAAAAAAVAGPMTPNSMSVSSTSSEACGVGGGAGGDEESAGKCKKEEEGDGGDDDGKEGSSTTKGDGDGEDKNKKGGKGKGKGEKRPRQPRFAFMTKSEVDHLEDGYRWRKYGQKAVKNSPFPRSYYRCTTQKCPVKKRVERSYQDAAVVITTYEGKHTHPIPATLRGTAHLLGAAAAAHHHGGLQYHHPGHFAAAVGHRLPPQPHDALGGGLLAPPHAQHLHAMQHQMQLAAAAASGGSLHAAAMQQMPQPDHAGLAAIIASTTGASTTPAPPPATGSAAAAATPLRMQHFMAQDYGLLQDMFIPSPFLHNDDANNNNHR

SEQ ID NO: 4673 - protein, 331 aa, Arabidopsis thaliana
  misc_feature (111)..(111): Xaa can be any naturally occurring amino acid
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGXALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 4674 - protein, 455 aa, Zea mays
MQFTHTAPPPPPLHPNGHAAGVLGLGLFLDVGAPTAARPCPGSFPTPASKISLGNDLNSTSCMEQLLVHCANAIEANDATLTQQILWVLNNIAPPDGDSNQRLTAAFLCALVARASRTGACKAVTAAVAAESAALHVHRFTAVELAGFVDLTPWHRFGYTAANAAILEAAEGFPVVHVVELGTTHCMQIPTLIDMLATRAEGPPILRLTVADVAPCAPPPALDMSYEELGAKLVNFARSRNVSMDFRVVPTTPADAFTSLVDQLRVQQLVLDGSEALVVNFHMLLHTVPDETAGSVGLTQPVSLRTMLLKSLRTLDPNLVVVVEEDADFTAGDVVGRLRAAFNFLWIPYDAVDTFLPKGSEQRRWYEAEIGWKVENVLAQEGVERVERQEDRGRWGQRMRSAGFRALAFGEEAAGEVKAMLNEHAAGWGMKREDDDLVLTWKGHNVVFASAWAPS

SEQ ID NO: 4675 - protein, 417 aa, Arabidopsis thaliana
MMKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 4676 - protein, 428 aa, Arabidopsis thaliana
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQPMEMLRFSSPAGQQSQQPSSVPTKTTDGSRLDH

SEQ ID NO: 4677 - protein, 1160 aa, Oryza sativa Japonica Group
MVAINLPITNSIFLPTTTRRDEDEEEEQELGLGGGDLLRPQIGSPTSSRPRSRTPRRLHLCRAESLSWSRRRRRRGPVVGAPQIAPLPWPSGSHPQIQHPGIVRLGTALRGTRAARVAVARAIVMMTSDNGKAPEKGGEASGPSSAPQEGEISNEPQRRRPLSGRTTGPTRRSTKGNWTPEEDSILSRAVQTYKGKNWKKIAECFPDRTDVQCLHRWQKVLNPELVKGPWSKEEDDIIVQMVNKLGPKKWSTIAQALPGRIGKQCRERWHNHLNPGINKEAWTQEEEITLIHAHRMYGNKWAELTKFLPGRTDNAIKNHWNSSVKKKVDSYMSSGLLTQVSCLPLNEYSAHCNSSPALTQQNSEDSGSYAVREVENSSVCSQSSLAKVSCSQVHNANVALGCDLQVNANVDNNEAHDSQSSVGHEACYTSVGAVATAIPEVHYHVSSSNFDPDQHLQEEFAQGLNLHMSMDEVPSNSSFADNPTICSIENHERSLEPYDVAMEMPLSMLPSDSGAEQKLHFMSEADFNSPNCLKSELWQDISLQSLLSGPDAVETDSFSRSNHQSDVYSSQADNEFLAPPYLLQTSNSSSVMEATYGQSPQMSVPPSLICSNVMTDVPSDNRSEPKEMTVSQAEMVTQSSSSSGDAEMSANPGSSNGSDIPSMMERIPECADQHVTNAEEPEASIEKEPSVTPSATADEKQDEGALFYEPPRFPSMDVPFVSCDLVTSGDLQEYSPLGIRQLMRSTMNVCTPMRLWGSPTHDESPDILLKSAAKSFICTPSILKKRHRDLVSPIPDKRIEKKSGTEKDCGVSDTSSIGIQTCFINATKDDAVITKSVLRIERSASSKPLEKKLEFSDENKENLDNTIEQAKDGQSAGNYKHIDEQARGERRTATNITTTYDDLPGNLQPAGILIEHNGDDLVSPDYGKNTMKQKQNTNMESLSVCKEGVSAKKPAELIVEKSSACINVDYEYVNILADTPGIKRGLESPSAWKSPWFVDMQFQGSYFVSPANGSYDALGLVKQINVQTAAALAEAREVLASGGQSENINSDKENLENPDAKKEPGATTKLQAKIKLGSGADGRWEKRPGEGGSGRQGREGEVASGAAAAVRMLHARLGAGLAVGRAGSVAECGGGTTVGGGDRGPELVEVELEKRAAATA

SEQ ID NO: 4678 - protein, 154 aa, Brassica napus
MNWLPEGEFKGLSDNFFDDFINHIDFPLEDIDTTNGEGGDWDAKFKELEPPPMDMFTTFPSEFNSCGVASKAGIKKNVSVLSDASAALSGINDTLHQSSSHHDVKVSKLFQSSSPVSVLESSDGSFSPPNSTSLRLTFPVKGLRSKRKRPTTLR

SEQ ID NO: 4679 - protein, 313 aa, Glycine max
TQFSRHTQSEYVFFFSGAEFGTRQNEVLESEETFFLKKEPSSNTQRELLVKVDGKSTDQKPNTPRSKHSATEQRRRSKINDRFQMLRELIPHSDQKRDKASFLLEVIEYIHFLQEKVHKYERPFQGWSNEPERLMPWRNNDKPAETFQPRGTDNGSSPSPTLLFASKVDEKNITISQTIPGSTQNVESGLSSATTPKTMDHHAGMMNKAFPIPIPSQLNFFTPTQIGGPGGVVSQLTHRSASDAEKTKYQPSVECQTMTATNEKLKEKELTIEGGAISISSVYSKGLLHTLTHALQSSGVDLSQASISVQIEL

SEQ ID NO: 4680 - protein, 182 aa, Vitis vinifera
MATEEPNNPPQPPSSIPQYSEMIMAAIEALNDKSGSNKSSISKYIESTYGDLPAAHSTLLAHHLNKMKQSGDLVMVKNNYMKPDPNAPPRRGRGRPPKPKVPLPPGTVLAPPRPRGRPPKPRDPFAPVSPPKKASSGSGKPRGRPPKKPKVGTSSAPAPATGAPRPRGRPPKVKPAVVPVGC

SEQ ID NO: 4681 - protein, 509 aa, Oryza sativa Indica Group
MALSTLLLPSSSSSSKTVTATDTSDRRRHHHHHNHTKRKKKPPPPPLSPTPRTPPPAGSGSHRAMAASSKKSTKQVVAAKTTTGHRPKKAAAAPTTPSRGAPSASAAPVSSSWEQLKSLLSCRSATSAARVHDPAAPSSALSRLRSHGAGACGASLCAIRDVVDAASSASAASTAAASLDRDTTPLTRSSRRAHRAATSSSGGGGGHHASLRGLSGCYECRAINVEPMSRRYPRPRELCACSQCGEVFTKADSLEHHQAIRHAVKIGWQKYIKRYLCLAIFCMLAVASASPFVEVSELGPEDSGRNIVEIIFKSSWQKRDRPICQIDRILKVHNAARTVARFEAYRDAVRTRCRATDARAAADGNELLRFHPAALACPLGLNGATSLCDDDDACGVCAAIRHGFAPWAGAHPLGVRTTASSGRAHDCGAAAVAAQQAGGCRAMLVCRVIAGRVRRNDDDGGAEEEEGAFDSVAGDEAASSVYGNLEELFVANPRAILPCFVVIYRVVPE

SEQ ID NO: 4682 - protein, 291 aa, Brassica napus
  misc_feature (187)..(187): Xaa can be any naturally occurring amino acid
MGAPKQKWTQEEESALRSGVIKHGPGKWRTILKDPDFSEVLFLRSNVDLKDKWRNMSVIANGWGSREKSRLAVKRTHSLPKQEATSLANTSPLQSDEEMADATGTSAPNVRLDSLIMEAISTIKEPGGSNKTSIGTYIEEQYHAPPDFKRLLSAKLKYLTARRQLIKVKRKYRIPDSTALSSHRRNXLGTSSGKQRSLSLPSPKTDRDEVNVQTKAQIDAELARMKTMNAHEAQAAAEQAVEEAEAAMAAAEEAAKEAEAAEAEAEEAQAYVEEALKTVKGRNNCKMMVCT

SEQ ID NO: 4683 - protein, 360 aa, Oryza sativa Japonica Group
MRLARQQQQVVVAATMEHDVHHHRQMMQQQQQQEMDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKDQEWVLCRVFKKSLELAPAAAAAVGRRGAGAGTDVGPSSMPMADDVVGLAPCALPPARDLLLQRAGGPVPGHTVPPPRRRSRGSPRHVLRLAVLGGPADAVRPGRRRRRRSGHGARAAHGRRLVLQQGREGEAERRLAGHRPHVVGGEPRRDLVVVAAATHGSSRRVPLGLLKYSFIIIENCISHYY

SEQ ID NO: 4684 - protein, 79 aa, Brassica napus
MAAGGSKVHGGLSMQVSWRLEESKFMAAGGANMHYFDLSIRLKTDHEHLFRNIQRNEYNNLYSFISSKGLKITNLGGAA

SEQ ID NO: 4685 - protein, 268 aa, Tradescantia fluminensis
MGRSPCCEKAHTNKGAWTKEEDQRLIAYIKVHGEGCWRSLPKAAGLLRCGKSCRLRWINYLRPDLKRGNFTEEEDELIIKLHALLGNKWSLIAGRLPGRTDNEIKNYWNTHIKRKLISRGIDPQTHRPINAGSQFTISSANHQGSLKNIRDNEALKQSPNSSSQDMQSNSSVIDVVERCPDLNLDIAINIAYSTDQKPFSSSTEVQKAPAVTQATTPTSVSPYFQPICLCYNLGFSKSEACSCRASSNDNQHVLRYYRPLIEEGHQTN

SEQ ID NO: 4686 - protein, 185 aa, Zea mays
MESMAQERDALDSPALSIDKRLRSDAVESPLVDDATQPKEGADGYPVKVRKPYTITKQREKWTEEEHGKFLEALKLYGRSWRQIQEHIGTKTAVQIRSHAQKFFSKVVREPGASNSIEIPPPRPKRKPLHPYPRKCADSTVTNAPMGEPKNAPVSSPSGSDQENGSPVSVLSAMQSDAFGSSISN

SEQ ID NO: 4687 - protein, 458 aa, Vitis vinifera
  misc_feature (20)..(21): Xaa can be any naturally occurring amino acid
  misc_feature (39)..(40): Xaa can be any naturally occurring amino acid
  misc_feature (310)..(310): Xaa can be any naturally occurring amino acid
  misc_feature (418)..(418): Xaa can be any naturally occurring amino acid
MAGIETNLSGLQYRDVKIIXXAAMKAELRGNPPPISLQXXSLFNTPQNSLSGALRGCLGSLDGACIEKLLLHCASALESNDVTLAQQVMWVLNNVASSMGDPNQRLASWFLRALISRASRVCPTTAMNFSGSSGLQRRLMTVTELAEYVDLIPWHRFGFCAANSTIFNAIQGCPRVHILDFSITHCMQWPTLIDALAKRPEGPPSLRITVPSFRPPVPPLLNVSSEEVGLRLANFAKFRDVPFEFNVIEDSSSSTMGEMISRESSSLYSESLLNHLNPSMLDLRDDEALVVNCQNWLRYLPDDQKGRAQXVSLRDTFPRIVVDEDADLGASSLTSRITTCFNYFWIPFDALETFLPKDNHQRIEYEADIGHKIEDIITYEGLQRIERLESGPKLSQRMKSSGFLSIPFCEETVREVKXLLDEHASGWGMKREEDMLVLTWKGHNSIFATAWFPSGLED

SEQ ID NO: 4688 - protein, 841 aa, Oryza sativa Japonica Group
MAAAATAAASPVEGLTGGGGGGGGGVDGLFVELWRACAGPLVTVPAVGERVFYLPQGHIEQVEASTNQVAEQQGAPLYNLPWKIPCKVMNVELKAEPDTDEVYAQLTLLPEKQQDGNGSGNGNVSKDKVEEEEVVPPAATERPRVHSFCKTLTASDTSTHGGFSVLRRHADECLPPLDMSQHPPTQELVAKDLHGVEWRFRHIFRGQPRRHLLQSGWSVFVSAKRLVAGDAFIFLRGENGELRVGVRRAMRQQANIPSSVISSHSMHLGVLATAWHAVNTGTMFTVYYKPRTSPSEFVVPRDLYKESLKRNHSIGMRFKMTFEGEEAAEQRFTGTIVGVGDSDPSGWADSKWRSLKVRWDEAASVPRPDRVSPWQIEPANSPSPVNPLPAPRTKRARPNVLASSPDLSAVNKEVASKVMANSQQNGLPRAFHSQENMNLRSRFGDSNELNTSQKLTMWSSGSNQEKNNVSVQRELGSQSWMQMRRPDGSSEILSGFQPLKDTRNPLSSFPSQISGNRSNTWNTINVHYPDQNANHNMYPGTWSLMPPNTGFGVNQQNYLMTPDITLPQRSLNAKFGGNGAFTSLRAHGIDQRSSGWLGHIEPSSHIDDASSSLIKPQPLVIDHNVQKAKGSSCMLFGISLDSPAKPELLISPPSVAFDGKLQQDALEEDECSDPSKTVKPLDGAQHDSAREKHQSCPDGTKNIQSKQQNGSSRSCKKVHKQGIALGRSIDLTKFTCYDELIAELDQMFDFNGELNSSSKNWMVVYTDNEGDMMLVGDDPWNEFCNMVHKIFIYTREEVQKMNPGALNSRSEDSRSTSVERGLVGEGLQGGLSTPSLNSENC

SEQ ID NO: 4689 - protein, 302 aa, Zea mays
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPTKRVSLSPDSPSGSGSGSGSGSGSDRSDLSHGAGQVYRPVARSGGFEPADCAMSRPLEEEEEEKEDPLTSLSLSLPGTDQRFHHDRAHSQFQELPASPPSPSPPPPPAGPTSAYPFSPVFMEAMQELIRTEVQRYMASVGVRAGCGAAGGADLCMPQLVDGVMRAAAERVGRMQ

SEQ ID NO: 4690 - protein, 244 aa, Eucalyptus globulus
MGRGRLQLKRIENKINRQITFSKRRAGLLKKAHEISVLCDAEVALIVFSAKGKLFEYSTDSCMERILERYERYSYAEHQVLASETESIGSWTLEHAKLKARLEVLHRNYRHFMGEDLDSLSLKDLQNLEQQLESALKHIRSRKNQLMHESISVLQKKDRALQEQNNLLTKKIKEKERALAQQAQWEQQDHALDSPVVLPHYLPSLDINGSYQARHNGHDDGENLTQPRAGTLLPPWISASQLRL

SEQ ID NO: 4691 - protein, 413 aa, Zea mays
MTSAGAATGAALGARTARSCDGCMRRRARWHCPADDAFLCQTCDVSVHSANPLARRHHRVRLPSASCSSPPRDPDAPTWLHGLKRRPRTPRSKPGGSKSNKHEATPSFIAAAASSAAVPDLEAEESGSGILGGNDDHHGFLQDDDEDLLYRVPVFDPMLAEFYNPVADEGEQKPACSLLMPSLAETSPEFASGGSAEADGLSVSFHVPDMELASFAADMESLLMGVDDDGFDCLGFLDEEKPQVNADLDAIVAPAPEPEDKKRKRPEMILKLNYEGVIASWVRDGGSPWFHGERPHLDCHELWSDDFTTGSRELLGGAVTPVTGGEREARVSRYREKRRTRLFAKKIRYEVRKLNAEKRPRMKGRFVKRATLPPLPRPPPPQQQQQQKQLPRAPPHVGMVLPPPPVSNGRLWF

SEQ ID NO: 4692 - protein, 426 aa, Zea mays
MEQELRTGGRGGGNLRAHSSACLSGALIDGPRIQQLLLHCAAALESNDVTLAQQAMWVLNNIASSQGDPSQRLTSWLLRALVARACRLCAPPGSTTQSAAAAAAARTPAPRERAMSVTELAEYVDLMPWHRFGFTASNGAILRAVVGSAAVHVVDLSVTRCMQWPTLIDMLSKRPGGPPELRITVPSARPAVPPQLGVSDAEIGLRLANFAKSKGVQLHFSVVEGVTSPPPEKQAAALCQDLASVLSDRQALGLRDGEALVVNCQSWIRHVAPGSRDAFLGAVRALNPCLVTVTDEDADLDSPSLATRIAGCFDFHWILFDALDTSAPRDSPRRAEHEAAVGRKIEGVVGADDADGAERSESGARLAERMRRNGFVSVAFDEEAAGEVRRLLSEHATGWGMKREEDMLVLTWKGHGAVYTSAWMPN

SEQ ID NO: 4693 - protein, 420 aa, Triticum aestivum
  misc_feature (78)..(78): Xaa can be any naturally occurring amino acid
MGGSDQKAAGGAVGGKAARACDGCMRRRARWYCAADDAFLCQACDTSVHSANPLARRHERLRLRATSPLPAEGVAAVXGVVWGATTSKCLDVAPAWPKRKARTRRPPVKSVGQLLSRRLVVPEVGAGESSTSDERRAPEEEQLLYRVPVFDPALAEFCSPPPIDDSRHGEDVEGAVEDTKEHMATPSPVQELPDCFASFGPTDADLREFAADMEALLGQGLDDGNELEDSFYMEALGLISPPGEHGGRVKVEADGSLVSRSNGVLASGHDLKREFNGSPPTLVDDDDSFEHKTSTASNGDAVDDAQFLKRSLDLRLNYEAVMESWGSSPWTDGRRPSGQLDDLLLHDHAGMWTAGGGGRHGDAAWPPRPRTDEWREARVSRYREKRRTRLFAKKIRYEVRKLNAEKRPRMKGRFVKRTGG

SEQ ID NO: 4694 - protein, 212 aa, Oryza sativa Japonica Group
MGFPVCCYPSCCSPKQLLHLLLLLGYIRRFLLWAFHAVGLGDLLDLGDEQQAVLQDHAREHRAPAQALPPQQQHRRAEFRTVPAMVIEEVLPVVRFDELVAAAPAVCGGGDCAVCLSGIGGGDEVRRLSNCRHVFHRGCLDRWMEHDDQRTCPLCRAPLIPDEMASALWAAAGVPDASDFDFSYFGAPLTPMPTPTLLRPHELLLTGLGGYQ

SEQ ID NO: 4695 - protein, 176 aa, Oryza sativa Japonica Group
MGFPSVCYCVILPQPLVLVLQLLDLLRHAFLLCLSALGLAAPPLPDEHPAYAPPPPPPASMAALPADLVWAFQPAPEPAAIKARLPAVRYADFVRCRRAAAAAAASCVVCLGALEARHRVRELGNCAHAFHKACIDKWVDKGQATCPLCRAALLPSADDADAAAIAATTRHHLPSF

SEQ ID NO: 4696 - protein, 264 aa, Physcomitrella patens subsp. patens
MATACLQGPQGQVQSQHGEPFLPPGFRFHPTDEELVSYYLTNKVLDSSFAVHAIAEVDLNKCEPWDLPEKAKMGEKEWYFFSLRDRKYPTGIRTNRATDAGYWKATGKDRDVFAHGRPPLVGMKKTLVFYRGRAPKGEKTSWIMHEYRLEGDGGHSLSPRVNKDEWVVCRIFQKNSGGKGSFLFSDSCMRSHAVMYQIEDTRSSLPPVMNNNSPNPTVTDGGTCTDCETCAGTEQMPACYNCVDDFDHGKETNSVMSWINAQST

SEQ ID NO: 4697 - protein, 252 aa, Physcomitrella patens subsp. patens
GKLALAAGIASANPAPQMDAPPQSSGPPPFLIKTYEMVEVSATDAIVSWSEVGNSFVVWNPPEFAQDLLPKYFKHNNFSSFVRQLNTYGFRKVDPDRWEFANEGFMRGKRDMLRSIRRRKPAVHTQQQQGSCVEVGKLGLEGEIERLKRDKNVLMLELVRLRQQQQSTERELQVMTQRFHVSEHRQQRMISFLTKAMQNPSFFAQFVSQQNENNQVVRKKRRLPIHEYGDMHESMSPESSIENQMVAFQPSE

SEQ ID NO: 4698 - protein, 250 aa, Oryza sativa Japonica Group
MAGGGGGGGRGEGEGRAATGKRERIAIRRIDNLAARQVTFSKRRRGLFKKAEELSILCDAEVGLVVFSATGKLFQFASTSMEQIIDRYNSHSKTLQRAEPSQLDLQGEDSSTCARLKEELAETSLRLRQMRGEELHRLNVEQLQELEKSLESGLGSVLKTKSKKILDEIDGLERKRMQLIEENLRLKEQLQVSRMSRMEEMQPGPDSEIVYEEGQSSESVTNASYPRPPPDNDYSSDTSLRLGLSLFSSK

SEQ ID NO: 4699 - protein, 154 aa, Cicer arietinum
IAPTTRHYRSVSMDSFIGKLNFNDESSKLPPSPGLMSPGNSVDGNSAAAFSLEFGNGEFSGPELKKIMANEKLAEIAMADPKRAKRILANRQSAARSKERKMRYISELEHKVQTLQTEATTLSAQLTLLQRDSVGLTNQNSELKFRLQSMEQQA

SEQ ID NO: 4700 - protein, 370 aa, Zea mays
  misc_feature (23)..(23): Xaa can be any naturally occurring amino acid
MEEERCFNNWDLDAVVRLGCRRXSPRAPQPDPFASFLPPPPQKEKPVAPAPAKEPEPHTAWRFPDLGAGGGQDGEELLRALLADQPPLHQPLPTPAATPTPTPTATPPPPSQQQHLQPTVTAVDVAPPQVRPAPARAQPSGRQVPGGVPRSKRRKNQVKKVVCHVPADGSSPDVWAWRKYGQKPIKGSPYPRGYYRCSSSKGCAARKQVERSRADPNTFILTFTGEHNHAAPTHRNSLAGTTRHKFPSSAAPQPPPPSVVVGGDAQDRQPSPSPTSTSTAGLSPTTPLRTPSMEEEEEEEEEEEEEDELLVEDMEMAGEDELLFLSTDADAGAPTSSLFDVVGEPFLSPPWVTAASSAGEPATGAAGAGS

SEQ ID NO: 4701 - protein, 213 aa, Physcomitrella patens subsp. patens
MAKPKNGKKTLDSCVIKGTRKIVKVGDTVLMRSEDPDKPPYIAKVENIEGDSRGNVKVQVRWYYRPEESMSGRKQFHGQKEVFLSDHYDVQSADTIEGKCIVHSFKNYTKLEAVSAEDYFCRFEYKATTGGFTPDRVAVYCKCEMPYNPDHVMLECNSCKDWFHRHCVGLSEEQVKHVDRYICPGCAPETVKKSNGPSHMTPDAKPEPKRQRR

SEQ ID NO: 4702 - protein, 310 aa, Brassica rapa subsp. pekinensis
MMKRLSSSDSVGGLISLCPTTSTDQPSPRRYGREFQSMLEGYEEEEEEAVTEERGQTGLAEKKRRLSINQVKALEKNFELENKLEPERKVKLALELGLQPRQVAVWFQNRRARWKTKQLEKDYGVLKTQYDSLRHNFDSLRRDNESLLQEIGKLKAKLNGEEEVEKMMKMENNAVTMECDVSVKEEEVSLPEELTDPPSSPPQALEHSDSFNYRSFTDLRDLLSLKAAASSVAAAGSSDSSDSRAVLNEESSSNVTAGPVTVPQGGFLQFVKMEQTEDHDDFLSGEEACGFFSEEQPPSLHWYSTVDQWN

SEQ ID NO: 4703 - protein, 361 aa, Triticum aestivum
  misc_feature (116)..(116): Xaa can be any naturally occurring amino acid
  misc_feature (194)..(194): Xaa can be any naturally occurring amino acid
MGVEILSSTGEPSSQYSSGAVSTATTESGIGGRPPTAPSLPVAIADESVTSRSAPAQSASSRFKGVVSQPNGRWGAQIYERHARVWLGTFPDYDCRTSAARAYDVAALRYRGREAXATNFPCAAAEAELAFLGAHSKAEIVDMLRKHTYADELRQGLRRGRGMGARAQPTPSWAREPLFEKAVTPSDVGKLNRXLVVPKQHAEKHFPLKRTPETTTTTGKGVLLNFEDGEGKVWRFRYSYWNSSQSYVLTKGWSRFVREKGLGAGDSIVFSCSAYGQEKQFFIDCKKNKTMASCPADGGAATASPPVAEAANGEQVRVVRLFGVDIAGEKRGRAAPAEQELFKRQCVAHSQHSPALGAIVL

SEQ ID NO: 4704 - protein, 266 aa, Zea mays
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAVASRQQQVQWDQQTHAQAQTSSSSSSFMMRQDQQGLPPPHNICFPPLTMGDRGEELAAAAQQQPLPGQAQPQLRIAGLPPWMLSHLNA

SEQ ID NO: 4705 - protein, 287 aa, Arabidopsis thaliana
MKSFVKPERDSLLRTVRIVFTDPDATDDSSSSSDEWLPKPRKVKRFVHEITFLPQVSESSQDRSNAVKTPRRKSTRQFKYPVGVRPRPSGKFAAEILNPFTKTKKWLGTYETPAEAEKAYVDKKVEYDALASSGSAVSSSVVTVTSQCLRSPTSASVSCVSADDLSKEKTSLNKDVAASGDSTTKEVFTTFDFSDVKIPDLRFLAAEEDSMVSNANGAELDFDCFLTDSNILLDDYSLLENDINFSRFENSLPSELPDCDFTEMEFQLDDFKFAYTDHLTTPPLGLV

SEQ ID NO: 4706 - protein, 241 aa, Glycine max
MEKDIIHLSPTWDGDNGNSTEKRLRLFGFELNPSKDGYAKESGEGDESVNSSNSVSSGGDKTVQEKPSAKDSDERKFECQYCYKEFANSQALGGHQNAHKKERMKKKRLQLQSINRYLQHPFQSKHGFAHPSDTPWFYDPSTYNNSEFTLSEEPQISFNSNVLDANFSCDQKSSWYSLASHPSNSQQDTCMFTFSNASNNSPFIFKPCHFPASNQSHKSKALDLQLGLNLQSNTRSSLRRM

SEQ ID NO: 4707 - protein, 309 aa, Oryza sativa Japonica Group
MEYSNDWDLQALVRSCGTAVADSEPEPPAAPSTTRRAEAETVFVGRAGGVPEFVGQPVRSSAASFYDLEYLDLYHERPRAPFLVTAPSTSRERGEGGEHEVLISFPAIASTSGQGRKQPGRKPGVRTARPKRSKKSQLKKVVCEVPVADGGVSTDLWAWRKYGQKPIKGSPYPRGYYKCSSLKACMARKMVERSPEKPGVLVITYIAEHCHAVPTQLNSLAGTTRNNKPASPDQQQQQQPSPGGASTDEAAAAAAKTEDSADTTCSMADDENDLWAPVEMDMNDFFGPFDDDLDHFLDDDAVLGRRLSL

SEQ ID NO: 4708 - protein, 585 aa, Zea mays
  misc_feature (201)..(201): Xaa can be any naturally occurring amino acid
  misc_feature (561)..(561): Xaa can be any naturally occurring amino acid
MSSAAGGGYGAAGGAEHQHLLLGQASGQLYHVPQHSRREKLRFPPDPADSPPPTAWPAPPPFYSYASSSTSSYSPHSPTLAHTQLVAHALPAGAGAQIPSQNFALSLSSASSNPPPAPRRQLAAGVAAGPYGPFTGYAAVLGRSRFLGPAQKLLEEICDVGGRPPHLDRRSDDEGMLDMDAAGGVDHEMDGGDCATAEAVXLSGAEQQWRKTRLISLMDDVCRRYKQYYQQLQSVISSFETVAGLSNAAPFAFMALRTMSKHFKCLKGMVMSQLRNTSKVIANHGIIAKDDMANFALMGGGAGLLRGNSVNAFSQPHNIWRPQRGLPERAVSVLRSWLFEHFLHPYPTDSDKQMLAKQTGLTRNQVSNWFINARVRLWKPMVEEIHNLEMRQLHKTTSVDQNQLGMQQQNHHSSDGSGRPSSDPSNSQRGQSSGMTRNLSSRAPRHIQDDELSQMPHDMAGQVSFAYSGLPPAHHGLALSHHHHPQQAQAEAVGVGGVAASSGGVAASSGGGVSLTLGLHQNNNNNNRAYIAEPLPAALPLSLPHRFGLEDVSDAYVMGAXSAGQDRHFSKGIGGGHNLLHDFVG

SEQ ID NO: 4709 - protein, 209 aa, Populus trichocarpa
MRNWGKWVSEIREPRKKSRIWLGTFPTPEKAARAHDAAALSIKGNSAILNFPELANSLPRPASLAPRDVQAAAAKAAQMDNFDQKSETTTTTTASSSSSCTSSLTSLVSLMDLSSQDEELSEIVELPSLETSYDELNNDFVYSDSVYGWMYPPPWMQSVENICLSGGGGGFWKEGKCVHKYPLLLVGENTTTTAGLISILKQAEAFKNW

SEQ ID NO: 4710 - protein, 210 aa, Zea mays
MKVQCDVCAAEAASVFCCADEAALCDACDDRVHRANKLAGKHRRFSLLHPCSSSAQKPPLCDICQERRGFLFCKEDRAILCRECDAPVHSANDMTRRHSRFLLTGVRLSSAPVDSADPSEGEEEEEQENSSRPGNGESCSGGAGATTATASDGSSISEYLTKTLPGWHVEDFLVDDAYASDVGACSSDGLYQVSSVLPCEWNCKLSLRRS

SEQ ID NO: 4711 - protein, 419 aa, Glycine max
MSSATKNAANAVGAKTARACDSCITKRARWYCAADDAFLCQACDSSVHSANPLARRHERVRLKTASYKSTDEQQQQQQQQPPTWHTKKPRTPRQWKHSRNNNPFHLVPEEGSEEANSHDENEEQLLYRVPIFDPFVAELCGTNSSPSPVTSTDQGVVAAAEVEYKGFQSNGFCSNSSEMENLHGMLPSDAELAEFAADVESLLGRGLENECVGMEELGLVDAKEEECSVGSGKVKMEDQEESPLVEMEMDMVVGRDDQSFELSFDYETCEEVKVCDLGLGNELGAKKENDDEVKKNKISLQLDYEAVIIAWASQKSPWTTADKPNLDPDECWKQCMGSCETAYHHPCGEMGGFGIHPVIIDGGREARVSRYREKRRTRLFSKKIRYEVRKLNAEKRPRMKGRFVKRASFAPPTFPLLNK

SEQ ID NO: 4712 - protein, 257 aa, Populus trichocarpa
MSDHQQQNLETESSSTKAFSPPSPSSPSSNSNPSKKHQQDQDFSPCKKITRIRDSSKHPVYRGVRMRNWGKWVSEIREPRKKSRIWLGTFPTPEKAARAHDAAALSIKGNSAILNFPELANSLPRPASLAPRDVQAAAAKAAQMDNFDQKSETTTTTTASSSSSCTSSLTSLVSLMDLSSQDEELSEIVELPSLETSYDELNNDFVYSDSVYGWMYPPPWMQSVENICLSGGGVGENTTTTAGLISILKQAEAFKNW

SEQ ID NO: 4713 - protein, 149 aa, Agapanthus africanus
ISVLCDAEVALIVFSTKGRLYEYSTESSMEGILERYERYSYAEKALVATDHDSQGNWCEDYSKLKGRIESLQKSQRHLMGEQLDLLCVKELQQLELKLENAVKHIRSRKNQLLLDSITELQKKEKELHDHNRDLAKKLIEKEKAKASHG

SEQ ID NO: 4714 - protein, 250 aa, Populus trichocarpa
MSDHHQQNSETESSSTNSLSPASPSSPLSNSTQSKKPLKDQDFSPSKKIKRIRDSNKHPVYRGVRMRNWGKWVSEIREPRKKSRIWLGTFPTPEMAARAHDVAALSIKGNPAILNFPELANYLPRPASLAPRDVQAAAAKAAQMDQFDQKSETTTTTSPSSSSTSSLTSLVSLMDLSSQEEELCEIVELPSLETSYDELSNDFVYFDSIDEWMYPPPWMQSMENHCCGGGGGCACDDFTLPNESTVLWDY

SEQ ID NO: 4715 - protein, 60 aa, Physcomitrella patens subsp. patens
YRGVRQRQWGKWVSEIREPKKRSRIWLGSFPTAEMAARAYDAAVVCLRGPTASLNFPDSP

SEQ ID NO: 4716 - protein, 230 aa, Cyperus longus
ISVLCDAEVGLIISSSKGKLYEFATENSMDKILDRYERYSYAEKVLVSTEQDPQANWCHEYRKLKAKVEAIQKCQRHLMGEDLDSLNVKDLQQLEVQLEVSSKHIRSRKSQLVIDSISDLQRKERLLQEENKMLQKELADKQKVLTQQGHWEQHQHQQHQHQHQQQHQMQPQIQPHQQHQSNSSSPGFLLGDTLPLNISAYQGTTRGEVVAAQAQAPAGLPPWMLSPLNH

SEQ ID NO: 4717 - protein, 126 aa, Cytisus racemosus
KDRHSKIHTSQGLRDRRVRLSIDISRKFFNLQDMLGFDKASNTLEWLFNKSKKAMKELAQSKNSGSGVVANGFSSSDSECEVVSMINQDSIDATPEGVVVDSKERKIKRAKMKESREKARARARER

SEQ ID NO: 4718 - protein, 113 aa, Plantago major
INTSQGPRDRRIRLSIGIARKFFDLQELLGFNKPSKTLDWLLSKSEEAIKELVLKSNAANSLSSTPSEGEEVLSHENSLGPAADLKGKSRAGNKYCRDSVNLMKESRAKARAR

SEQ ID NO: 4719 - protein, 370 aa, Oryza sativa Indica Group
MGKGRAPCCAKVGLNKGSWTPEEDMRLVAYIQKYGHANWRALPKQAGLLRCGKSCRLRWINYLRPDLKRGNFTAEEEETIIKLHGLLGNKWSKIASCLPGRTDNEIKNVWNTHLKKRVSPEQKKGGGKSKKKTTCTDVLVPSPSPSSSTTTTTNCSSGDSAGEQSNTSKEEEEETDKIEIPMLELDPCCFDFDMLVDPVVPDTYCPAVSASASASAPTSPCSSTSPSCARAGVDPLLDLPEIVDLGPELWSIMDGGAGDGCTEAPPPAWSNAAAAAAANATVATTTSLEEEGKEWWLEDLEKELGLWGPTDDYHCHPGPQGQPGRAGPPPSAVVEDPVSCYFQAGPTAAATWQGHEPSAVITSNPMDYYV

SEQ ID NO: 4720 - protein, 289 aa, Zea mays
MGRAPCCEKMGLKKGPWTPEEDKVLVAHIQSFGHSNWRALPKQAGLLRCGKSCRLRWINYLRPDIKRGNFSKEEEDAIISLHEQLGNRWSAIAARLPGRTDNEIKNVWHTHLKKRLDPTKQEQQQQHGTTPVAGAGKKHRPAAAAKRGGGGARKATADAVVVPATAAPASPERSAASSSVTESSMTEQEQEHGNTGSSPAFPKEESFTTSSSDAEEFQFDDSFWSETLSMPLDSLDDVVPMEPSDDAFGDVDVDVAAASSSSVGADGDLDYWLRVFMESGDAHPELPQI

SEQ ID NO: 4721 - protein, 135 aa, Plantago major
ICTAQGIRDRRMRLSLQVARKFFDLQDMLGYDKASKTIEWLFTKSKKAIKELASDHPNVNISISEAKSESFVSECEVVSPNEDNSAIVHEAKEGVLPTNPVSLCNTTPCDETKLRKKAVCKPNNMRESRDKARAR

SEQ ID NO: 4722 - protein, 314 aa, Oryza sativa Japonica Group
MAGAEWSPFDGDAAFAEYSSAVLAELGGWAAPGEEGGAGMMVPAALDLPVDVVGAAAREEEEEEEEAPARSGDGAAAAASSSSSGEPAAPDKRPAAAEAAPAAAATATATAKKGQKRARQPRFAFMTKSEIDHLEDGYRWRKYGQKAVKNSPFPRSYYRCTNSKCTVKKRVERSSDDPSVVITTYEGQHCHHTASFQRGVGGAAVAAHIHGAAAVALAEQMSAFVSPPPQPHMLYGLPRLHPPSSETAVSCSMPTTTSLQELNNSEGLQRPGYNNSPQAAVTIAQRPPSPSVPPAVSFDKGLLDDIVPPGVRLG

SEQ ID NO: 4723 - protein, 232 aa, Oryza sativa
  misc_feature (73)..(73): Xaa can be any naturally occurring amino acid
  misc_feature (76)..(76): Xaa can be any naturally occurring amino acid
  misc_feature (224)..(224): Xaa can be any naturally occurring amino acid
VGEDRCWTLRVEQKVSRPCAIGQSTSQHFRSVKRISRKSSLKAEDGLLYPLEKGFFFLPKPPTLILHEEIEYXELXRHGAGGASISSHYFDLLVKLKNDQEHLFRNIQRNEYHNLFNFISGKHLKILNLGEAQGRAGGVTAVLQSTDDDAVDPHLERIRNQTGDDESDEEDEDFVADKDDSGSPTDDSGEEGSDASLSGGEKEKSSKKEASSSKAPLKKRKPRXDAAEGSEK

SEQ ID NO: 4724 - protein, 201 aa, Arabidopsis thaliana
MGGKKTKIEIKKIINKPAKTVAFTKRREGLFRKASQLCLLSPATQIAILAAPMTSKSHASFYSFGHSSVDNVVSSLLYDHPPLTANQDNRSGLGFWWEDKRFDVSENVEELKEAVDAVSRMLNNVRCRLNDAVKSTQRDGGLEILHHQEEEVLQTRNDETKTNQTHEFEGGETSGSASWLENEDDILHFDDDFYTGIDPLF

SEQ ID NO: 4725 - protein, 348 aa, Sorghum bicolor
FGVGASSHSHGHGHGQHHHHHHPWASSLSAVVAPPPQQPPTAGLPLTLNTVAATGNSGASGNPVLQLANGGSLLDACVNVKAKGEPSSSSPYAGDLEAIKAKIISHPHYYSLLAAYLECKKVGAPPDVSARLTAMAQELEARQRTALSGLGAATEPELDQFMEAYHEMLVKFKEELTRPLQEAMEFMRRVESQLNSLSISGRSLRNILSSGSSEEDQEGSGGETELPEVDVHGVDQELKHHLLKKYSGYLSSLKQELSKKMKKGKLPREARQQHLSWWDLHYKWPYPSETQKVALAESTGLDLKQINNWFINQRKRHWKPSEEMHHLMMDGYYTNTFFMDGHFINDGG

SEQ ID NO: 4726 - protein, 221 aa, Physcomitrella patens subsp. patens
MEASTDNSAPLKRHKSDGEDVRAVKAEQASASENSGDSISPRSTLKGATSKRPQDFPKQDYIHVRARRGQATDSHSLAERVRREKISERMKFLQDLVPGCSKVTGKAVMLDEIINYVQSLQRQVEFLSMKLATVNVPRLDYSYDLLSKEMPMQSRSPETTLLGPDPLAAPFGDHSQCSPMQSISTPSCHFEALYLRRSMSVPTMMSRFDSAGHFSDLFSQV

SEQ ID NO: 4727 - protein, 138 aa, Oryza sativa Japonica Group
SDDKALKRHLLRKYSGYLGGLRKELSKKRKKGKLPKEARQKLLTWWELHYRWPNPSEMEKIALAESTGLEQKQINNCFINQRKRHWKPTEEMEFAVMEAYHHQSTDAAAAFYVDVDARLVGATAAAPASAVYTARPDH

SEQ ID NO: 4728 - protein, 334 aa, Panicum miliaceum
YGLGASGHGHGQHHHYHHHPWGSSLSAVVAPPPQPPPSAVLPLTLNTAATLNSGANGGAGGNPVLQLAHGGSLLDACIKAKEPSSSSPYAGDVGAIKAKIISHPHYHSLLAAYLECQKVGAPPEVSARLTAMAQELEARQRTALGGLGAATEPELDQFMEAYHEMLVKFREELTRPLQEAMEFMRRVESQLSSLSISGRSLRNILSSGSSEEDQEGSGGETELPEVDAHGVDQELKHHLLKMYSGYLSSLKQELSKKKKKGKLPKEARQQLLGWWDLHYKWPYPSETQKVALAESTGLDLKQINNWFINQRKRHWKPSEEMHHLMMDGYHTTGA

SEQ ID NO: 4729 - protein, 496 aa, Brassica napus
MEPEDDLCQNNWGGSSSSSSSKRREQVCFTTQHKWEDASILDYEMGMEEEPAFQENSNNNNGGQVNVDFLQGVRAQAWDPRTMLSNLSFMEEKIHELQDLVHLMVARNGQLQGRQEQLVAQQQQLITTDLTSIIIQLISTAGSLLPSVKHHNMSTAPGPFTGSALFPYPREANNLASQTLNNNTCEFDLPKPIVVEERESHVVEEHEMKDEDDVEEGENLLPGSYEILQLEKEEILAPHTHFCTICGKGFKRDANLRMHMRGHGDEYKTPAALAKPNKEAAPGSEPMLIKRYSCPFPGCKRNKDHKKFQPLKTILCVKNHYKRTHCDKSFTCSRCHTKKFSVIADLKTHEKHCGKNKWLCSCGTTFSRKDKLFGHIALFQGHTPAIPLEETKPSAQRGSSACENSNNNNNTGMVGFNLGSATNAIEEVAQPGFMDGKIRFEDSFSPLSFDTCNFGGFHEFPRPMFDDSESSFQMLISSACGFSPRNGGESVSNTSL

SEQ ID NO: 4730 - protein, 266 aa, Glycine max
MVQQDIRRGPWTEQEDYKLVYFVGMFGDRRWDFIAKVSGLNRTGKSCRLRWVNYLHPDLKRGKLTPQEQHLVMDLHSKWGNRWSRIARKLPGRTDNEIKNYWRTHMRKKKALEKKHASASASSPVSSSCQSSLSSNNHVVDSHASKESFYDTGGYDDMMMGLIGGEKGYSMDDIWKDIVLSGEENSIYNNNNLQPVYEEGHSEEGFNFSCPPPMMIMPSPPSWDQYNISSQPLWVMDEEESNKMLFPTLSDQYFSHYEQGNEFLTG

SEQ ID NO: 4731 - protein, 265 aa, Solanum lycopersicum
MAREKIQIKKIDNSTARQVTFSKRRRGLFKKAEELSVLCDADVALIIFSSTGKLFDYSSSSMKQILERRDLHSKNLEKLDQPSLELQLVENSNYSRLSKEISEKSHRLRQMRGEELQGLNIEELQQLERSLETGLSRVIERKGDKIMREINQLQQKGMHLMEENEKLRQQVMEISNNNNNNNNGYREAGVVIFEPENGFNNNNNEDGQSSESVTNPCNSIDPPPQDDDSSDTSLKLGLATLLRLKRSKARCGYFCMLLEEGEKKK

SEQ ID NO: 4732 - protein, 321 aa, Pennisetum glaucum
YGVGASGGSGHGHGQQQQQHHHHHHHLWGSSLSAVVAPPPQPPPSAGLPLTLNTAAAGNSCGAGGNPVLQLANGGGLLDACVKAKEPSSSSPYAGDVEAIKAKIIFHPHYYSLLAAYLECQKVGAPPEVSARLTAMAQELEARQRTALGGLGAATEPELDQFMEAYHEMLVKFREEPTRPLQEAMEFMRRVESQLNSLSISGRSLRNILSSGSSEEDQEGSGGETEIPEIDAHGVDQELKHHLLRKYSGYLSSLKQELSKKKKKGKLPKEARQQLLGWWEAHYKWPYPSETQKVALAESTGLDLKQINNWFINQRKRHWKP

SEQ ID NO: 4733 - protein, 138 aa, Oryza sativa Indica Group
SDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPASAVYTARPDH

SEQ ID NO: 4734 - protein, 549 aa, Vitis vinifera
  misc_feature (24)..(24): Xaa can be any naturally occurring amino acid
  misc_feature (26)..(26): Xaa can be any naturally occurring amino acid
  misc_feature (197)..(197): Xaa can be any naturally occurring amino acid
  misc_feature (533)..(533): Xaa can be any naturally occurring amino acid
  misc_feature (544)..(544): Xaa can be any naturally occurring amino acid
MELPQPRPFGTEGRKPTHDFLSLXSXSTVQQDPRPSQAGYLKTHDFLQPLERGEKNSIKEENAIEIRTVDKPPPPAPPPNSSVEHILPGGIGTYSISHISYFNQRLPKPEGSIFTAAQASTSDRNEENSNCSSYTGSGFTLWEETAVKKGKAGKENAVERPIGIEPAVKLGQWTSERPSQSPSNHRSSFSSLSSSQXSGQKNQSFMEMIQSASAKGTQEEEEEDEEEFVLKKESSSNKGDLTVKVDGKSSDQKAVTPRSKHSATEQRRRSKINDRRVFQMLRDLIPHSDQKRDKASFLLEVIEYIQFLQEKVHKYEGSFQGWNHESAKLMPWRNSHRPAESFADQSRGINSGSGPALMFSAKFDENNVAVSPNISRNTQNPVESDLSASTTFKAMDRHPGLTNKAVPIHMQLQPNIFTPVVGGGGLAQLPPRLAPDAENMASLPQSQLWQSRSSVTTECTVASDKLKEQELTIEGGTISISSAYSQGLLNTLTQALQSSGVDLSKASISVQIDLGNKANSRPTAPTPIIKAGXIKYINLKASFXLNFKF

SEQ ID NO: 4735 - protein, 344 aa, Setaria italica
FGVGASGGHGHVQDHLHHHHPWGSSLSAVVAPPPQTPPSAGLPLTLNTAATGNSGGAGGNPVLQLANGGGLLDACVKAKEPSSSSPYAGDVDAIRAKIISHPHYYSLLAAYLECQKVGAPPEVSARLTAMAQELEARQRTALGGLGAATEPELDQFMEAYHEMLVKFREELTRPLQEAMEFMRRVESQLNSLSISGRSLRNILSSGSSEEDQEGSGGETEIPEVDAHGEDQELKHHLLKKYSGYLSSLKQELSKKKKKGKLPKEARQHLLSWRDLHYKWPYPSETQKVALAESTGLDLKQIINWFINQRKRHWKPSEEMHHLMMDGYHTTGAFYMDGHFINDSG

SEQ ID NO: 4736 - protein, 350 aa, Oryza sativa Japonica Group
MDPRFPPPAPSGGAPPRGHHRRAHSETFIRLPDADLLLDPDGEFGFSDLDFPSLSDDSPAASDPTPPPPPPALPQAAPRPPGGAHLRSLSLDAAFFDGLAFQGGGGGGGAGSGSSGGGAGHKRSGSMDGESSLFEGESAPPDYAKKAMPADRLAELALLDPKRAKRILANRQSAARSKERKIKYTGELERKVQTLQTEATTLSTQLTLLQLLHRTTSSSFEFKVASSSGVLGHYKAIEIKESKYIYPDKQSNLLRKPSLFNAALNDALREEVQRLKIAAGQVPNMNGNSFNGGLQQQQQQQMPTYFSQQQQMHYLSGHQGRHHHPNNPHNSLNGGQSMSGQTLNDSMDFM

SEQ ID NO: 4737 - protein, 490 aa, Capsicum annuum
MAENEGLSSSSATSRGQLVRPTITLPPRNSMDSLFSGGISPGPMTLVSSFFSDNDPDSECRSFSQLLAGAMTSPAGISGVRPGFSPPSTAAPAMTPTFSVPPGLNPTNLFDGFFSPGQGPFGMSHQQVLAQLTAQASQPQSQMHIQPDYSSSSAATALSMSPFQSLTSNTAANQQIPPALDPNTIKESSDVSLSDQRSEPASFVVDKPADDGYNWRKYGQKQVKGSEYPRSYYKCTQPNCPVKKKVERSLDGQVTEIIYKGQHNHQPPQASKRSKESGNPNGNYNLQGTYEPKEGEPSYSLRMKDQESSLANDQISGSSDSEEVGNAETRVDGRDIDERESKRRAVEVQTSEAVCSHRTAPGPRIIGRTTREFDLLDDGYRWRKYGQKVVKGNPYPRSYYKCTSQGCNVRKHVERAASDPKAVITTYEGKHNHDVPAARNSSHNTANNSTSQLRPHNPVFDKPTAMRRSDFPSNEQQPIALLRFKEEQIT

SEQ ID NO: 4738 - protein, 336 aa, Oryza sativa Indica Group
MEHFNDWDLQAVVRSCSFPQSEPPRVGVGVPAAPGAGGAPVVVAPPARAPDGPDQMARASASALYDLEYLDLDHKPFLLPGSSSSSSSSRAVARARGEDDGKGRHEVMISFPAAAAASTSGAQPRSPSGRKPGIRTPRPKRRSSKKSQLKKVVYEVPVADGGVSSDLWAWRKYGQKPIKGSPYPRGYYKCSSMKGCMARKMVERSPAKPGMLVVTYMAEHCHPVPTQLNALAGTTRHKSAPTGDDDKPTSPGPAAGRAAAGEGVVKCEDVDGNELSAMAADGGAEDTAAAVDDDGELWPEGMGLELDEFLGPMDDDVFEFDHVLEDDGVLGRRLSL

SEQ ID NO: 4739 - protein, 334 aa, Chasmanthium latifolium
FGVGASGHSQQQQQHHHPWVSALSAVVAPAPSAGLPLTLNTAATGSSGGNPVLQLANGGSLLDACVKAKELSSSSPYAGDVDAIKAKIISHPHYYSLLAAYLECQKVGAPPEVSARLTAMAQELEARQRTAFGGLGNATEPELDQFMEAYHEMLVKFREELTRPLQEALEFMRRVESQLNSLSISGRSLRNILSSGSSEEDQEGSGGETELPEVDAHGVDQELKHHLLKKYSGYLSSLKQELSKKKKKGTLPKEARQQLLSWWDLHYKWPYPSETQKVALAESTGLNLKQINNWFINQRKRHWKPSEEMHHLMMDGYHTTNAFYMDGTSSTTAG

SEQ ID NO: 4740 - protein, 122 aa, Brassica rapa subsp. chinensis
MGKRKELDKKVKGSTKMKSKSSEENGKLPYVHVRARRGQATDSHSLAERARREKINARMKLLRELVPGCDKIQGTALVLDEIINHVQSLQRQVEMLSMRLAAVNPRIDFNLDTLLASEVSIF

SEQ ID NO: 4741 - protein, 540 aa, Dubautia arborea
MKRSRERKKEAKTTSSVPDSGGMDELLEVLGYKVKSTDMADVAQKLEQLEMVMGEDGVLQLSDTVHYNPSDLSGWVQSMLSVLNENNNTPPSDHIVLSGDSSTTMIDFSNSSEIVVHGKQGSKMHEDDPYDLRAIAGGAIYGGESESSVRGNGNGNGIKRMKSTAVGSVDVQPESPRRVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4742 - protein, 277 aa, Arabidopsis thaliana
MALNMNAYVDEFMEALEPFMKVTSSSSTSNSSNPKPLTPNFIPNNDQVLPVSNQTGPIGLNQLTPTQILQIQTELHLRQNQSRRRAGSHLLTAKPTSMKKIDVATKPVKLYRGVRQRQWGKWVAEIRLPKNRTRLWLGTFETAQEAALAYDQAAHKIRGDNARLNFPDIVRQGHYKQILSPSINAKIESICNSSDLPLPQIEKQNKTEEVLSGFSKPEKEPEFGEIYGCGYSGSSPESDITLLDFSSDCVKEDESFLMGLHKYPSLEIDWDAIEKLF

SEQ ID NO: 4743 - protein, 209 aa, Brassica rapa subsp. chinensis
MRWTPELHESFLKSVNKLEGPEKATPKAVLKLMNVEGLTIYHVKSHLQKYRLAKYMPEKKEEKKNVNSEEKKLAMSNSEADEKRKGAIQLTEALRMQMEVQKQLHEQLEVQRVLQLRIEEHAKYLEKMLEEQRKAGRLFSSSSSSQTLLSPSDDETRPDSQNMSKIEASLPQPSSSAKNIASETEDDQCESPQKRRRLENNTEPQDSER

SEQ ID NO: 4744 - protein, 538 aa, Dubautia arborea
MKRSRERKKEAKTTSSVPDSGGMDELLEVLGYKVKSTDMADVAQKLEQLEMVMGEDGVLQLSDTVHYNPSDLSGWVQSMLSVLNENTPPSDHIVLSGDSSTTMIDFSNSSEIVVHGKQGSKMHEDDPYDLRAIAGGAIYGGESESSVRGNGNGNGIKRMKSTAVGSVDVQPESPRRVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4745 - protein, 364 aa, Triticum aestivum
  misc_feature (321)..(321): Xaa can be any naturally occurring amino acid
MAAIDLYGAANQFSSSSSSSSSDQELMRALEPFIRSASSPTSSTSTSTSPFSFYATSTSTSSPFSYYSSSSLPQESCYLPASSSYSYTTLQAPFAPTAATTTSSSFSQLPPLPPTSQYSASPAGRVPVGGRPALGPEQIHQIQAQLFLQQQQQQQQQQQRGPLGVRSSGPRAQPMEQAGAPSAGKLYRGVRTQRHWGKWVAEIRLPKNRTRLWLGTFDTAEDAALAYDKAAFRLRGDAARLNFPNLRRGGAHLAGPLHAAVNAKLDSICQTIAAPAPSSKSSPPDSPKASTSTSSTEGDGSVLSAGSTPLPPQSSQHQQPXAPLHEMAKLDFSEAPWDESDAFHLHQDLHKCPSWEIDWDSILS

SEQ ID NO: 4746 - protein, 169 aa, Triticum aestivum
MSKTPGKTPRTPRRILESYTIKGSDGVIRPGDSVLMKAPDTSKPPYVAKIEEIEAAGPRGANVKVKVRWYYRPEESIGGRRPFHGEKEVFLSDHQDVQSADTIECKCNVYSFRDYTKLSAVNPEDYFCRFEYKSITGSFVPDRIAVFCKCEMPYNPDDLMIQCEECSDW

SEQ ID NO: 4747 - protein, 536 aa, Dubautia ciliolata subsp. glutinosa
MKRSRERKKEAKTTSSVPDSGGMDELLEVLGYKVKSTDMADVAQKLEQLEMVMGEDGVLQLSDTVHYNPSDLSGWVQSMLSVLNDNTPPSDHMVLSGDSSTTMIDFSNSSKIVVHGKQGSKMHEDDPYDLRAIAGGAIYGGESESSVRGNGNGHKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4748 - protein, 711 aa, Glycine max
  misc_feature (180)..(180): Xaa can be any naturally occurring amino acid
  misc_feature (192)..(192): Xaa can be any naturally occurring amino acid
LQTVNLRSSEILDHPHTQICNEGRQNALSEILEILTVVCETHNLPLAQTWIPCKHRSVLAQGGGVKKSCSSFDGRCMGKVCMSTTDIAFYIIDAHLWGFREACVEHHLQQGQGVAGRAFLSHGMCFCSNITQFYKTDYPLVHYALMFGLTSCFGICLVSSLTGNDDYVGEFLFSPPLTHXVGGPPPTISYVXPPPPHFQSLKIASGVELEDGSIEIIEATIERVHTRHESIPITPSIKSPPRLDTSPNMGEEVPQDPSEQQILMYCNDMNDGRSLGKNADGIDHMPSIETKNIKKPLERKRGKTEKSISLEVLQRYFAGSLKDAAKSLGVCPTTMKRICRQHGISRWPSRKINKVNRSLSKLKRVIESVQGAEGAFGLNSLSKSPLPIAVGSFPEPSTPNKFSQSASLSIKPSEPQVKENELNASKALEANRQAGMEDQLLGGRTQNLEKVINDKGGYTREVGREPKRTRTRNGSSEDSTNPTSHGSCHDSPPNESSPVKDIFITSNNDQCAGIKRSPESTLQLTTNTPNRPAAYPMPDFVAAELQEPFGGMLIEDAGSSKDLRNLCPLVAEVILEDMIPEACGTNLPGPDLSPKLSMGTPNKAVTPFAAMKEMKTVTIKATYREDIIRFRASLTCGIVELKEEIAKRLKLEVGTFDIKYLDDDHEWVLIACDADLQECMDVSRSSGSNIIRVLVHDITSNLGSSCESSGE

SEQ ID NO: 4749 - protein, 536 aa, Dubautia ciliolata subsp. glutinosa
MKRSRERKKEAKTTSSVPDSGGMDELLEVLGYKVKSTDMADVAQKLEQLEMVMGEDGVLQLSDTVHYNPSDLSGWVQSMLSVLNDNTPPSDHMVLSGDSSTTMIDFSNSSEIVVHGKQGSKMHEDDPYDLRAIAGGAIYGGESESSVRGNGNGHKRMKSTAVGSVDVQPESPRPVVLVDSQEAGIRLVHTLMACAEAIQHNDLKLADALVKLVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4750 - protein, 536 aa, Dubautia menziesii
MKRSRERKKEAKTTSSVPDSGGMDELLEVLGYKVKSTDMADVAQKLEQLEMVMGEDGVLQLSDTVHYNPSDLSGWVQSMLSVLNDNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKLVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLDIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4751 - protein, 330 aa, Oryza sativa
MMRDVCMEVLPPMDHYASRGNWFMARKWSPEENKQFERALAGLDLRCPDWDRVARAIPGRSALEVMNHFRDLELDVQQIENGMVPFPVYGAAAAGGAFTLQWDGAHGVGDFRNAYRFGGGGGGKRHFGRTPEQERKKGVPWTEEEHKLFLLGLKKYGKGDWRNISRNFVQTRTPTQVASHAQKYFIRLNSGGKDKRRSSIHDITTVNLTDDRPPSPSQSSLISNQSNTSTLTAAVAPFSSTADVKPQNAANASFNSPSRTLGMAGYGMGLQDQGLQCGGQKQSGHSLSDDGRHCCIEPSGLMWLLLLEILQAYTTGFSMSPDVPLQHQTI

SEQ ID NO: 4752 - protein, 134 aa, Joinvillea ascendens
ISVLCDAEVALIIFSTKGRLYEYATDSCMDKILERYERYSYAEKVLVSADSEAQGNWCHEYRKLKAKVEAIQKCQRHLMGEDLDSLNIKELQQLEHQLESSLKHIRSRKSQLMLESISELQKKGKSLQEENKQL

SEQ ID NO: 4753 - protein, 219 aa, Streptochaeta angustifolia
ISVLCDAEVAVIIFSPKGKLYEYATDSRMDKILERYERYSYAEKALISAESGIQGNWCHEYRKLKAKVETIQKCQKHLMGEDLDSLNLKELQQLEQQLESSLKHIRSRKSHLMMESISELQRKEKNLQEENKVLQKELVERQKVLSQQVPWDQTQTQTQPQTSSSSSSFMMRDAQLPPPNIGAYPVVAGERGDVAAAAGGQAQLRIGGLPPWMLSHLNA

SEQ ID NO: 4754 - protein, 228 aa, Arabidopsis thaliana
MPKQKAPRKQLKSYKLKHINKSIQEGDAVLMRSSEPGKPSYVARVEAIETDARGSHAKVRVRWYYRPEESIGGRRQFHGAKEVFLSDHFDFQSADTIEGKCKVHSFSSYTKLDSVGNDDFFCRFEYNSTTGAFDPDRVTVFCKCEMPYNPDDLMVQCEECSEWFHPSCIGTTIEEAKKPDNFYCEECSPQQQNLHNSNSTSNNRDAKVNGKRSLEVTKSKNKHTKRPG

SEQ ID NO: 4755 - protein, 134 aa, Pueraria montana var. lobata
KDRHSKIHTSQGLRDRRVRLSIEIARKFFDLQDMLGFDKASNTLDWLFTKSKKAIKELTRSKNSAESFEFSSSSEGEVVFTIQQDLQQQQQQQQQGVDLEEGKLKEPAYNCVKAKMKESREKARARARARERER

SEQ ID NO: 4756 - protein, 468 aa, Glycine max
  misc_feature (262)..(262): Xaa can be any naturally occurring amino acid
  misc_feature (380)..(380): Xaa can be any naturally occurring amino acid
  misc_feature (382)..(382): Xaa can be any naturally occurring amino acid
  misc_feature (396)..(396): Xaa can be any naturally occurring amino acid
  misc_feature (410)..(410): Xaa can be any naturally occurring amino acid
LISLGGNAKLSGYNDRIPCSLLSKSRDNVPVVSRDDDENSSGCTHPINTETKSFRPKTCIGKRMASNFQKVAEKTKNYALSNNDGDWKRTYLSKRNCNKHQSSQMNIPFKKRKLFNYRSVANSNGLIRRGGIYYSPENCMNQDGCGSPPGMHKDPGMPSLEACQHQTLRSRGSHVNLRIKSFRVPELFIEVPETATIGSLKRTVMDAVTAVLGGELHIGVFLQGKKVKDDSKTLLQTGISHQNELDALGFTLEPNSSQSLTXVCAAHSPGPKADITQPVIRYPSSPAVIHQRIQGNSDMLPEHQVTSLGSHFENDHDSAPSPVNASVEKGMKDSKELVTVPEMDEELAMVPVHQKSKRSEIVQRRIRRPFSVDEVEALVXAXEKLGTGRWRDVKVXLFDNAKHRTYVDLXDKWKTLVHTARISPQQRRGEPVPQELLDRVLVAHAYWSHQQTKPQHKHHPETETVFSF

SEQ ID NO: 4757 - protein, 93 aa, Zea mays
  misc_feature (9)..(9): Xaa can be any naturally occurring amino acid
  misc_feature (14)..(14): Xaa can be any naturally occurring amino acid
  misc_feature (35)..(35): Xaa can be any naturally occurring amino acid
  misc_feature (37)..(37): Xaa can be any naturally occurring amino acid
  misc_feature (40)..(41): Xaa can be any naturally occurring amino acid
  misc_feature (51)..(52): Xaa can be any naturally occurring amino acid
  misc_feature (59)..(59): Xaa can be any naturally occurring amino acid
IRSTYIQRXSKDTXVDVRIVEEDVNIKLTKRRRDXCXAAXXRALDDLRLDXXHLSGGKXGDCQIYMFNTKIHKGSSVFASAVAGRLMEVVDEY

SEQ ID NO: 4758 - protein, 125 aa, Pueraria montana var. lobata
KDRHSKIHTSQGLRDRRVRLSSEIARKFFDLQDMLEFDKPSNTLEWLFTKSENAIKELARSKHSGSSSGGDKCSCDPSVDSNNNNKSLVGDGSKGRKLKWAQKDDVCVQTKKESRERARARARER

SEQ ID NO: 4759 - protein, 680 aa, Zea mays
MVFQKRSSSSEMESCGGGQVPEMPRVPKSARGKRSVRKKEAQSPAQMSAFDLLATVAGKLFDEGAGSLGNTSAGAPALAACAKDALVKQEQCDEQMKLFKHEATDQDSCNESAILPHIVLQRVVNNARNEDPKAKSEVQDKESSMISYTKAELGCNFGVIADRWSPESVESGACTGDAVARLMMTAPAGFHKNAPEMYSLLDSMDVDVKPPPLVSSDSTGEMPLHGDKIHRSTSLPRGPKGVGFFAVDRDDDDDKSSGCTHPSTATNKDFTSNCKAEYNRVRKLLTSKHRKVAPARIHKSDLSYSDVERKPSFRYKKMHTRQRTQRSTFKRRKLFDRHLALASEFGTANGKGNTKVAGRNSNAVSLEANKGTNSMPFQKSCGSNDCYVKLRIKSFNVPELLVEIPDSATVGSLKKTVLEAVTAILGGGLRVGVLHHGKKVRDDSKTLIQAGIGQDDMLDNLGFSLEPNCTQNPQVQAPEDVNFLENIDTTEPLARITPADSSSKLGEVDVSQELALTPLAMNYQGSDHDSVHSPGAVSSRDKDSRALFLVPAADPNAGAVVPANKTKRSPEQGHRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPSLAEARLLTQ

SEQ ID NO: 4760 - protein, 320 aa, Vitis vinifera
MRNPASASTSKTPCCTKVGLKRGPWTPEEDELLANYVKREGEGRWRTLPKRAGLLRCGKSCRLRWMNYLRPSVKRGQIAPDEEDLILRLHRLLGNRWSLIAGRIPGRTDNEIKNYWNTHLSKKLISQGIDPRTHKPLNPKPNPSPDVNAPVSKSIPNANPNPSSSRVGEIGSNHEVKEIESNENHKEPPNLDQYHSPLAADSNENWQSADGLVTGLQSTHGTSNDDEDDIGFCNDDTFPSFLNSLINEDVFGNHNHHQQQQQQQQLQQVQQPSNVIAPLPHPAISVQATFSSSPRTVWEPAALTSTSAPLVHDQKHSMSP

SEQ ID NO: 4761 - protein, 220 aa, Eucalyptus gunnii
MNPFSSHSHPNSCRFNFAEPPSDSRSATALGNFSHKEVLLASHHPKKRAGRKKFRETRHPVYRGVRLRDSGKWVCEVREPIKKSRIWLGTFPTVEMAARAHDVAALALRGRSACLNFADSAWRLPVPASADTKEIQKAAARAAEAFQSVESEDVMSGDEKKLRSEEGVFYDEEDIFGMPGLLADMAEGMLLSPPKWGGDIYGGEDEGNLGAHTSLWSYSI

SEQ ID NO: 4762 - protein, 447 aa, Zea mays
  misc_feature (331)..(331): Xaa can be any naturally occurring amino acid
MATGETAVDRREDPRDMDLSGEEHVRPKVQRRLQIPWRSACSHSFLPRLPDQARKPYTITKRRERWTEEEHGRFLEALQLHGRAWRRIQEHIGTKTAVQIRSHAQKFFTKVVRESSPGSNASAGAAPAIQIPPPRPKRKPAHPYPRKADGAAKKPAPELKRLEMTSLRDRVRDEGSPTSVLASARTASRAEVSGSVVANSSSASMSPALSDAGSDERGDGDGGGSLASSVDREDGCASPRTRAPCTKVLCDAHEVSRLGSGAPVVKLFGNKVVVVKDLETDTPPASVAEAAINGSPTNGAAGASSWKPWPELTCLVPRRDGFAAQPAVSPXARFYPQASAQEHQQASEPLDHRRAQREGSSPTGSSVASSAAAESRHGPVQENASDGYAALRAAIPRPTKRVSSASFGGRGFVPYKRCAAESEAARPVALALAPGEEADGELTRLCL

SEQ ID NO: 4763 - protein, 133 aa, Pueraria montana var. lobata
KDRHSKINTARGLRDRRMRLSLEVAKRFFGLQDMLGFDKASKTVEWLLNQAKGEIKQLVREKSSVGGAKSASSTSECEGVSSLDEVVVSGVNEEQERETPNMKRRTSKVCRKSAFNPIDKESREKARERARER

SEQ ID NO: 4764 - protein, 359 aa, Vitis vinifera
MSPPLLGVGEEEGQSNVTILASSASMESVCQISSGLKERNYMGLSECSSVDSSAISTDSDGNKSSLNLKATELRLGLPGSLSPGREPELCLLSSTKLDEKPLFPLHPSKDLTYTSSQKTVVSGNKRGFADAMNGFSEGKFLANSEVNVMLSPRPSPNKENLGSQPAKMKEMASPKIVQERPRATNETPPNHTGTGNNNSSAPATKAQVVGWPPIRSFRKNTLATTSKNTEVDGKAGPGALFVKVSMDGAPYLRKVDLRNYSAYQELSSALEKMFSCFTIGQYGSHGAPGREMLSESKLKDLLHGSEYVLTYEDKDGDWMLVGDVPWQMFIETCKRLRIMKSCDAIGLAPRAVEKCKNRN

SEQ ID NO: 4765 - protein, 351 aa, Oryza sativa Japonica Group
MALEAVLLSRGDLFGRRRCAMEGGGGGWSSPFSGFEGVMDLDGGNWDAAACSSMLLHGFQELEIPAAAAAAAAMAPPPPPVEPANCAENAGGVGGHQEDQAAVAAAATAVQSGRRKRRRARAAKNKEEVESQRMTHIAVERNRRKQMNEYLAVLRSLMPPSYAQRGDQASIVGGAINFVKELEQLLQSLEARKSSRQCAAHDAAAAAAPFASFFTFPQYSMSAAAAAAPVAPVVNELHGRDDGGAGTAEAEASGSKPSAVADVEVTMVESHANLRVLSRRRPRQLLRLVVALQGHRLTVLHLNMTSAGHMVLYSFSLKVEDDCQLTSVDEIATAAHQIIEKIQEEQGCSLD

SEQ ID NO: 4766 - protein, 437 aa, Glycine max
MAQKQKLRPSPLDEPPTASSSDSEEEEEQQQQQPSSQQHEEEEEEVSSGEEEEASSEEEEDENLPPPPISKNPPPPPPSNPQPQPTSSESETESGSETESEPHPTPVKVKPLASKPMDQAQKPKAQPSPAPPPPKSASKRPAENNNNNARVADPKRAKKKATESSSAAAISDDEMEEDGKKSGDNSKKFQRLWSEEDELAILKGVVEFTSKTGLDPLKFPNANAFHDFMKKSLHVEFSSNQLKEKLRRLKKKFETQAGKGKNGDAPKFSKPHDQKFFELSKKAWGSEDGGVANGSVEKPKSNGNAAKSPNPKKKESGSRNVASAKKPKPETNPEPAPVPSLEFKESERMEIDQKPDGGDACLFLRELVRYKEGANVSRLDEDDVKRGLELIEESKRAELRGKWKKLHHAEMELFANRSELIGEQTKLILEALRSSNH

SEQ ID NO: 4767 - protein, 97 aa, Scrophularia californica
HTAQGARDRRVRLSIGIARKFFDLQEMLGFDKSSRTLDWLLTKSKAAIKELAASGKTESRISSPSECEVVSAENASSDSKSKGKNPCQLASNLAKES

SEQ ID NO: 4768 - protein, 503 aa, Oryza sativa Indica Group
MEGEQAAGDLADIVLRAGGAAAAAVAGGGIPSTEWQLPPAEEEEEEPGLFPLPPSSSDGSGMSGADAFGDPFAGLPDPFGGDYPSSSGGAAAAADFFDAVVAKAGFVDVGVLGGGGGGGCDGGGVDGGGGGSSLLGMSKPILPRAAMQLPSVSPRAIRPYPVMAGDTVKLGAPMAGGPCAFDGAAAAGLHMSSSPRGAVGGIKRRKNQARKVVCIPAPAAAGGRTSGEVVPSDLWAWRKYGQKPIKGSPYPRGYYRCSSSKGCSARKQVERSRTDPNMLVITYTSEHNHPWPTQRNALAGSTRSHHAKNSSSNSSSSGASSASKNNSSHRGYHHHHHHQKPLVKAEPNDQSAAAAATTTAATVPVKEEAAMVGTSSEALAKTTQKSMDDAAAAASATAAAVEHSDLMQQMFSQSYRPMIPEAAAGGHHDDFFADLAELESDPMSLIFSKEYMATNYKPAGDPAGKEMNAVDKGLDPAYMLDWSSTTVVTRAGGSSFMQGEGGL

SEQ ID NO: 4769 - protein, 386 aa, Dactylis glomerata
MEGVEESNREAVQSCHRVLSLLSNPHGQLVPHKELVEATGEAVSKFGSVATKIATNGNGRQGHARVRKKINQPMPMFDSSLFLETTASAADAAAAKTSQPGPDTILRLFPRYQQVEGSSSKDPVRIPAQFPRRLLLENPSVGSNGPARGPPVQLVQPVSVAPPAGTPAPALPAAHLHFIQQQQSYQRFQLMHQMKLQSEMMKRGGLGEQGGSNGGVNLKFASSNCTGSSSRSFLSSLSMEGSMASLDVSRSSRPFQLVSGSQTSSTPELGLMQRKRCAGKEDGSGRCATGGRCHCAKKRKLRIRRSIKVPAISNKVADIPADEFSWRKYGQKPIKGSPHPRGYYKCSSVRGCPARKHVERCVDDPAMLIVTYEGDHNHNRAAAQPA

SEQ ID NO: 4770 - protein, 640 aa, Oryza sativa Indica Group
MGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGCESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCNNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGVGGSNGGVFEDVNGMMQQPQQTTPAQQQFFIRDDTPFGNQMGDINGASEFRFGSGFNMSGAVEYPGAMQGQQKNDGSNWYY

SEQ ID NO: 4771 - protein, 463 aa, Oryza sativa Japonica Group
MARFQETKARNDQGPVADHVGHQNLMENLTDPLDSSGMDMMDEARIPKARKPYTITKQREKWTEDEHKLFLEALQLHGRAWRRIQEHIGTKTAVQIRSHAQKFFSKVIKESSGDNCNSLGAASSIQIPPPRPKRKPVHPYPRNLGSTASKNVPALKQLEKPQLQVQSLYDQDNGSPTSVLTVPQIRADTLGSESGGSPTSTIDIEERCPTPSIATAELAMELPPTNDEEVKGNGDHEEVTCDRSGVPVLRLFGKRVMVNDLHQMSAPDAGNLQTVADMEVDASAETPTSGTGKFSSHGAAEANTWNPWLTNTQQFLYYLPNGQIFSVHSALPCFTYHNEGVTCTQFSNPQVVASDQQHQHQTSEAVDYKGIQREGSWTESNTSSSSVPETATHNSETTESYRNGNRNEDEMVPSPDSRKCVSPGSNCRRGFVPYKRCVADSEALLKSQAPQEEADGEMTRLCL

SEQ ID NO: 4772 - protein, 149 aa, Triticum aestivum
HSITSLYKKAGWYRSGIPGISSTHASEDVDRIKGPWSPEEDDALQRLVGRHGARNWSLISKSIPGRSGESCRLRWCNQLSPQVEHRPFTPDEDNTILRAHAMFGNEWATIARLLSGRTDYAIKNHWNSTLKRKYSSSLVLSCPAAYSAF

SEQ ID NO: 4773 - protein, 427 aa, Arabidopsis thaliana
MDPRLIVATQIGSIDELYAHIHENPYILEIIDAIPFINTPLHIASASGNLSFAMELMNLKPSFARKLNTYGLSPLHLAIEEGQTRLVLSLLKVDSDLVRLRGREEFLLACPGCIKDANVNGETALHIAVSNDRYEELEVLLGWVQRLRQTDAESLEMQFLNKRDQDGNTALHIAAYQNRFKAVKILVKCSAVNRNIHNRTGLTALDILHNQRDHHANSNIENIIRKWGGKSGNSLPKSKKVSEILRSPISFTEHLFTQTARYRNQTSEGTRSALLVIAALIITATYQTALQPPGGVYQENAAEESKKSVGTVVMSHKYFFVLRGVNTMAFVGAIFMAFCLLPAGEGYVWWFLWIAVPLYVSYLVSMSVISPDTVWYVSTNAGSVIIVVFAYMVVFFLRWKRSKKKVPGTSSELILEGLTTLDLAKGS

SEQ ID NO: 4774 - protein, 538 aa, Dubautia raillardioides
MKRSRERKKEAKITSSVPDSGGMDELLEVLGYKVKSTDMADVAQKLEQLEMVMGEDGVLQLSDTVHYNPSDLSGWVQSMLSVLNDYNNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKHVVILVASQAGAMAKVSTYFAGALAQRIYNIYPQNALETSCYEILQMHFYETCPYLKFAHFTANQAILEAFAGATRVHVIDFSLKQGMQWPALMQALALRYDGPPAFRLTGIGPPQPDNSDALQQVGWKLAQLADTIGVEFEFRGFVANSIADIDADMLDIRASETEVVTVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4775 - protein, 443 aa, Physcomitrella patens subsp. patens
MGAPKQKWTAEEEAALRAGVEKYGPGKWRAIQKDSKFGPCLTSRSNVDLKGTVSEVIKVFNFSFLRFVNGCKQRSCPAVSIRRAVSYRILNEMDKWRNMSVSANGLGSARKPLAITAGPGMLTLMEDVASVKPLSVVAPGDEGYVVKRESADTSGDRKSLGSRYDNMVFEAVLGLKEPYGSSNASIASYIEEPVTWGYVFIANNCIWRIFIHKQLDTKFEGCSGYGEELIVDSSVEVIELGQQTSLNRHCASERHAVPSNFRRLLTTKLKSLALSGKLVKVRQNYKMNEGNESPSSVAEEPEVREREREREREHVGTVSDGRVQKGSRLRRQEVHCDDSNKPHPSRVPRDAWDLRDSSKRIRPESLPYKKPKTDIEHLARARAKTAEEAARAAALAVAEAEAAAAAAEAAAREAEAAEAEAEALEAAAEAAAAAAIRHPKKCT

SEQ ID NO: 4776 - protein, 538 aa, Wilkesia gymnoxiphium
MKRSRERKKEAKTTSSVPDSGGMDELLEVLGYKVKSTDMADVAQKLEQLEMVMGEDGVLQLSDTVHYNPSDLSGWVQSMLSVLNDNNNTPPSDHIVLSGDSSTTMIDFSNSSEIVVHGKQGSKMHEDDPYDLRAIAGGAIYGGESESLVRGNGNGIKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNTDALQQVGWKLAQLADTISVEFEFRGFVANSIADIDANMLDIRPSETEVVAVNSVFEVHRFLARPGDVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4777 - protein, 538 aa, Argyroxiphium kauense
MKRSRERKKEAKTTSSVPDSGGMDELLEVLGYKVKSTDMADVAQKLEQLEMVMGEDGVLQLSDTVHYNPSDLSGWVQSMLSVLNDNNNTPPSDHIVLSGDSSTTMIDFSNSSEIVVHGKQGSKMHEDDPYDLRAIAGGAIYGGESESSVRGNGNGIKRVKSTAVGSVDVQPESPRPVVLVDSQEAGIRLVHTLMACAEAVQHNDLKLADALVKHVGILVALQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAVEKVLSGITKMKPKIVTLVEQESNHNSAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4778 - protein, 210 aa, Triticum aestivum
MAPKNAAPAAAAADAGMEPRFRGVRKRPWGRYAAEIRDPARKARVWLGTFDTAEAAARAYDAAALHYRGPKAKTNFPVGTVAAFAHVPLPPPKALAVSPSSSTVESSSRDTPAAPPAAPAPPPALDLSLAMPAMVAAQPFLFLDPRVAVTVAVAAPAPAPCRSAAISGMNKAASREEEQSDTGSSSSVVDASPAVGVGFDLNLPPPVEMA

SEQ ID NO: 4779 - protein, 538 aa, Argyroxiphium sandwicense subsp. macrocephalum
MKRSRERKKEAKTTSSVPDSGGMDELLEVLGYKVKSTDMADVAQKLEQLEMVMGEDGVLQLSDTVHYNPSDLSGWVQSMLSVLNDNNNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLDIRPSETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4780 - protein, 337 aa, Triticum aestivum
MEASKGSDGSSGASASNDDSTVEEEGAGRESHEDACRGNSLSSSSVRPYVRSKNPRLRWTPELHHCFVRAIHRLGGQDRATPKLVLQLMNVRGLSIGHVKSHLQMYRSKKIDDSGQVIGHLPLPHAFHHRQSGAGTMSSRFGAAAWPPWRSFHEPYWAHGRPFLGSRTYNSLEAETEAAFLRSRAQHVARAASSNPGLMMQSGCASLNDHHTMNHQHKRLLQPTVRNDDDTHVPLDLDLDLDLSLGLPVPRKEAKWKRSGCGWVKEGPDENGADEEQVDEISTATMLSLSLFSPGDAPRMMSSTSASDRAVNVSVDIKRGGKDEHATRRASTLDLTI

SEQ ID NO: 4781 - protein, 212 aa, Ehrharta erecta
ISVLCDTEVAAIVFSPKGKLYEYATDSRMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKHAVRQQQQVQWDQTQQAQAQAQAQAQAQTQAQTSSSSSFVMRDQQQLQAAQQNICYPPVSMGEAAAAAA

SEQ ID NO: 4782 - protein, 468 aa, Oryza sativa Indica Group
MPPCVWGSHTPLSLLSPPAAWAGERMEGDQAGGDLTDIVRAGGGAMPGSVVVDLPSTAAEWQLPAEPMLFPPPPSLSSTTDGCGAGGAAGADIFGGGGGDLFSGLVDPFSSDYSSGADFLDAMPDAMAKVGFDTAVGGGCGGGGGGGGGSGGHLLDMSRKPLLPRGMPMAAVGGLAAPRVMPSPLSPRAIRPYPPISAGDMMKLGITAGQAAGCAIDAAVAGMQMSSPRSGGIKRRKNQARKVVCIPAPTAAGGRPSGEVVPSDLWAWRKYGQKPIKGSPYPRGYYRCSSSKGCSARKQVERSRTDPNMLVITYTSEHNHPWPTQRNALAGSTRSHHSKNSGGGGGSGSKGSQNDKSQQQPSVKEEQKDQATTATTTTTSTITTTNSASPVVVKEEEAALAGSSEALDTTAAGVVDHSELMDHVFSESYKPMIPETGQPDDFFADLAELEYKKIIFYVDVLLGYRDSS

SEQ ID NO: 4783 - protein, 131 aa, Sophora flavescens
KDRHSKIHTSQGLRDRRVRLSSEIARKFFDLQDMLEFDKPSNTLEWLFTKSENAIKELARSKNSSSCSGGDKCPCDQPHGGVGTSNEKSLGGSGGDASKGRKLKWAQRDQDVCVQTKKESREKARARARER

SEQ ID NO: 4784 - protein, 300 aa, Vitis vinifera
MSRSCSQCGNNGHNSRTCTESGGAGAAANDIMLFGVRITEGAFRKSASMTNLSQYEQPQDSNADAGYASDDVVHASARSRERKRGVPWTEEEHRLFLLGLQKVGKGDWRGISRNFVKTRTPTQVASHAQKYFLRRNNHNRRRRRSSLFDITADTFMGSTILEEDQVHQETVSPPQLHSHLNGSAGGFPVPTFPVTMAPVVLPVASNGSMEILTLGQSNQAKGPTKLIRPIPILPVPPSSKMADLNLNIPSTADPLPLSLKPSSSTSTSPQSPTATRHSSAFQAMSESFNSSTGDNIISVA

SEQ ID NO: 4785 - protein, 198 aa, Leersia virginica
VALIIFSTKGKLYEYATDSCMDKILDRYERYSYAEKVLISAESEIQGNWCHEYRKLKAKVETIQKCQKHLMGDDLESLNLKELQQLEQQLENSLKHIRSRKSQLMLESINELQRKEKSLQEENKVLQKELVEKQKVQKQQVQWDRTQPQTSSSSSSYMMREALPATNISNYPAAAGERAEEVAGQPQHVRIGPATMDA

SEQ ID NO: 4786 - protein, 138 aa, Sophora flavescens
KDRHSKIKTARGLRDRRMRLSLEVAKRFFGLQDMLGFDKASKTVEWLLNQAKLEIKQLEREKNIHHPGFCISVNGIAKSASSTSECEGVSSLDEVAVSGNIQEQKRIGKRKAKLSRKNALKPVGRESREKARARARER

SEQ ID NO: 4787 - protein, 99 aa, Scrophularia californica
IHTAQGARDRRVRLSIGIARKFFDLQEMLGFDKPSRTLDWLLTKSKAAIKELAASGKTKSRISSPSECEVVSAENASSDSKSKGKDPCQLASNLAKESR

SEQ ID NO: 4788 - protein, 118 aa, Brassica napus
MQDQLVCHGCRNTLMYPRGATNVRCALCHIVNMVPLHPHPPPPHHAHAGMDMAHIVCGGCRTMLMYTRGASSVRCSCCQTVNLVPGPPPSNQVAHINCGNCRTTLMYPYGASSVKCAV

SEQ ID NO: 4789 - protein, 245 aa, Hordeum vulgare subsp. vulgare
GTRCGLAAMSSYSSLISVSPGEQIGGYADQGDDDDMAAAANYLSSFCFDFGDEYSVGKAATASYPLHGQQQQAPTKADSHHSGQAASITSSQRFDNINTSLTSSDARSKGSKIAFKTRSEVEVLDDGYRWRKYGKKMVKNSPNPRNYYRCSSEGCRVKKRVERDRDDERFVITTYDGVHNHLAPLPPQGCAGYSLSLAQTRVDEGSSPLPMEGRRCFLDAMKMHAAGSLAGSSPVPAPRTLERHN

SEQ ID NO: 4790 - protein, 208 aa, Brachypodium distachyon
ISVLCDAEVALIIFSTKGKLYEFATDSCMDKILERYERYSYAEKVLISTESEIQGNWCHEYRKLKAKVETIQKCQKHLMGEDLESLNLKELQQLEQQLESSLKHIRSRKNQLMHESISELQKKERSLQEENKVLQKELAEKQKAHTQQAQWEQTQPQTSSSSSSFMIREAPPTTNISNRPGAAGERTEEAAGQTQARVGLPPWMLSPL

SEQ ID NO: 4791 - protein, 101 aa, Scrophularia californica
IFTAQGPRDRRVRLSIGIARKFFDLQEMLGFDKPSKTLDWLLSKSKAGIKELVQMKEKATSSSPSECEVISSEAFENGYSDLKRKSSYKGKEASNLAKESS

SEQ ID NO: 4792 - protein, 105 aa, Scrophularia californica
AQGVRNRRMRLSLQVARKFFDLQDLLGYDKASETIEWLFSKSKKAIKELTNQQGNNRTYISISDAKSVSFVSECEVVSKHEKKSKKNERKMRKMCSKLNSRESRD

SEQ ID NO: 4793 - protein, 453 aa, Triticum aestivum
MAPKHGAGAGGSQHMTQHSIGGAGGGGSQHMVQHSAGGGGGSQHMAQHSAGGGGGGGSQHMVQHNTGAGGGADGGMDIGMGVVAVSGDAKGDQGGEAGQDEQVKKKRGRPRKYKPDGSVTLGLSPSPSTPHSSSPGMGAMVTTPGSGFGPGTGSGGSGSGALTEKRGRGRPPGSGKMQQLASLGKWFLGSVGTGFTPHVIIISAGEDVAARIMSFSQQGPRAICIISATGAVSTATLHQDSDSGAVTYEGRFEILCLSGSYLVVEEGGTRTRSGGLCIALCGPDHRVIGGSVSGVLTAAGTVQVIVGSFMYGGGSKKNKGKADQDVENEEQNGGGGGEETPTLALPEHPHNMPPHPMSGWPPGLMNQMDLRSSPMYGSLSKQNQTKAEQEMEERNGGGAGGEEPLAMAHPEDDMDPEHNMNMPPPRPMGGWQPGLMRQMDSRSSSIDINSIRE

SEQ ID NO: 4794 - protein, 99 aa, Scrophularia californica
AQGVRDRRMRLSLQVARKFFDLQDLLGYDKASKTIEWLFSKSKKAIKELTNQQGNNSYISISDAKTVTFLSECEVVSSKKNERKMRKTGSKPNNRESRD

SEQ ID NO: 4795 - protein, 158 aa, Glycine max
MNSEAFNWNIAESESPAQAQEDEVSKVRTNKKDIFLRLNYEEVITAWASQGSPWTTGTPPKFFNSDDCWLDLGSNGGGVQCYYGEVRSLRVHADGGREARVSRYREKRRTRLFAKKIRYEVRKLNAEKRPRMKGRFVKSVPLLEPLLCQLNYQSSPLT

SEQ ID NO: 4796 - protein, 121 aa, Scrophularia californica
AQGIRDRRMRLSLQVARKFFDLQDMLGYDKASKTIEWLFTNSKKAINELVKDHPQANNISTSDAKSESFVSECEVVSGIEESSRIDVINIIAPPNSTPLSVKDEVKYLKDTLKPNTKESRD

SEQ ID NO: 4797 - protein, 321 aa, Oryza sativa Japonica Group
MDRQWRCLAAAASTSGNSKLPPLPMALGGAVEYGQLVHGAAAPVAPFFVDAEQQSLSPATAMVLGAGWYNYNLVTPSQAAQLHHRLRRAVGAAPCSMKRCGGMAAAAAGRLALVGPAPVQAKLYRGVRQRHWGKWVAEIRLPRNRTRLWLGTYDTAEDAALAYDGAAFRLRGDAARLNFPELRRGGRHHAPALSASVDAKILQATTTTTADTAAAAAPASTNTTPPPSPRVVKTEPGCCSVSEASTTTTADAADVSSTGSSPSPTSSNQAATATPPAPRPPPPLPETIQQLDFTEAPWDEADGFALRRYPSWEIDWDAILS

SEQ ID NO: 4798 - protein, 261 aa, Saccharomyces cerevisiae
GHMAEAFYEELKEKADIGEVAGDAIVSFQDVFFTTPRGRYDIDIYKNSIRLRGKTYEYKLQHRQIQRIVSLPKADDIHHLLVLAIEPPLRKGQTTYPFLVLQFQKDEETEVQLNLEDEDYEENYKDKLKKQYDAKTHIVLSHVLKGLTDRRVIVPGEYKSKYDQCAVSCSFKANEGYLYPLDNAFFFLTKPTLYIPFSDVSMVNISRAGQTSTSSRTFDLEVVLRSNRGSTTFANISKEEQQLLEQFLKSKNLRVKNEDRE

SEQ ID NO: 4799 - protein, 405 aa, Oryza sativa Indica Group
MEPAPLASLQEEGEGEPGESPSSAAAAVPPRPATHSKKGITNRMNSFFALFMYHHQQQLQSHNQLLPSRQSFPSERHLLMQGGSVSGESGLVLSTDAKPRLKWTPELHERFVEAVNQLGGPEKATPKTIMRLMGVPGLTLYHLKSHLQKYRLSKNLHAQANAGNVKNALVCTTATEKPSEANGSPVSHLNLGTQTNKSVHIGEALQMQIEVQRRVHEQLEVQRHLQLRIEAQGKYLQSVLEKAQETLAKQNAGSVGLETAKMELSELVSKVSTECLQHAFSGFEIESSQMLQGHTMHLGDGSVDSCLTACDGSQKDQDILSISLSAQKGKEIGCMSFDMHVKERGSEDLFLDKLNRRPSNHPERCERRGGFSMSCQTANLDLNMNDTYDGPKHCKKFDLNGFSWA

SEQ ID NO: 4800 - protein, 345 aa, Capsicum annuum
MDRVKGPWSPEEDELLQQLVQKHGPRNWSLISKSIPGRSGKSCRLRWCNQSSPQVEHRPLTPEEDDTIIRPHARFGNKWATIARLLNGRTDNAIKNHWNSTLKRKCCSLSADEGRELADQIFENHQPPLKRSVSAGSAMPVSGFHFSPGSPAGSDSDSSLHVTSSSQSHVFKPVAKTGGIFPPPSIDISSPSIDPPTSLSLSLPGADLAELSSRSAESTQSKNPFQLSLPPPVQVPPPPPPPPPPPQPQPVTAVPFEQQDKIFVPFSQELLRVMQEMIKTEVRNYMMGIEQKQQHPQQQHYQQQQQFQQQTHQLPSGLGLGLCMQQASDGYRDRAANRMGISKFD

SEQ ID NO: 4801 - protein, 245 aa, Physcomitrella patens subsp. patens
MSTNPRTVDEVFKDFKGRRLGMLKALTADVEEFYRQCDPEKENLCLYGFPEEAWEVNLPAEEVPPELPEPALGINFARDGMQRKDWLSLVAVHSDAWLLAVAFYYGARFDKNERKRLFNMINELPTVFDVVTGKKPVKDKPAVNNSSGTKTKSATKVVMAQAKPAKPVPPIQKDEEDAFDDEDEEEHGDTFCGSCGGPYTADEFWIGCDICEKWFHGKCVKITPARAEHIKQYKCPSCSNKRART

SEQ ID NO: 4802 - protein, 202 aa, Glycine max
MSSSLIANPTADRSRDSHRTKKKKKSLKQHQLQHEQSHAKWKSHAQQQLYSSKLHHALARVNISGDAPRRGRAVREAADRVLAVAAKGRTRWSRAILTNRLKLKFRKPIHKRQKVVVGPGRPKKARFSVLRLKGKTLPAVQRKVRVLGRLVPGCRKEPLPVILEEAIDYIPALEMQVRAMQALADLLLGSSSASTSAAAPPS

SEQ ID NO: 4803 - protein, 537 aa, Argyroxiphium sandwicense subsp. macrocephalum
MKRSRERKKEAKTTSSVPDSGGMDELLEVLGYKVKSTDMADVAQKLEQLEMVMGEDGVLQLSDTVHYNPSDLSGWVQSMLSVLNDNNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLDIRPSETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 4804 - protein, 247 aa, Helianthus annuus
SYMSSCPFKKNEIFFANKTIYEAALSSSTLHIVDFGIAYGFQWPILIKHLGDRPGGPPKLRITGIEFPQPGFRPAEWVEETGRRLATYCERFKVPFEIYNAIAIQNWEMINIDDLKLQRNEFLAVNALARFENLLDETMVTGSSPRDAVLKLVRDMKPDIFVHSIVNGSYSAPFFVTRFREALFHYSALFDMLDATIERENEQRQSYEGEFHGRQVMNVIACEGPQRVERPETYKQWQVRITRAGSN

SEQ ID NO: 4805 - protein, 535 aa, Madia sativa
ERKKEAKTTSSVPDSGGMDELLEVLGYKVKSTDMADVAQKLEQLEMVMGEDGVLQLSDTVHYNPSDLSGWVQSMLLVLNEDNNNTLDDDVSDHILLPGNSSTTMIDFSSSRTETVNRKHGSKMLEDDPYDLRAIAGGAIYRPESEGIGNGMKRMKTTAAGSEVVDVQPESPRPVVLVDSQEAGIRLVHTLMACAEAIQHNDLKLADALVKHVGILVASQAGAMAKVATYFAGALAQRIYNIYPQNALETSCNENLQMHFYETCPYLKFAHFTANQAILEAFAGATRVHVIDFSLNQGMQWPALMQALALRSGGPPAFRLTGIGPPQPDNSDALQQVGWKLAQLADTIGVEFEFRGFVANSIADIDANMLDIRASETEVVAVNSVFEVHRLLARPGSVEKVLSSITGMKPKIVTLVEQESNHNGAVFMERFNEALHYYSTMFDSLESSALTLPNSQDDLVMSEVYLGRQICNVVACEGTDRVERHETLTQWRVRMNSAGFEPVHLGSNAFKQASMLLALFSGGDGYRVEENDGCLM

SEQ ID NO: 4806 - protein, 163 aa, Arabidopsis thaliana
MANESNNLGLEITELRLGLPGDIVVSGESISGKKRASPEVEIDLKCEPAKKSQVVGWPPVCSYRRKNSLERTKSSYVKVSVDGAAFLRKIDLEMYKCYQDLASALQILFGCYINFDDTLKESECVPIYEDKDGDWMLAGDVPWEMFLGSCKRLRIMKRSCNRG

SEQ ID NO: 4807 - protein, 255 aa, Oncidium Gower Ramsey
MKRKPYGNDDELNKGPWTALEDELLTSYINASGEGKWTSVPKNAGLKRCGKSCRQRWLNYLRPDIKRGNISEEEEELIIRLHKLLGNRWSLIAGRLPGRTDNEIKNYWNTTLSKKLENLNFALNMPNNKAFTPISSKPHHEHYNSSSSSTHALIRTKALRCTKASHSYFPLQIPSSADGIDQIEQINQQNFGDELMENETMVGVKSSNLPSFDDEMWFNGLEFDGLIDGNDEDGILIEDDWASGSILETDIWLNF

SEQ ID NO: 4808 - protein, 548 aa, Carlquistia muirii
MKRSREHKKEAKSTSSVPDSGGMDELLEVLGYKVKSTDMADVAQKLEQLEMVMGEDGVLQLSDTVHYNPSDLSGWVQSMLLVLNDDNNNNNTADDSDHIFLPGNSLTTMIDFSNSTETVVHGKQRSKLHEDDPYDLRAIAGGAIYRSESESSMRGNGNPNGNGMKRMKTTAAGSEVVDVQPESPRPVVLVDSQEAGIRLVHTLMACAEAIQHNDLKLADALVKHVGILVASQAGAMAKVATYFAGALAQRIYNIYPQNAIETSCYEILQMHFYETCPYLKFAHFTANQAILEAFAGATRVHVIDFSLNQGMQWPALMQALALRSGGPPAFRLTGIGPPQPDNSDVLQQVGWKLAQLADTIGVEFEFRGFVANSIADIDVSMLDIRAPDTEVVAVNSVFEVHRLLARPGAVEKVLSSITGMKPKIVTLVEQESNHNGAVFMERFNEALHYYSTMFDSLESSALTLPNNQDDLVMSEVYLGRQICNVVACEGTERVERHETLTQWRVRMNSAGFEPVHLGSNAFKQASMLLALFAGGDGYKVEENDGCLM

SEQ ID NO: 4809 - protein, 548 aa, Carlquistia muirii
MKRSRERKKEAKTTSSVPDSGGMDELLEVLGYKVKSTDMADVAQKLEQLEMVMGEDGVLQLSDTVHYNPSDLSGWVQSMLLVLNDDNNNNNTADDSDHIFLPGNSLTTMIDFSNSTETVVHGKQRSKLHEDDPYDLRAIAGGAIYRSESESSIRGNGNPNGNGMKRMKTTAAGSEVVDVQPESPRPVVLVDSQEAGIRLVHTLMACAEAIQHNDLKLADALVKHVGILVASQAGAMAKVATYFAGALAQRIYNIYPQNAIETSCYEILQMHFYETCPYLKFAHFTANQAILEAFAGATRVHVIDFSLNQGMQWPALMQALALRSGGPPAFRLTGIGPPQPDNSDVLQQVGWKLAQLADTIGVEFEFRGFVANSIADIDVSMLDIRAPDTEVVAVNSVFEVHRLLARPGAVEKVLSSITGMKPKIVTLVEQESNHNGAVFMERFNEALHYYSTMFDSLESSALTLPNNQDDLVMSEVYLGRQICNVVACEGTERVERHETLTQWRVRMNLAGFEPVHLGSNAFKQASMLLALFAGGDGYKVEENDGCLM

SEQ ID NO: 4810 - protein, 706 aa, Zea mays
MTSSAAAAAAAAQVAGGGGGGEGDAAAAARGGGGTEDGMYTELWNLCAGPLVTVPRVGDKVYYFPQGHIEQVEASTNQVAEQHMQFYDLPWKILCEVMNVELKAEPDNDEVYAQLTLLPESKQPEENGSSEEMPASPPAALARPRVHSFCKTLTASDTSTHGGFSVLRRHADECLPPLDMTRQPPTQELVAKDLHGVEWRFRHIFRGQPRRHLLQSGWSVFVSAKRLVAGDAFIFLRTSPAEFVVPCDRYMESLKRNYPIGMRFKMRFEGEEAPEQRFTGTIVGNVDPDQAGWAESKWRYLKVRWDEASSIPRPERVSPWQIEPAVSPPPINPLPVHRPKRPRSNAVASLPESSAPTKEAAPKVTLETQQHALQRPLQTQDNVAPKSVFGDNSELDSAHKSSLRPSGFDLDKSTIGMQRKLGSDIWMRMNRPDGYSEMLSGYQPPNEGARNSQGFCSLPDQIAAGRPNFWHTVNAHYQDQQGNHNLFPGSWSMMPSSTGFGMNRQSYPMIQEVGGMSQSCTNTKFGNGVYAALPGRGIDRYPSGWFGHTTPGGRVDDAQPRVIKPQPLVLAHGEALKMKGNSCKLFGIHLDSPAKSEPLKSPPSVATPAAEKWMADGIDADKSPEPHKTPKQLGATQVDPVPERCPQASRGTQCKSQGGSTRSCKKVHKQGMALGRSVDLTKFNGYTELVAELDEMFDFNGELKGL

SEQ ID NO: 4811 - protein, 226 aa, Thalictrum dioicum
MGRGKIEIKRIENTTNRQVTFCKRRNGLLKKAYELSVLCEAEVALIVFSSRGRLYEYSNNSVKKTIERYKKASTDSPNSGSVSEANVQFYQQEASKLHNQIASLQNHNRNLLGESLSNLNIKELRQIEKKIEGGISKIRAKKNELLFAEVEYMQKREIDLQTDNKYLRAMIAANERAPPEHMNLMPANEYHIMSSAPFDSRNFLPANLLDHNNNYSRSDQTTLQLG

SEQ ID NO: 4812 - protein, 102 aa, Scrophularia californica
FTAQGPRDRRVRLSIAIARKFFDLQELLGFDKPSKTLDWLLTKSKAAIKDLMMVQKKSQNGVVSSSLSKCEVTSAGKMEYPEYGLDSKQKSGILKAKETRVK

SEQ ID NO: 4813 - protein, 535 aa, Oryza sativa Indica Group
MIVGAGYFEDSHDQSLMAGSLIHDSNQAPASSENTSIDLQKFKVHPYSTEALSNTANLAEAARAINHLQHQLEIDLEQEVPPVETANWDPAICTIPDHIINHQFSEDPQNILVEQQIQQYDSALYPNGVYTPAPDLLNLMQCTMAPAFPATTSVFGDTTLNGTNYLDLNGELTGVAAVPDSGSGLMFASDSALQLGYHGTQSHLIKDICHSLPQNYGLFPSEDERDVIIGVGSGDLFQEIDDRQFDSVLECRRGKGEFGKGKGKANFATERERREQLNVKFRTLRMLFPNPTKFISMMFFTDNSAMLLRVVLVLSQIMPYQIVGILKSYLAKFGLPPKLVKFWHYQYIDMVTNQNTPNCVHPNQNDRASIVGDAIEYIDELNRTVKELKILVEQKRHGNNRRKVLKLDQEAAADGESSSMRPVRDDQDNQLHGAIRSSWVQRRSKECHVDVRIVDDEVNIKLTEKKKANSLLHAAKVLDEFQLELIHVVGGIIGDHHIFMFNTKVSDGSAVYACAVAKRLLQAVDVQHQALDIFN

SEQ ID NO: 4814 - protein, 120 aa, Calceolaria tenella
CTAQGIRDRRMRLSLQIARKFFDLQDMLGNDKASKTIEWLFTKSKKAINELVKKPPQASILLASDLKSESFLSECEVESDIQENLNGEIKEDIKPTNIKSLCLNPFEVIEKKSRKNTSRD

SEQ ID NO: 4815 - protein, 323 aa, Hordeum vulgare subsp. vulgare
MEGEEKPVVGGAYWGVGARACDSCATEAARLFCRADAAFLCAGCDARAHGSGSRHARVWLCEVCEHAPAAVTCKADAAVLCASCDADIHAANPLARRHERVPVAPFFGAAADAHKPFPSSGAQAGAAASAEDDGSNDAEAASWLLPEPDHKDGANGATADVFFADSDHYLDLDFARSMDDIKAISVQLNGQPEIDLNGGNKGFYSDHSMNHSLSSSEAAVVPDAAAAPVVSRGREREARLMRYREKRKSRRFEKTIRYASRKAYAETRPRVKGRFAKRTGTADADALEEHEEMYSSAAAAVAALMAPGPDHDYGVDGVVPTLV

SEQ ID NO: 4816 - protein, 382 aa, Zea mays
MGKGRAPCCAKVGLNKGSWTPEEDMRLIAYIQKYGHANWRALPKQAGLLRCGKSCRLRWINYLRPDLKRGNFTAEEEEAIIKLHGLLGNKWSKIASCLPGRTDNEIKNVWNTHLKKRVSPAGEERGAAGSKKKKKKKTTKAAAGGGAEAPLPLPSPSPSSSTTTTNFSSGDSGEQQSNNMSKEADDELDLENFEMMPMLDVDDPSFGFGTLVDTAPAPYGSAVSVSASAATSPCASSTSPPPASAPPGVDDLLVLPEIDMGHELWSIIDGDAAEAPAPRCQRNPAEPTNGADAGSHGAEGKEWWLEDLERELGLWGTVEDYQYPMGPQGLLVADHPDPLPAMVDDPVSCYFQAGPASAVLQELPGYPVPATAVTGSINQMGL

SEQ ID NO: 4817 - protein, 118 aa, Calceolaria tenella
AQGIRDRRMRLSLQIARKFFDLQDMLGYDKASKTIEWLFTKSKKAINELVKNPPQASILLASDLKSESFLSECEVESDIQENLNGEIKEDIKPTNIKSPCLNPFEVIEKKTRKNTSRD

SEQ ID NO: 4818 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQQHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 4819 - protein, 821 aa, Lotus japonicus
MMDSPEPSKINRSSSASALNASVNTPSSESPQVQESPFFRFASNLSPMRPAKACHVAPSFLGLNSPPLVFKSPRVNCDRESRYLERPQGTHLSSVEMSQSYNGGNSLRVAPGDSNESNSQLPLPERFATDTQQDIGLRNDTNTQSCSFPTSVDEYLADPGDTDEMYSVNPDVEQSTYAVESEPSNLTRTKKVILKCNGNDDPGDKAEEPSPLSEESNEIHQERPVENPETEGDKRVVERVSQEHTKLESNLAADVSHNSLTQHAGNGPDHSDCAAQSMSDPLQDVKESKDCHEMVSTLHVRQENISQDGSEASLKYHGIRRRCLKFGEAASSALGSNMSNMKLNATSSQMHFVNPFKPVSSLYLQRGIPETGSKPADYFSPSLKEPIALYPASGHDKRKLSPTDAGNSEGLDQHTPGKKKKKTSSTADGNGCKRCNCKKSKCLKLYCDCFAAGVFCLDPCSCQDCFNKPEYGEKVLETRQQIESRNPLAFAPKIVKSATNAPSNMEDVNLTTPSSARHTRGCNCKRSMCLKKYCECYQSNVGCSSGCRCEGCKNVYGKKEDYVAPDHALSKERVSSNVEKGSDSTMLNKPEMVASREDLFQKEFYDQHHLSPITPSLQCSDQGKDMFPSHRSLMLTDSCDSKSYENVQSPAPPCNSASCILQLTPLSNPDSTSGAPSIPAKPVGTSAPSSRVSHGCVRQLSGGSLRWRSSPVTPRNTNLGEAQHLQGLESDSRLFDIVEDETPAILKESSTPTKTVKANSPIQKRVSPPRVIGSSSSGGLRTGRKFILKSVPSFPPLTPCMDSKGNGNEDGNVDSGNGATK

SEQ ID NO: 4820 - protein, 132 aa, Calceolaria tenella
RTAQGIRDRRMRLSLQAARKFFDLQDLLGYDKASKTIEWLFTQSNKSIKELAQDQEQAKNISNSDAKSESFVSECEVVSGINENSNDSDIMKGIKINAPKNLSLLSTHGRNDRKLRKPACKSSAKVSRDEAR

SEQ ID NO: 4821 - protein, 330 aa, Capsicum annuum
MESYKEIKIEDHPMYYLDNNFAVTNSHSFTGLISDYYGVEGRNIMNTSSSLGFMELLGFQDLMCSSSASFFELPKEENSCPAVCVSEEVKPTAGESQNKLISTVAAANVFNTPSTPNCSSISSETNEGHTNTTHEDAEAGEVLDHQDQQHTNTKQQLKAKKTVSQKKQREPRFAFMTKSEVDFLEDGYRWRKYGQKAVKNSPFPRNYYRCTSATCNVKKRVERCFSDPSIVVTTYEGKHTHLSPMNTIMPRPSCYPITPVPASPGAFPLPMQFNINQSFNNLTSSLAMNNQLDHAAFVAQGRRFCTSEMLGDEGLLQDLMPSTLIKENYR

SEQ ID NO: 4822 - protein, 132 aa, Calceolaria tenella
RTAQGIRDRRMRLSLQAARKFFDLQDLLGYDKASKTIEWLFTQSNKSIKELAQDQEQAKNISNSDAKSESFVSECEVVSGINENSNNSDIKKGIKINAPKNLSLLSIHGRNDRKLRKPACKSSAKVSRDEAR

SEQ ID NO: 4823 - protein, 138 aa, Oryza sativa Japonica Group
SDDKALKRHLLRKYSGYLGGLRKELSKKRKKGKLPKEARQKLLTWWELHYRWPNPSEMEKIALAESTGLEQKQINNWFINQRKRHWKPTEEMEFAVMEAYHHQSTDAAAAFYVDVDARLVGATAAAPASAVYTARPDH

SEQ ID NO: 4824 - protein, 138 aa, Oryza sativa Japonica Group
SDDKALKRHLLRKYSGYLGGLRKELSKKRKKGKLPKEARQKLLTWCELHYRWPYPSEMEKIALAESTGLEQKQINNWFINQRKRHWKPTEEMEFAVMEAYHHQSTDAAAAFYVDVDARLVGATAAAPASAVYTARPDH

SEQ ID NO: 4825 - protein, 261 aa, Saccharomyces cerevisiae
  misc_feature (3)..(3): Xaa can be any naturally occurring amino acid
  misc_feature (80)..(81): Xaa can be any naturally occurring amino acid
  misc_feature (83)..(83): Xaa can be any naturally occurring amino acid
  misc_feature (202)..(202): Xaa can be any naturally occurring amino acid
GHXAEAFYEELKEKADIGEVAGDAIVSFQDVFFTTPRGRYDIDIYKNSIRLRGKTYEYKLQHRQIQRIVSLPKADDIHHXXVXAIEPPLRQGQTTYPFLVLQFQKDEETEVQLNLEDEDYEENYKDKLKKQYDAKTHIVLSHVLKGLTDRRVIVPGEYKSKYDQCAVSCSFKANEGYLYPLDNAFFFLTKPTLYIPFSDVSXVNISRAGQTSTSSRTFDLEVVLRSNRGSTTFANISKEEQQLLEQFLKSKNLRVKNEDRE

SEQ ID NO: 4826 - protein, 399 aa, Triticum aestivum
  misc_feature (154)..(154): Xaa can be any naturally occurring amino acid
VNYRTSLYKKAGWYRSGIPGISSTHASGPQRLITPRHTSRTHSSPLPTAPPIARTSAIPPPRRDQRYKMSNRATHWCYACRRPIRLRGQEIICPNCNDGFIQEISEIGGALNNYGMFGPRFDDRLDGRFGMMDAMSALMRRRMAEMSSNPVFDXNAAWASTTQGRPSPIGPRLIFGSNMPAQGSDDSGVNVLVRGGRRIGADRPNFSGFLVGGPSLEALFEQLLLQTGNRQGPAPAPQSVIDSMPVVRITRRHLSDDPVCPVCTERFEIGSEAREMPCKHLYHASCIIPWLVQHNSCPVCRHPLPPQRGSDNNAARPQPSAQAGEAVSRGVDGAGADPGPVMRNGADEGGSPFSFLWPFGSSSSGPSSYQYGGGGGEPAPAVYNDDPGQITYSEWHYDP

SEQ ID NO: 4827 - protein, 609 aa, Arabidopsis thaliana
MDTPEKSETQIGTPVSKLKVEDSPVFSYICNLSPIKTIKPIPITCPLSSLNYASPPSVFTSPHAVSHKESRFRSQKDVSASKEVGEEEALVGSEPEQSYKNDCNTPRVTNDVKDNGCGKDLQVMMDNVKKKSDTPDWETLIAATTELIYGSPRESEAFSCLLKKTSNSEARLRGSITATSVAVTNTDVVNNESESVDALSILHRGVRRRCLDFEVKGNNQQTLGESSSSCVVPSIGLHLNTIAMSSKDKNVANEYSFSGNIKVGVQSSLTPVLHSQHDIVRENESGKDSGQIIEVVPKSLASVDLTPISPKKKRRKSEQSGEGDSSCKRCNCKKSKCLKLYCECFAAGFYCIEPCSCINCFNKPIHKDVVLATRKQIESRNPLAFAPKVIRNSDSIIEVGEDASKTPASARHKRGCNCKKSNCLKKYCECYQGGVGCSINCRCEGCKNAFGRKDGSLFEQDEENETSGTPGTKKTQQNVELFKPAAPPSTPIPFRQPLAQLPISSNNRLLPPQSHFHHGAIGSSSSGIYNIRKPDMSLLSHSRIETITEDIDDMSENLIHSPITTLSPNSKRVSLSHLDSPESTPWRRNGGGRNLIRSFPTFPSLTPHH

SEQ ID NO: 4828 - protein, 244 aa, Antirrhinum nuttallianum
ATSVIDLNGNEIQLHDMLSGHYLTTANAPVLDSTALFNNSFNHEVVNGLNRDPSPTFPTKQAAKKDRHSKIYTSQGPRDRRVRLSIGIARKFFDLQEMLGFDKPSKTLDWLLTKSKTAIKELVQSKSTKSNSSSPCDDCEEVVSVDSENVTDHSKGKSVLLKANNKCKEAMDLAKESRAKARARARERTKEKMCIKQLNEAIVRNHQFEVSGNREAFVHPVFGFHQQNYGNTSNENWDQSNFVS

SEQ ID NO: 4829 - protein, 138 aa, Oryza sativa Japonica Group
SDDKALKRHLLRKYSGYLGGLRKELSKKRKKGKLPKEARQKLLTWWELHYRWPYPSEMEKIALAESTGLEQKQINNWFINQRKRHWKPTEEMEFAVMEAYHHQSTDAAAAFYVNVDARLVGATAAAPASAVYTARPDH

SEQ ID NO: 4830 - protein, 246 aa, Silene latifolia subsp. alba
MGRGRVQLKMIENKINRQVTFSKRRSGIIKKAHEISVLCDAEVALIIFSHRGKLFDFASDSCMEKILERYERYCYAEKQLASNDPDAQVNWTFDYAKLKAKLDLLQRNHRQYLGQDLDALNLKELQSLEQQLDVGLKHIRSKKNQLMHDSISELQKKERSMEEQNKMLTKKIKEKGKAATTETQQMQWQQQQQNHQDVATSSDYLIHPPVPLNMSNSYEKEQGGEGSRNDLNLTLESNCWAHHSLF

SEQ ID NO: 4831 - protein, 257 aa, Silene latifolia subsp. alba
MGRGRVQLKRIENKINRQVTFSKRRTGLLKKAHEISVLCDADVGLIVFSTKGKLFEYATDSCMEKILERYERYSYAERQLTAPDPDSHVSWTLEHAKLKARLEILQKNHRHYMGEDLDTLSLKELQNFEHQLDTALKHIRSKKNQLMYESIHELQKKDKALQEHNNTLSKKVKEKEKEKEKEKAIADQQAQWVQQNQELNPSAFFSSQVLPALNIRGNYETGSSVIVNEVAQTQNRSNSSNNNSLVPSWMLNHLAEQ

SEQ ID NO: 4832 - protein, 366 aa, Oryza sativa
MESCVPPGFRFHPTDEELVGYYLRKKVASQKIDLDVIRDIDLYRIEPWDLQEHCGIGYDEQSEWYFFSYKDRKYPTGTRTNRATMAGFWKATGRDKAVHDKSRLIGMRKTLVFYKGRAPNGQKTDWIMHEYRLETDENAPPQEEGWVVCRAFKKRTAYPARSMVETWDYSLHERNIMSAAAAAAFADPSAAYAQMRRQHRSGRFKQEAELDGAATALLHYSSHLAELPQLESPSAAAAPLQPNPSQLATAGEDDDCKGDNGGRRPKKARAAGDKVATTTDWRALDKFVASQLSPGECGSMEATAEAAAAAVAGVSSPLDHGDDDMAALLFLNSDERDEVDRWTGLLGSGAGASGVDGDLGICVFDK

SEQ ID NO: 4833 - protein, 540 aa, Calycadenia multiglandulosa
ERKKEAKASTSSSSSMAPAAKAKDLQNPPDSGGMDELLEVLGYKVKSTDMDDVAQKLEQLEMVMGEDGILQLSDTVHYNPSDLSGWVQSMLSELNNSGGDSDIGIGIPAGGESSTTMIDFSNNKEKQPEDPYDLRAIAGGAIYGEGSESSGNGIKRMKMKSTAEGSGAVDVPPESPPRPVVLVDSQEAGIRLVHTLMACAEAVQNNDMKLAEALVKHVGILVASQAGAMAKVATYFAGALAQRIYKIYPQDGGLETSCWEILQMHFYESCPYLKFAHFTANQAILEAFAGAARVHVIDFSLNQGMQWPALMQALALRPGGPPAFRLTGIGPPQPDNTDALQQVGWKLAQLADTIGVEFEFRGFVAASIADIDAAMLDIRLDEVVAVNSVFELHRLLARPGAVEKVLSSITSMKPKIVTLVEQESNHNGVVFMDRFNEALHYYSTMFDSLESSALTQPNSQQDLVMSEVYLGRQICNVVACEGPDRVERHETLTQWRTRMISAGFEPVHLGSNAFKQASMLLALFAGGDGYRVEENDGCLM

SEQ ID NO: 4834 - protein, 380 aa, Anisocarpus madioides
MKRSRERKKEASSVPDSGGMDELLEVLGYKVKSTDMADVAQKLEQLEMVMGEDGILQLSDTVHYNPSDLSGWVQSMLLVLNDNNTTTTADDSGHILLPGDSSTTMIDFSSETVVHGKPGSKIHQDDDLRAIAGGAIYRSESESSMPGNANPNGNGVKRMKTTAAGSEVVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGAKRVHVIDFSLNQGMQWPALMQALALRSGGPPAFRLTGIGPPQPDNSDALQQVGWKLAQLADTIGVEFEFRGFVANSIADIDANMLDIRLPE

SEQ ID NO: 4835 - protein, 197 aa, Triticum aestivum
MVKTAAAGSTGDGAVAAKQQQLGGKMRTYKGVRMRSWGAWVSEIRAPGQKTRIWLGSHSTAEAAARAYDAALLCLKGASAAADLNFPVRFPFDLPAAAMSPKSIQRVAAAAAAGASANVFDFAAADDSASANAVDFAGADDSASAVTPEYCSSFFQSPKCMEYAMMDPCSTFFAPAPIAMEDECSWEEGGDIALWSY

SEQ ID NO: 4836 - protein, 143 aa, Anisocarpus madioides
RPGAVEKVLSAITKMKPKIVTLVEQESNHNGALFMERFNEALHYYSTMFDSLESSALTLPNSPDDLVMSEVYLGRQICNVVACEGTDRVERHETLTQWRVRMNSAGFEPVHLGSNAFKQASMLLALFADGDGYRVEENDGCLM

SEQ ID NO: 4837 - protein, 272 aa, Oryza sativa
  misc_feature (62)..(62): Xaa can be any naturally occurring amino acid
MEGGGGGGGGGGGGGGGGGGGGAPYATRTAEEVFRDLRGRRAGMIKALTTDVEKFYKLCDPXRENLCLYGYPNETWEVTLPAEEVPPEIPEPALGINFARDGMNEKDWLALVAVHSDSWLLSVAFYFGARFGFDREARRRLFNMINNLPTIFEVVTGAAKKQAKEKTPNSSSKSNKPSSKVQSKAESRSKSKLSAPKDEEGSGDDEGEEEEDDHDNTLCGTCGTNDGKDEFWICCDNCEKWYHGKCVKITPARAEHIKQYKCPDCTNKRTRA

SEQ ID NO: 4838 - protein, 542 aa, Argyroxiphium sandwicense subsp. macrocephalum
MKRSRERKKEAKTTSSVPDSGGMDELLEVLGYKVKSTDMADVAQKLEQLEMVMGEDGILQLSDTVHYNPSDLSGWVQSMLLVLNDNNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHKDLKLADALVKHVGILVASQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADINANILDIRAPETEVVAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 4839 - protein, 168 aa, Glycine max
DDQSFELSLEDETCEEVKEMKVSDLELGNELGEMKENDDDEVKRKKVSLQLDYEAIIIAWASQKSPWTTADKQNLDPDECWHQCMGSCGTAFHHPYGELGGFGIHSVIVDGGREARVSRYREKRRTRLFSKKIRYEVRKLNAEKRPRMKGRFVKRASFAPPTFPLLNK

SEQ ID NO: 4840 - protein, 351 aa, Oryza sativa
MDGDAWWYPGGGGGGGSNNWDLGAVVRFGCGGGRVSPAAALLGEAWEYDDDPFSSFLAPPMTAQQAALPAVWEEGDDGDAAWMAPLPGLQTGGGWGDQAPMVVDELCGALVVAPPPPPKQQEVLQVQQQPPPADNTQPTTYQQGSGGDGESTRAGGSRSARRKKKQTRKEVVRVAASGPAPDLWAWRKYGQKPIKGSPYPRGYYRCSSNKNCAARKQVERCRFDPSFLLLTYTGAHSGHDVPLHRNSLAGTTRHKPPPPPPLPSAADKSPATAAEAATASQSPGLSPTTPLRASSMELHGEDDAEAELQVEEDDMAIDDEDDDDVADETISTVPWGTPISDAIIAASYEWR

SEQ ID NO: 4841 - protein, 255 aa, Prunus persica
MGRGRVQLKRIENKINRQVTFSKRRSGLLKKAQEISVLCDAEVALIVFSTKGKLFEYSTDSCMERILERYERYSYSEKQLLANDHESTGSWTLEHAKLKARVEVLQRNCSHFMGEDLQSLSLKELQNLEQQLDSALKHIRSRKNQVMYESISELQKKDKALQEQNNLLAKKVKEKEKALAPQAESWEQQVQNQGLDCSSTLLPEALQSLNFGSGSNYQGIRNDGSGGDHEDENETPTANRPNTLLPPWMLRHLNE

SEQ ID NO: 4842 - protein, 541 aa, Argyroxiphium sandwicense subsp. macrocephalum
MKRSRERKKEAKTTSSVPDSGGMDELLEVLGYKVKSTDMADVAQKLEQLEMVMGEDGILQLSDTVHYNPSDLSGWVQSMLLVLNDNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHKDLKLADALVKHVGILVASQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAAEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 4843 - protein, 365 aa, Arabidopsis thaliana
  misc_feature (72)..(72): Xaa can be any naturally occurring amino acid
MPTLYKKAGCMVAIRKEQSLSGVSSEIKKRAKRNTLSSLPQETQPLRKVRIIVNDPYATDDSSSDEGELKVXPKPRKMKRIVREINFPSMEVSEQPSESSSQDSTKTDGKIAVSASPAVPRKKPVGVRQRKWGKWAAEIRDPIKKTRTWLGTFDTLEEAAKAYDAKKLEFDAIVAGNVSTTKRDVSSSETSQCSRSSPVVPVEQDDTSASALTCVNNPDDVSTVAPTAPTPNVPAGGNKETLFDFDFTNLQIPDFGFLAEEQQDLDFDCFLADDQFDDFGLLDDIQGFEDNGPSALPDFDFADVEDLQLADSSFGFLDQLAPINISCPLKSFAASHPAFLYKVGIIRKHCLSICCNEQVTISQNK

SEQ ID NO: 4844 - protein, 95 aa, Ligustrum ovalifolium
FTAQGPRDRRVRLSISIARKFFDLQEMLGFDKPSKTLDWLLTNSKTAIDELQVNINQVVSDAENGDQSLRMDSKRKSLMDDKQAAIYLATRESRA

SEQ ID NO: 4845 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQQQHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 4846 - protein, 411 aa, Arabidopsis thaliana
MEPTHRALPVGFRFRSTNCEISNYFLKKKALGQPMKARTIPEECHDIFSRHPHDLPGYPSEEHWYYFCRKRDNQVTSNSHNLWTPIGEETNVLDPKNNDALVGIKRRFTLIAQEEEESDNICLSDDEEALKYNWFMDEISLPQTVANTDWLLKKMQSEESHELTDGISEEKESKETMKSQKADRKKKKLKEKLLKEASKADNRGVCYLSRIPPHMDHVRLRHILAQYGELGRIYLAPEDSEAQVHRKRAGGFRGQRFSEGWVEFAKKSVAKRVADMLNGEQIGGKKKSSVYYDIWNIKYLTKFKWDDLTEEIAYKSAIREQKLNMVLSAAKREKDFYLSKIEKSRAMTEIDARMEKKRKIQEESGSNAEAAPVFPPRAIFQFRQKKSIENETSQSKPGLSTDFLASVFGGS

SEQ ID NO: 4847 - protein, 274 aa, Picea sitchensis
MKEEDWLAKWEDELPSPEELMPLTQNLITPDLAAAFKIHPSSASASAPTESGSVFPGSGQQQQRPGVEPPKRIELEEEESSVGGVTENVGEEPARTLKRPRLVWTPQLHKRFVDAVAHLGIKNAVPKTIMQLMNVEGLTRENVASHLQKYRLYLKRMQGLSSEGPSSCDQLFASTPVPPSHFLHRDDMVVPLVPMGMGVPGLGHGHMVPGPPHYGGFDPRYLTTLSRQQQQPPPPQRLGPSAATPRGEYVVVEDLSSTVTPPRQVLTLFPTGDN

SEQ ID NO: 4848 - protein, 108 aa, Ligustrum ovalifolium
NTAHGPRDRRMRLSLDVARKFFGLQDVLGYDKASKTVDWLLKNSRSAIRELMKGPCVNKQTCSTVSSTSECEVVSGINDENKSTVISQKSELNKPPCTKEKKRRRATV

SEQ ID NO: 4849 - protein, 224 aa, Cycas edentata
MGRGKIEIKRIENTTNRQVTFCKRRNGLLKKAYELSVLCDAEVALIVFSSRGRLYEFANNSVKRTIERYKKTCADNTQGGAISESNSQYWQQEAGKLRQQIDILQNANRHLMGDALTSLSVKELKQLEIRLERGLSRVRSKKNEMLLEEIEIMQRREHILLAENQFLRTKIAEYESNQNTNVLIPGPEFDALPAFDSRNFLHANLIEAAAHHYTQQDQAALQLG

SEQ ID NO: 4850 - protein, 129 aa, Ligustrum ovalifolium
CTAKGIRDRRMRLSVQVARKFFDLQDMLGYDKASKTIDWLFTKSKKAIKELTKNHHQAKISSGNDNVKSECFVSGCEVALAIEENSKNEFKGVSATSVSPGNRHEKDDHLNYICKVVGKPKPNTRESRD

SEQ ID NO: 4851 - protein, 140 aa, Pentas lanceolata
AQGPRDRRVRLSIEISRKFFGLQDLLGFDKASLTLDWLLTKSKTAIRELLQTKQIDNPEDALCRRLCSLSEDGDFSKGTPEEEEAAVADDNNNIVNGESKKTAAVCSKIRKRKTGKQKKGAAKKPKIMTALEKLAKESRG

SEQ ID NO: 4852 - protein, 401 aa, Zea mays
  misc_feature (106)..(106): Xaa can be any naturally occurring amino acid
MSAAETAVSPTTTPQPQLQSDPNAAADAASSNSLWVADETQTLTEVLLQPQPNHLSPPPSGEGDDGITASGAPVGGDAAASASAAAAANATIEERVRGPWSPEEDXLLSNLVEKFGARNWTLIARGIPGRSGKSCRLRWCNQLDPQVKRKPFTEEEDRIIMAAHAVHGNKWASIAKLLDGRTDNAIKNHWNSTLRRRYCNDGQCKHGGSVERSIPKVSREVSEEPWPLNDLNSFTAMDVKDDPVQTAPDTSPRARHITDHCSITQVVDPPYLSRPAAKIGAFRPYYLGHTEPTQQEMPGAVVMFDSTHKVSTPESEVFKFVDPICFAAEVPDKCGYGCCGAHEQHRKNSLLGPEFSEFEGHPPVLNISFASLVSEISSIAWMRSGMQSSDSSNLMQSIPPT

SEQ ID NO: 4853 - protein, 340 aa, Glycine max
MGVPERDPLAQLSLPPGFRFYPTDEELLVQYLCRKVAGHHFSLPIIAEVDLYKFDPWVLPGKAAFGEKEWYFFSPRDRKYPNGSRPNRVAGSGYWKATGTDKIITTEGRKVGIKKALVFYVGKAPKGSKTNWIMHEYRLLDSSRKHNLGTAKLDDWVLCRIYKKNSSAQKVEANLLAMECSNGSSPSSSSHVDDMLESLPEIDDRCFTLPRVNSVRTMQQQDEKFGFQNMGSGFFTDWVNPTDLDSVSEFGSGCQTQGMVNYDCNDLFVPSVPPFGHSHVNYMVGAPPSEEEVQSGVRTQQADGAACFQQNPNARLLPGSGDPFGFGFIMGQQVEFGFRD

SEQ ID NO: 4854 - protein, 140 aa, Pentas lanceolata
AQGPRDRRVRLSIEISRKFFGLQDLLGFDKASLTLDWLLTKSKTAIRELLQTKQIDNPEDALCRRLCSLSEDGDFSKGTPEEEEAAAADDNNNIVNGESKKTAAVCSKIRKRKTGKQKKGAAKKSKIMTALDKLAKESRA

SEQ ID NO: 4855 - protein, 349 aa, Triticum aestivum
MGSNDPSTPSKASKPPEQEQPPATTSGTTAPVYPEWPGFQGYPAMPPHGFFPPPVAAGQAHPYMWGPQHMVPPYGTPPPPYMMYPPGTVYAHPTAPGVHPFHYPMQTNGNLEPAGAQGAAPGAAETNGKNEPGKTSGPSANGVTSNSESGSDSESEGSDANSQNDSHSKENDVNENGSAQNGVSHSSSHGTFNKPMPLVPVQSGAVIGVAGPATNLNIGMDYWGATGSSPVPAMRGKVPSGSARGEQWDERELKKQKRKLSNRESARRSRLRKQAECEELGQRAEALKSENSSLRIELDRIKKEYEELLSKNTSLKAKLGESGGGGGSDAVPDMNERGDTNGGSHQKEP

SEQ ID NO: 4856 - protein, 222 aa, Medicago truncatula
MTNFAQFYESWHTQFNNLIHQLKLSTSTQTDSEELIQKVLSHHQDYYNAKSMAAEKDPLHVLASPWATTLERSLHWIAGWRPTTAFHLIYTESSLLFESHIIDILRGFRTGDLGDLSPNQFRRVSDLQCDTVKEENAITEELSEWQDSASDMMGSEADINDKIERLVSIIKKADDLRLRTLRSVVEFLSPQQAVEFLIASAELVVGIRGWGLNHDRSRPRIR

SEQ ID NO: 4857 - protein, 226 aa, Triticum aestivum
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQRVLCTKDRQFMQQISDLQQKGTQLAEENMRLKNQMHEVPTVSTVAVAEAENVVPEDAHSSDSVMTAVHSGSSQDNDDGSDISLKLALPWK

SEQ ID NO: 4858 - protein, 339 aa, Arabidopsis thaliana
MSDKDEFAAKKKDLVNTPVDLYPPENPMLGPSPMMDSFRETLWHDGGFNVHTDADTSFRDSTGLFLQDTQIPSGSKLDNGPLTDASKLVKERSINNVSEDSQSSGGNGHDDAKCGQTSSKGFSSKKRKRIGKDCEEEEDKKQKDEQSPTSNANKTNSEKQPSDSLKDGYIHMRARRGQATNSHSLAERVRREKISERMKFLQDLVPGCDKVTGKAVMLDEIINYVQSLQCQIEFLSMKLSAVNPVLDFNLESLLAKDALQSSAPTFPHNMSMLYPPVSYLSQTGFMQPNISSMSLLSGGLKRQETHGYESDHHNLVHMNHETGTAPDHEDTTADMKVEP

SEQ ID NO: 4859 - protein, 109 aa, Physcomitrella patens subsp. patens
MIPSSSNHEQQQQQAQLQQQEKKASQLFAQRALQERRLKPPDQVIACPRCQSLNTKFCYYNNYSLTQPRHFCKSCRRYWTAGGTLRNVPVGGGCRKNKRTKPRTPEGQN

SEQ ID NO: 4860 - protein, 251 aa, Triticum aestivum
  misc_feature (123)..(123): Xaa can be any naturally occurring amino acid
  misc_feature (167)..(167): Xaa can be any naturally occurring amino acid
  misc_feature (185)..(185): Xaa can be any naturally occurring amino acid
  misc_feature (197)..(197): Xaa can be any naturally occurring amino acid
  misc_feature (234)..(234): Xaa can be any naturally occurring amino acid
MEQGEEDGDWMMEPAAGKKGGAMIDRKKRFSEEQIKSLESMFATQTKLEPRQKLQLARELGLQPRQVAIWFQNKRARWKSKQLERQYAALRDDYDALLSSYDQLKKDKQALLNQLEKLAEMLXERGGAKCGRYAGAAARDDVRLAVAGMSMKGRVVDAGGASKLYSXSEGCGGSGKLSVFGEDDXNRGLFLGPSLEXPPGHGGGFHGGLGRPITNRSRRRSFPFHSNWPVVRGXSRPCSSSQWWEFESPSE

SEQ ID NO: 4861 - protein, 138 aa, Oryza sativa Japonica Group
SDDKALKRHLLRKYSGYLGGLRKELSKKRKKGKLPKEARQKLLTWWELHYRWPYPSEMEKIALAESTGLEQKQINNWFINQRKRHWKPTEEMEFAVMEAYHHQSTDAAAAFYVDVDARLVGATAAAPASAVYTARPDH

SEQ ID NO: 4862 - protein, 71 aa, Oryza sativa
  misc_feature (55)..(55): Xaa can be any naturally occurring amino acid
  misc_feature (64)..(64): Xaa can be any naturally occurring amino acid
WIPRAAGIRHEKVLRGLSGAKVTRPGSFRSCQDGYAVKSSLKAEDGLLYPLEKGXSFLPKPPTXLILHEKN

SEQ ID NO: 4863 - protein, 168 aa, Glycine soja
MESEGRREGGERETTAATRKVEGAERRYKGIRMRKWGKWVAEIREPNKRSRIWLGSYSTPVAAARAYDTAVFYLRGPSARLNFPELLVREGPAALVAGCDMSAASIRKKATEVGARVDALQATLHHHYVPPRQLLSGGGGGSGDFPVRVVDLNKMPEPESSDCEWDVN

SEQ ID NO: 4864 - protein, 292 aa, Glycine max
MQEAGLGMGMGMMSGEVSAAGDHHRQVKAEIANHPLYEQLLSAHVSCLRVATPIDQLPLIDGQLSQSHHLLRSYASHHSHSLSPHDRQELDNFMAQYLIVLCTFKEQLQQHVRVHAVEAVMACRDIESTLQALTGVSLGEGTGATMSDDEDDLQMDGSLDQSSADGHDMMGFGPLLPTESERSLMERVRQELKIELKQGFKSRIEDVREEILRKRRAGKLPGDTTSVLKAWWQQHAKWPYPTEDDKAKLVEETGLQLKQINNWFINQRKRNWHSNSQSVNSLKSKRKREYAH

SEQ ID NO: 4865 - protein, 542 aa, Argyroxiphium kauense
MKRSRERKKEAKTTSSVPDSGGMDELLEVLGYKVKSTDMADVAQKLEQLEMVMGEDGILQLSDTVHYNPSDLSGWVQSMLLVLNDNNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHNDLKLADALVKHVGILVALQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAVEKVLSSITGMKPKIVTLVEQESNHNGNVFMERFNEALHYYSTMFDSLEGSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 4866 - protein, 237 aa, Triticum aestivum
MVKTAAAGSTGDGAVAAKQQQLGGKMRTYKGVRMRSWGAWVSEIRAPGQKTRIWLGSHSTAEAAARAYDAALLCLKGASAAADLNFPVRFPFDLPAAAMSPKSIQRVAAAAAAGASANVFDFAAADDSASANAVDFAGADDSASAVTPEYCSSSSNASPVSSPETASSGGADLDGVDLLGYGYSQCSLAEIEAFFQSPKCMEYAMMDPCSTFFAPAPIAMEDECSWEEGGDIALWSY

SEQ ID NO: 4867 - protein, 132 aa, Physcomitrella patens subsp. patens
VPVGFRFHPTDEELVGYYLHGKVGRSQRDQLIQELDLYKIEPWDLQEVCRIGDDPPENQNDWYFFSHKDKKYPSGNRANRATTAGFWKATGRDKPIHTQRHVTGMRKTLVFYKGRAPHGQKTDWIMHEFRLD

SEQ ID NO: 4868 - protein, 544 aa, Argyroxiphium kauense
MKRSRERKKEAKTTSSVPDSGGMDELLEVLGYKVKSTDMADVAQKLEQLEMVMGEDGILQLSDTVHYNPSDLSGWVQSMLLVLNDNNNNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHNDLKLADALVKHVGILVALQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAVEKVLSSITGMKPKIVTLVEQESNHNGNVFMERFNEALHYYSTMFDSLEGSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 4869 - protein, 431 aa, Oryza sativa Japonica Group
MEASAAKEKDKDGKKMSRVGSWGSMAFYSSSSSSRSQPVSAAEGKNGGKKEKRRSSISRSITCAGSICSTKESSVSSRGRGRLRRSGGGGGGDGGGGGSTSSRSLMGPGYHGDSAAAVSASSSFNSVMTAATSATATTTTTTTSSSATSPPSALSSPLSSIGGSFRAMQIRKLSGCYLHCHSVLDPRTLAAVVFSCPDCDEVFVKPDSLELHRSTRHAVSELGADDTSRNIVEIIFQSSWLKKNAPVCRIERILKVQSSDKTIKRFEQHKEAVKEKARSAGDEAGRNPRCVADGNELLRFHCTTFACSLGLAGGTALCCASSSPPPLHCKLCSIIKDGFRVDGNGRITTMATSGRAHDTAEVSPDGEKRAMLVCRVVAGRVKKLHSSNSSEDHDCDSVSPCSEGVYSDLDELFVFSPRAILPCFVVIYSGY

SEQ ID NO: 4870 - protein, 247 aa, Helianthus annuus
SYMSSCPFKKNEIFFANKTIYEAALSSSTLHIVDFGIAYGFQWPILIKHLGDRPGGPPKLRITGIEFPQPGFRPAEWVEETGRRLATYCERFKVPFEIHNAIAIQNWEMINIDDLKLQRNEFLAVNALARFENLLDETMVTGSSPRDAVLKLVRDMKPDIFVHSIVNGSYSAPFFVTRFREALFHYSALFDMLDATIERENEQRQSYEGEFHGRQVMNVIACEGPQRVERPETYKQWQVRITRAGSN

SEQ ID NO: 4871 - protein, 534 aa, Dubautia arborea
ERKKEAKTTSSVPDSGGMDELLEVLGYKVKSTDMADVAQKLEQLEMVMGEDGILQLSDTVHYNPSDLSGWVQSMLLVLNDNNTNNTAHDSGHILLPGDSSTTMIDFSSEIVVHGKPGSKIHLDDDLRAIAGGAIYRSESESSMPGNGNGVKRMKTTVAGSEVVDVQPESPRPVVLVDSLEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLNQGIQWPALMQALALRSGGPAAFRLSGIGPPQPDNSDALQQVGWKLAQLADTIGVEFEFRGFVANSIADIDANILDIRAPETEVVAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 4872 - protein, 256 aa, Silene latifolia
MGRGRVELKRIENKINRQVTFAKRRNGLLKKAYELSVLCDAEVALIIFSNRGKLYEFCSGPSSMLKTLERYQKCSYGAVEVNKPSKELESSYKEYLKLKARYESLQRAHRNLLGEDLGPLNVKELDQLERQLESSLKQIRCIKTQSMLDQLTDLQSKEHALMEANKSLKAELERIMVKDNQVRQSWEGHHEHQNVHYEHQHAHSQHQHAHSQGLFQPIDCNPNLHLGYNAETSDHQLTAGTSHAQVPGFLPGWMQM

SEQ ID NO: 4873 - protein, 456 aa, Picea abies
QYSGVTFYRRTGRWESHIWDCGKQVYLGGFDTAHAAARAYDRAAIKFRGAEADINFNHSDYEEDMKQMNNLSKEEFVHILRRQSTGFSRGSSKFRGVTRHKCGRWEARMGQFLGKKYIYLGLFDSEIEAARAYDRAAIRCNGAGAVTNFEPGLYQDELIAEGENGGDDHNLDLSLGMSAPTYSTVPLDEHKRTQFKSNKAESANYSEVPDWKKTRLLNTRTEDCNIQQTQLGQLFNVSPSSTGEKILSFQQLSNAEGGNNFTFLQPQHQVKCAISDKGDRQELINITDYNSVRHSRPSEDKTVNLFSEQAPGWSGIHSRSILNRNVPNNGNYDLQHDRNRRADGSIVSLLPPEKTPGWAWQLQAAATSLPAAPVFASAASSGFSPQIISAAVPSHDWLQKAGFHYVDQSIGRTSFTEKPKVAFQEDIPLGIDHLLSLSSGSTTTKFKALGLSRETK

SEQ ID NO: 4874 - protein, 537 aa, Dubautia knudsenii
ERKKEAKTTSSVPDSGGMDELLEVLGYKVKSTDMADVAQKLEQLEMVMGEDGILQLSDTVHYNPSDLSGWVQTMLLVLNDDNNNTADDSGHILLPGDSSTTMIDFSSEIVVHGKPGSKIHLDDDLRAIAGGAIYRSESESLMPGNGNPNGNGVKRMKTTVAGSEVVDVQPESPRPVVLVDSQEAGIRLVHTLMACAEAIQRNELKLADALVKHVGILVASQAGAMAKVATYFAGALAQRIYNIYPQNALETSCYEILQMHFYETCPYLKFAHFTANQAILEAFAGATRVHVIDFSLNQGMQWPAFMQALALRYGGPPAFRLTGIGPPQPDNSDALQQVGWKLAQLANTIGVEFEFRGFVANSIADIDANILDIRAPETEVLAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 4875 - protein, 258 aa, Triticum aestivum
  misc_feature (18)..(18): Xaa can be any naturally occurring amino acid
  misc_feature (231)..(231): Xaa can be any naturally occurring amino acid
MGRAPCCEKMGLKRGPWXTAEEDMTLVAHIEQHGHSNWRALPKQAGLLRCGKSCRLRWINYLRPDIKRGNFTSEEEEAIIQLHAMLGNRWSTIAARLPGRTDNEIKNVWHTHLKKRLESSSKPSGQAAPKRKAKKPAVAATASALEGPTSEPASSSPGQSLSMSPEQSLSTSSAAGYSMASSLENTGSSSSESEEFQIDDSFWSETLAMSVDSSGSGMETGDTFGVDSASXPSSSNDEMDFWVTLFMQASDIQSLSQI

SEQ ID NO: 4876 - protein, 244 aa, Silene latifolia
MGRGRVELKRIENKINRQVTFAKRRNGLLKKAYELSVLCDAEVALIIFSNRGKLYEFCSSPSMLKTLERYQKSNYGPPDNTAVSSREALEISSHQEYIRLKARYEALQRTHRNLMGEDLGPLSSKELESLERQLDMSLKHIRSTRTQYMLDQLADLQRKEHVLNEANITLKQRLIEADQVSSAQCYGHELDYGRQNPQAQADHVFFHPLECEPTLQIGYQPEQMNVTAAGPSINNFMTGWLPQN

SEQ ID NO: 4877 - protein, 337 aa, Triticum aestivum
MAPLSQHHMRIRDALAKKTKTKMLAGFGVKPSAALSKPAQLQAQTLLPAAQPPRRRVRVLYEDPDATDSDTDDEEAAAAPASSKRCFELFLGKAPPAKLFAKPVTPTAAASAVAACTTSSAEGHRGVRLRKWGKWAAEIRNPFSGKREWLGTFDTADLASAAYQAASRSFIEEKRRRRGQSAASTTPTSSSTTPTASSSSSTSAAPFAHPSPSSVLEATKPADESLSPEPTPVPVMVSTTAETAQLPDDPEFYQDLLRGLQLPDIDPMDFRAGLDALDVSEASAYLDGEQDLLLGDFADEELDLDMDLDIGDDFLEMPGCDFGRGMDDFLHTVDFCV

SEQ ID NO: 4878 - protein, 140 aa, Pentas lanceolata
AQGPRDRRVRLSIEISRKFFGLQDLLGFDKASLTLDWLLTKSKTAIRELLQTKQIDNPEDALCRRLCSLSEDGDFSKGTPEEEEAAAADDNNNIVNGESKKTAAVCSKIRKRKTGKQKKGAAKKPKIMTALEKLAKESRG

SEQ ID NO: 4879 - protein, 404 aa, Zea mays
MGKGRAPCCAKVGLNKGSWTPEEDMRLVAYIQKYGHANWRALPKQAGLLRCGKSCRLRWINYLRPDLKRGNFSAEEEETVIKLHGLLGNKWSKIASCLPGRTDNEIKNVWNTHLKKRVSPSGGEEEHGAAGSNKNKKKKKKAAGGAEEPLPSPTPSPSPSSSTTTTANCSSGDSGEQQSNTSKEADDEQLDLENLEMMPMLDDDPITFGFDMLVDPVPAPYGPAVSAFASASRPTSPCASSTSPPPPAGCGPLGVDDLLVLPEIDIDQELWSIIDGNGDGGGDGGGSACAVSAETSAPCCQSNAPEPTTNGACATSHHGAAEEEGKEWWLEDLERELGLWGPVDVEDYQYQYPTGPHGLVADHTDPLPAMVDDPVSCYFQAGPASAVLQEPGYSVTSGSNLMGL

SEQ ID NO: 4880 - protein, 345 aa, Oryza sativa Japonica Group
MWEAVGGGDGTALLPWPGSAAAAPLYMPPAAAAAAPFAAGEQLPVEQPFYFDGGGGVAGHNHHPHHHQYGMEAPPPMTMMQMGGGGSSSSRMVVSGLLGTLQAELGRMTAKEIMDAKALAASRSHSEAERRRRQRINGHLARLRSLLPNTTKTDKASLLAEVIEHVKELKRQTSAMMEDGAAGGEAAAAPVVLLPTEDDELEVDAAADEGGRLVARASLCCEDRADLIPGIARALAALRLRARRAEIATLGGRVRSVLLIAAVEEEDPDEAGNDDDGEHGYGVAASHRRHELVASIHEALRGVMNRKAASSDTSSSGAGGGGGSIKRQRMISAHDQQGSFNSSGW

SEQ ID NO: 4881 - protein, 140 aa, Pentas lanceolata
AQGPRDRRVRLSIEISRKFFGLQDLLGFDKASLTLDWLLTKSKTAIRELLQTKQIDNPEDALCRRLCSLSEDGDFSKGTPEEEEAAVADDNNNIVNGESKKTAAVCSKIRKRKTGKQKKGAAKKSKIMTALDKLAKESRA

SEQ ID NO: 4882 - protein, 277 aa, Zea mays
MEADALLHAPMTSSSSSSSSSSDSVGGSCVVNGAQELPSNTGKPHKNVKRKRTASPSAAPGGGVAPAPPEAAIADDDCGGRRRKRGSAGTRHPTFRGVRMRVWGKWVSEIREPRKKSRIWLGTFPTAEMAARAHDVAALAIKGRGAHLNFPHLAHDLPRPASTSPADIQAAAAKAAAAAADADVEVEQCESSHAVETPSSSATSSEEVAAASNAEEMSVLFDLPDLLMDLSDGLWSPIWAAAPAAVEEYDGGDSLSEPLLWAHEHCWLDAAAPVQPD

SEQ ID NO: 4883 - protein, 1442 aa, Magnaporthe grisea 70-15
MGDRPEPGLIKWYPSAARDYFLHVSLQNPRVDIYQPTGNARNGAFDRKKLFTYDNIPLLTTYDWSPTLPDILAVGNSSGDVNILRIDGESKAMSAIRPRAPRTCQAVAFNTNGKLAVGLERARGDHSLYVWDVSQLDSITQASPRGLPDGLKFPDPVYKNEMGVSVSSVKFFEDNPNTLVIGAKRDGLRIHDLRDPSSGATTFRTHCCNNLAIDYADPNYFASSVLDNPGIMVWDRRATSRFHASPSYTTATEDQPSFPWGGALQLNNALGLESNDSLGDITTSFIRSMRYCRDRRGMLAVLSRTGQLKVMSTSPERLDDNYRVEGSPELLEVNKSNEMDTGGDHHDLVQFEPQEAGEILAPKIVQDELSEIPLFQEPKPDAQAVVASVLQSPIHEGYHLKDLEAEDSPPLPDSFRAATTVAEKLRILREYAKIALPLNGLQRGVPSRNTDKSWPHLTHDGEHPITYRERHEQLLATTMFTLGFPSEAQLFIDHVMLWRAKEMYLFDCERNRKIVADDPWLRDTWAWIAGAEDAAQDSGMTAAPLDLSYMGVATIWFSDLGNKPSNRLVDGGTALPDSAAWERSISAICSKQALPKFDCAETKKAHHRRLCLAICGWGRSGPMDLLEFEQIPASEKTSTWHTMTTAHALFRGETKNAIKLLKRASAEHPELMFVSLALQLMMRGDNDLAKEHLDFDENIAPQEDPYLRAISSLIATRGWLTIANQRSLPLRERVYVAVRYLNDEELSQWLTAEVRDVIETGDISGIVLTGITDNMVEILAKYVQKFHDVQSAILIMSICAPRYVDDYRCAAWRRAYRAYLQRHKAYFQRTKFEVESTKKSKRDGQPTISPPFRQIALRCIYCDAEMSMSRGTAVVAPASARTKLSFGACVESFDNIYLDLSRESGKCRFAENGLGWKPAGGGDAFTLDQSNIGGANWSRAAKGYQLKILQRNSGLIQLDGFQQEDYERLSKIFKNWYSHNLENKEHSLRGWNWGKAEFGKAELTFNVQNRPSFEVPYSEISNTNLAGRNEIAVEFGVDGEKEKKPTASKDQLTEIRFYIPGTTTRKEAEGEDAGSDADEEEKNAVTLFYDTLIEKADIGETAGDTIATFLDVLHLTPRGRFDIDMYDSSFRLRGKTYDYKLQYDSIKKFMVLPKPDEMHFLICIGLDPPLRQGQTRYPFIVMQFKRDEEVTLDLNLAEEELNGKYKDKLQGHYEQPLHQVVTYIFRGLANKKITAPAKSFQTHRGQLGIKCAIKASEGFLYCLEKAFMFVPKPATYISYEQTQSVTFSRVGGAVSATQTFDITIHMKGGGSSQFSNINREDLKALETFFQAKELRVKNEIDEDANLLAAMRDQAMVSSDDEVGPKADRGSADEDEESVDEDFQTESESDVAEEYDSDHESSGTGSDEESDGGKGGRGKDDDDDDDDEEASTEKPPKKKKKTS

SEQ ID NO: 4884 - protein, 128 aa, Nicotiana sylvestris
CTAQGVRDRRVRLSLHIARKFFDLQDMLGFDKASKTIEWLFSKSNNAITELSENIPQKDYSDGNKIINSNSSSSEDQKSESLMSECEVLSRWEENSNNEGKERGKDINMNDRLSEMVQNNPHKRESRN

SEQ ID NO: 4885 - protein, 172 aa, Triticum aestivum
  misc_feature (64)..(64): Xaa can be any naturally occurring amino acid
  misc_feature (92)..(92): Xaa can be any naturally occurring amino acid
  misc_feature (125)..(125): Xaa can be any naturally occurring amino acid
SCRSCRECGDRPRGASGEGPPPSDSWAWRKYGQKPIKGSPYPRGYYRCSSSKGCPARKQVERTXADPTALLVTYTFEHNHEAPQPKTSGGSXCHQQGKPSARPPAPKPEPSVVLVQRDESARSTXVETEVPEQEQETEPEEEHEPAEKGPWPVRKRNLNGAPRRRFLVFTPR

SEQ ID NO: 4886 - protein, 123 aa, Nicotiana sylvestris
NTAHGPRDRRMRLSLDVARKFFNLQDLLGFDKASKTVEWLLTKSKCAVNELVQGINKENCATANIGAISTCSTTSECEVVSGIDESTTTNDIQKQSNRGKVGEKKKANKLVRRAAFNPVAKES

SEQ ID NO: 4887 - protein, 260 aa, Picea glauca
MEDMNMNIGGAATFYGVNMNEYGDTGVGSMVALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 4888 - protein, 114 aa, Solanum lycopersicum
CTAQGVRDRRVRLSLHIARKFFDLQDMLGFDKASKTIEWLFSKSNNAIKDLSENTPQKEYSDGNKIVINSNNSSSYEGKSDSFMSECEENSINELGKDKEKIMQNNPHKRESRE

SEQ ID NO: 4889 - protein, 157 aa, Zea mays
  misc_feature (94)..(94): Xaa can be any naturally occurring amino acid
  misc_feature (137)..(137): Xaa can be any naturally occurring amino acid
ITLRVQNAQDLTRDVIKSDSASVKVPELELELSCGTLGGMVTTVEGLIVKICEALERIHGFQLGDSTLEWKKKKWDDFKERLSKIISLLSLSLXEAWTLIIDDGLAASFVAPATDSLEDDSQLTIEEYQRSWEQNEXLGLNDMDTSSADAAYNTIST

SEQ ID NO: 4890 - protein, 1746 aa, Chlamydomonas reinhardtii
MPSNGRCLQSHARHFRLLLLLGNWVGFPLPGCRACCSSANALNWWRSAVARRCILAFRLSQLMASRTHGYHPDAAALDDEGCGGCGAAAGGGACFSPSGRCNSGCLAALADAFLSGSSDAVGATCGGGSGGGGGGGGGWVLGSNTHRLYSAGSLELRSLDEHALNHGSGGGGGLAAATMAAPSPFGGPSAPCCYLHPSPRGADGYDGDGGFGGRGDDLCFDPGCGVAAAAEDGGCAAYLSMHRPSAAAAAASAIASAAAACAPRTRSSSGSAGVAVRASRSASPQLRCPFAAAAVAGFDGGLDTAAGGNGSAAGIGAAPPAGGSADDTLQCGEALTSEESSGDGADIAAAICATATAAAAGAAGGDCKAAYYYSSSPAPPSSAAAAAPAVTAAALPPQALHASPAPHHHALPAHPPAAPPCAAPDPPMQRMTPPPPPPPPPPHVAVAGTGAPPPPGYYHHYPGAPPPTPQMYAPPPPPVPASVPPPVPYAQPPPPYSHYDNRPPPYGYTSPPPPVTYGHSSTGGSAGEHATAAGNPPPLPPPYVTAAAGSPTYPPGPHPHSHHHHHHHDHHHHHQQQYPPVVPPPYHNIGPPPPTTTYGYGYPPAAHYSHAHSHAMPPPPHQPHHQPHHHQPHGITMMPAPPQPPPPPHGYYGQPPPLPYHMPPPPYYMYGERPGPPTAPGDKYNSQAHRGAAPAADPCAHCGAAGSCLCHVERRESAGSSFTAGGAAPSVAKSQLPPPGSVPLPPCGSVPLPPCGSVPPPPPTPLRVAASITTELSVDAPQPQHHSQHLSPQHSQPAPQQPAPSPFGSAAGAARTALLGAATPASAAPTCLPRPAGPSPTASSNHSAMPPQAQAQAPPPAHQHQPQQLQQAQSYSAGPDAARTIAPPQQAPAYCYTRASNVSSASAVGVTAIPRPEVPHTHAAPWQQAHSCPPPHVHPPQQLQHPQHQRPCLPVPVPPPPKWRQDRPTAANTTATDGSNVASAGFASAAATATVGYRPRQSSALSDCSIALRDLLCGGGGGGEKGVAAGYISRRGSGAVTPGLVQQLTGGGDSDAEGMRVAMAALLSGGAVGAAEEDEATAAADWLQLSSFHTDGDGDCDGGSGDGSSSGRAHAAPAPAATLVYGRTTSSSMVPCSDLYAYNNTYAYTRPAAGAAAATTAAVFADGSSISGAAAPAAGVMYPLHTLCSGGSADVGVTAGPGATPPGLASDPYNHSSSGVPAPDASVGTLPALQQTGSSGRATADVAQALLPSAVASAEIASAAMGQQPAATLVARRSSGGPKPHASRGAPAYQAAAEIAAAPVVAAAPPAPALPRARAPKRSAAVAALTQIAAHTRSDFSCGGGSSAASGDDNYSASEAEEDEEEEADIEIEEEEEEPQPPPRRSSGGAKARGGARAAGGDASSSRSRKRRAVSAAAAASAAPVQPAAVMAGTVQAAMAAGATGAAGTGGAAEEEDGGCKKRSSQYRGVTRHRRSGRWEAHIWVKEMGRQVYLGGYEEEAHAAEAYDVAALKCKGAKAGVRTNFELGRYSGLLASLPHISLEELIMAVRRQSQGFSRGSSSYRGVTAHPSGRWESRIGIPGSKHIYLGLFEGERDAAAAYDRSLVRLKGPTAATNFSLSEYRSELSEFHVYGNASVLRDARLASVTAGSGPDFEKWIKSGFGAFPHLSAADFGASAAAAATGAAPAPGASGSGSVEAAPRTAGPSTASGDASPAVAAAAVAHSPSPIAAVMAMAAASAAVAAGGV

SEQ ID NO: 4891 - protein, 544 aa, Yarrowia lipolytica CLIB122
MSTTEFDGIYLNQSKAHGRLRMVETGLGWKAVQKTSMGGSKETKKDEPFLLGKEELLAAFWSRGSRGFEMKIQTKNRGAANFDGFEQDNLEELKNVMKRNYGISVEQREHSVKGWNWGKTDFERSELVFSVANKPAFEIPYAEVANSNLVGKNEVALEFQQPADGRAGDELVEMRFYVPGVTSVEGDENPKKKQKTEKEGEEGKEGDDDADADDESEEEVQSTAQIFYDTLKEKADIGAVAGTAVVSLSEIYLVIPRGRYDIDMYANFMRLRGKTYDYMVQYKHVQRLIVLPKPDDLHNILVVQLDPPLRQGQTRYPFLVMQFLREAEIKVELNVDDAEFAEKYADKGLKQSYDESAHQVVGSIFRGLTGRKLTVPGSFKTVHGHAGVSCSLKASEGHLYPLERNFLFLSKPVFIPFAEIQDITLSRVGSSVTTSRTFDMTLKLRNAQGEYQFSNISKEEQEGLEAFIKSKGIRLKNDLAEEKALLAATLAEVDDDSDDGGEFRGSADEDDESPDEDFHAESDSEVAEEFDSNAESSSGEEDDE

SEQ ID NO: 4892 - protein, 193 aa, Triticum aestivum
  misc_feature (169)..(169): Xaa can be any naturally occurring amino acid
MMKMTHDDYVHLCLMALASVATGGGQAEAAKGQWLQTLPATTAAACELRFRCSVCGKAFPSHQALGGHKASHRKRAALVLPLQSVSPAEETVASSTSSGVGGHRCSVCHRSFATGQALGGHKRCHYWDGLSVSLTASASRSGSGSSVRDFDLNLTPVPEKAAAGMRRWXEEERGAEPLAVQERRLSSPSLELN

SEQ ID NO: 4893 - protein, 170 aa, Triticum aestivum
ERERGELVVQTRPSAPVNELQPVQNECLPEGSVSTAGTATENEKSIQQAQQSSKDIQSKSQGASTRSCTKVHKQGVALGRSVDLSKFTDYDELKAELDKMFEFNGELVSANRSWQIVYTDNEGDMMLVGDDPWEEFCSIVRKIYIYTKEEVQKMNSKSSAPRKEEPLTVG

SEQ ID NO: 4894 - protein, 670 aa, Oryza sativa Japonica Group
MSRAARRACHWVWVGSLSLSVSPSWLLPQGRNCIPAGRVIERGGQRGERREIDLIEGKETHKAFKPQNPNPPSPHPLAMAPKRPAAASGSASEASDCEAGGAGRRRSPSRSRSPSRSASPSRSRSKTPPHNAAVLSSTPASAAVDFVAASDSDAGADADARLASPRRSRERSPRLHSDSDNSAAATAEAAEAAAAAAFDDGDDEGNATPPPRSRRSSRVEATGVKPISSRPMDASRRPAAASSQSQRRSKRPRSSPTQHSPEQHKRPPRVWNPQDEVTILRALISYRAKNGALPGSSQDTGKLHNMIRGQLSVKASTTQLSDKVRRLKHKYNLILTRVTKSGRDPDLPTEHDREVYELSKKVWGTKSGGAGAGSGGGGGGGGGRVYENAEVVQSDEEQGSRDDSDEDMESGWDDRDHRNRRLKAIVVANGNGNAVTGGRSVHGNGSGKGDVADKGKDMYPYLWEAVEELSKEHPSGTAFRKAFGVLDGSRARAMEEKLNRCGGARRHQRSLEASGIEIKLDGNGAPHMEAERHRGLVNLPSSLLELLADAHSHLAFLFLNGATSGTVVAMATAKEAREGNFHWRSPTRELEEGGGMAGRKKGEGGATIRGDREEVLCHLAGARRARTRRDATLGPRQEAGARRATRDAAARPSCLPGRFAAPCANPLLAR

SEQ ID NO: 4895 - protein, 427 aa, Oryza sativa
MPSPLKERPAGRLGRLLAALRPARAGPLPVQTGFPTSLADLVVKNHGRLKKPSASASRRKKRGGPEAPPSPSPSPSPSPPPQPSSPPPTPPSPPPAAAVSVSPPTQPRPRPELPPVEAVLRRQPKGRVFGLGLGFVSLVGVVSLALLVIWSKKVVAAVTVASFSLFLLESVRSSALSRRPRRPAANNKLDLDGRGYVSPIREVEPARASFSDSSRRSELSILTIEERSEVGDDSIVAIEERIAAGGDDSSNAKVKTKKRSWRKLIPRKLQKGMKGKEAEDSSGSFRSSEGNRGDATATDSSDSRRGMRTKAADAFVARSMDSSPSFRGNGGDTDADAYSNATRVEIDAPADVLAGDGDAVGGTRSSVALLVVAVVLVGLVAGKLPAVVFTVLCGVFISSVQRLPAGGDGNGDRSFTWWFRIKPKDVN

SEQ ID NO: 4896 - protein, 341 aa, Oryza sativa Japonica Group
MGVMSKQQQEAMAEEMMELRRGPWTLEEDNLLMNYIACHGEGRWNLLARCSGLKRTGKSCRLRWLNYLKPDIKRGNLTPEEQLLILELHSRWGNRWSRIAQHLPGRTDNEIKNYWRTRVQKQARQLKVDANSTVFRDAVRCYWMPRLLEKMAGAATDPTPPPPPPLHHHAAMATASSSPFDFDTHLQQAEAATACVVPNNVYHHHIDPSPSTSTSAGSTAAAAAFQPLPCFSELRWDQQMQSSGELDDGAAGVFVDSASALGSLSLDGLDLGPAEYYSDSTLLDYLNSSCTGSAMMTMMTASGNAGSYNYCGGAMDGGDTWRSDEVCQAAARKLGEWGGGI

SEQ ID NO: 4897 - protein, 537 aa, Dubautia menziesii
ERKKEAKTTSSVPDSGGMDVLLEVLGYKVKSTDMADVAQKLEQLEMVMGEDGILQLSDTVHYNPSDLSGWVQSMLLVLNDNNNNTAHDSGHILLPGDSSTTMIDFSSEIVVHGKPGSKIHLDDDLRAIAGGAIYRSESESSMPGNGNPNGNGVKRMKTTVAGSEVVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLPRRPGAVEKVLSSITGMKPKIVTLVEQESNHNGNVFKERFNEALHYYATMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 4898 - protein, 739 aa, Ustilago maydis 521
MSTERQASGLGPSMTASSPRAHHSQAVPRDMQRPVKSEASASQPPPASPDRKRPRYEPALASRGTAEEELDELEESEDTTKRPRGESDEPKFERKGSGPESISRSSSAAAHHAHWAGRSASANLDSRYHQQQQQQQQQQQQQQQQQQQQQQQQQQQQQQQQQQQQQQQQQQQQQHQQHRGRQGIDSGGAQEPRRYEFERPHPSRYDPGPGVREDGRHIGGLVGERYGGEADRESRGRFAMEGKMEYNSSTTRMPPPGAGDHPNLPPGFRNRPSSPPPRLPGFASLEHEGLGHRAREDGVMGGAYASSPRRSIPFHGPSYGNYALPPSRTPLMHHHPSPTPSTSYGNPPMIHPALAGLPGAGGGPGGKQQPSFVSKLYSMLEDPSIADLISWGSSGTVFSVANPAEFSRLVLPNWFKHSNWQSFVRQLNMYGFHKVNHSYQGNPTDEVQVWEFRHPSFRRGEIALLHDIKRKSSRQKRGGSPRGSIGGADMRADRSGGSSTPSPEVPLATIPGHDGMRIMGGMGPGGHRGGREFAYGDDRMDGHAYVDRREMRGYAGERDYSASGPRGIPADEYGYMRGGKMEGQLGITTGGPGAGAGMGPPFAPGSDENARRAVEPIMERAEAMGRFEDLSERTDAIIRHASFLESQIRLLTDQLIDARAFTESAVRDEMILMLDRLERALSSPTPPGVDPTAKMVEVLRGQLSYYSHRSAGPNDRVNKPPAPTGSAVGTGTDPKRPSV

SEQ ID NO: 4899 - protein, 352 aa, Arabidopsis thaliana
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSNKQAIINAL

SEQ ID NO: 4900 - protein, 168 aa, Helianthus annuus
SSGDASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVPDGPRKLRITGIEYPQPGFRPAERLQETGRRLANYCERFNVQFEYNSIASQNWETVKIEDLKLQRN

SEQ ID NO: 4901 - protein, 539 aa, Dubautia raillardioides
ERKKEAKTTSSVPDSGGMDELLEVLGYKVKSTDMADVAQKLEQLEMVMGEDGILQLSDTVHYNPSDLSGWVQTMLLVLNDDNNTTADDSGHILLPGDSSTTMIDFSNSSETVVHGKPGSKIHLDDDLRAIAGGAIYRSESESSMPGNGNPNGNGVKRMKTTVAGSEVVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLNQGMQWPALMQALALRSGGPPAFRLTGIGPPQPDNSDALQQVGWKLAQLANTIGVEFEFRGFVANSIADIDANILDIRAPETEVVAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 4902 - protein, 168 aa, Helianthus annuus
SSGDASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVPDGPRKLRITGIEYPQPGFRPAERLQETGRRLANYCERFNVQFEYNSIASQNWETVKIEDLKAQRN

SEQ ID NO: 4903 - protein, 537 aa, Dubautia microcephala
ERKKEAKTTSSVPDSGGMDELLEVLGYKVKSTDMADVAQKLEQLEMVMGEDGILQLSDTVHYNPSDLSGWVQTMLLVLNDDNNNAADDSSHILLPGDSSTTMIDFSSEIVVHGKPGSKIHLDDDLRAIAGGAIYRSESESLMPGNGNPNGNGVKRMKTTVAGSEVVDVQPESPRPVVLVDSHEAGIRLVHTLMACAEAIQRNDLKLADALVKHVGILVASQAGAMAKVATYFAGALAQRIYNIYPQNALETSCYEILQMHFYETCPYLKFAHFTANQAILEAFAGATRVHVIDFSLNQGMQWPAFMQALALRSGGPPAFRLTGIGPPQPDNSDALQQVGWKLAQLANMIGVEFEFRGFVANSIADIDANILDIRAPETEVVAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 4904 - protein, 240 aa, Vitis vinifera
MEAAALFLQDIAILPEMETGVLEHSLAASNPFSSSFGDEGFYSKALIKGKKLRLFGFDVNPCANDGKRSVESEEGDESLSSSNTPSPWKEKTLQGKSSTKLLKERRYACQYCRKEFANSQALGGHQNAHKKERVKKKRMQLEARRASINQYLQSFQSHPRFTEPSFSIPEYSVCESPNTLNLIHHQTYLSDPHDLDSFGQQVYVPFQHGDMLGWADGSKCSRAMPGVIKPLPLRISRQRL

SEQ ID NO: 4905 - protein, 168 aa, Helianthus annuus
SSGDASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVSDGPRKLRITGIEYPQPGFRPAERLQETGRRLANYCERFNVQFEYNSIASQNWETVKIEDLKAQRN

SEQ ID NO: 4906 - protein, 233 aa, Zea mays
MAPRTSEKTMAPAAAAATGLALSVGGGGGAGGPHYRGVRKRPWGRYAAEIRDPAKKSRVWLGTYDTAEDAARAYDAAAREYRGAKAKTNFPYPSCVPLSAAGCRSSNSSTVESFSSDAQAPMQAMPLPPSLELDLFHRAAAAATGTGAAAVRFPFGSIPVTHPYYFFGQAAAAAAEAGCRVLKLAPAVTVAQSDSDCSSVVDLSPSPPAAVSARKPAAFDLDLNCSPPTEAEA

SEQ ID NO: 4907 - protein, 236 aa, Oryza sativa Japonica Group
MAPRTSDKTMSPAAAATGLALGVGGVAGAAAVGTGQHFRGVRKRPWGRYAAEIRDPAKKSRVWLGTFDTAEEAARAYDAAAREYRGAKAKTNFPYPNGAPAAGVNSGSSNSSTVESFGSDVQAPMKAMPIPPSLELDLFHRAAAAAAAGAGGMRFPFEGYPVSHPYYFFGQAAAAAAASGCRMLKIAPAPVTVAALAQSDSDSSSIVDLAPSPPAALAKKAIAFDLDLNCPPPMEV

SEQ ID NO: 4908 - protein, 420 aa, Physcomitrella patens subsp. patens
MPGPCFSWAKSISFKAKSITFKSDSGSEISHESRSGSFSSTPLRGEHSKSPPRRYGCTQGCTPSIANLKEMLQGNSSLLSSKSSSHSSSCASPPKNESYIHQTKNGDYMYRAPLQSKPNRTFRKQNSFGSAQEVTRTSRELVNIDVSTKENLCLVKGCCECSKHCNPGGGRIFPRDPQHHGSLSPKCFCPKCGEAFFKPEALELHQVVRHAVSELGSGNSSLNVIEIIFKTSWSVKGAPCTRIERILKIDNTEKHISEFHNYRDAVKKAAADEGMQHERCLADGNELLRFYGSSFMCCLGINGSTNLCSMSACNVCSIIRWGFAVRKEKGIFTTASSGKAHEIIMAEEKENWRGKHAMLVCRVIAGRIFRSPERTSRVHHASCLPDGYDSVSPGSATNLDELTVFNPKAVLPCFLVVYTI

SEQ ID NO: 4909 - protein, 336 aa, Arabidopsis thaliana
MNNIDDAKTETSVSSGSSDSFLPLKKRMRLDDEPENALVVSSSPKTVVASGNVKYKGVVQQQNGHWGAQIYADHKRIWLGTFKSADEAATAYDSASIKLRSFDANSHRNFPWSTITLNEPDFQNCYTTETVLNMIRDGSYQHKFRDFLRIRSQIVASINIGGPKQARGELFQKELTPSDVGKLNRLVIPKKYAVKYMPFISADQSEKEEGEIVGSVEDVEVVFYDRAMRQWKFRYCYWKSSQSFVFTRGWNSFVKEKNLKEKDVIAFYTCDVPNNVKTLEDNGSVVAEEVSMTVHDSSVQVKKTENLVSSMLEDKETKSEENKGGFMLFGVRIECP

SEQ ID NO: 4910 - protein, 286 aa, Oryza sativa Indica Group
MSNRATHWCYVCRRPVRIRGGSQDVTCPSCDDGFVQEMSEMGRRTASSTLGFVGPDAGDEFLLRRSPVMEAMSTLMRHAATVGGDEREVDVHDEHGGGDGVPAHARLGVLFRGGPRVGVERRGGYYRAGLEALFEQLQNQLGSSRQGPPPAPPSAIDAMPVVTISRRHLRAEPRCPVCQDEFQLGAEAREMPCAHLYHADCIVPWLVHHNSCPVCRHSLPPPATTASGGGASGGERQVRRGSRSFLWPFGPTSSTSHSHECEDGSSDTTVYEDPGKVRYIRWHYNH

SEQ ID NO: 4911 - protein, 121 aa, Schizanthus pinnatus
NTAKGPRDRRMRLSLDIARKFFNLQDMLGFDKASKTVDWLLIQSNSAINEFAMNKQSCSAAAVNIGASSTSDHECEVISRIDEFNINDQNQKTNAKGTCSNEEKKAKSTRRATFGKESRMQ

SEQ ID NO: 4912 - protein, 325 aa, Oryza sativa Indica Group
MEYSNDWDLQALVRSCGTAVADSEPEPPPAPSTTRRAEAETVVVGRAGGVPEFVGQPVRSAAASFYDLEYLDLYHELPRAPFLVTAPSTSRERGEGGEHEVLISFPAIASTSGQGRKQPGRKPGVRTARPKRRLLALTAVVNLHARSMQQEEPAEESGVRGAGCRRRRLHDLWAWRKYGQKPIKGSPYPRGYYKCSSLKACMARKMVERSPEKPGVLVITYIAEHCHAVPTQLNSLAGTTRNNKPASPDQQQQQQPSPGGASTDEAAAAAAKTEDSADTTCSMADDENDLWAPVEMDMDDFFGPFDDDLDHFLDDDAVLGRRLSL

SEQ ID NO: 4913 - protein, 519 aa, Petunia x hybrida
MWDLNDSPDQRREINIDESEEGCSSHIELEPDDEKGKRVGSFSTSSSSAIAIDEISEEEDGEKGKKKRSSPSKLFGFSMVGPGDLEQPITRQFFPVDEAEAETGVVTNGSLNFPRAHWVGVKFYQNEPLGITGVVDVTQQQQQQQQPMKKSRRGPRSRSSQYRGVTFYRRTGRWESHIWDCGKQVYLGGFDTAHAAARAYDRAAIKFRGVEADINFNLEDYEGDLKQMTNLTKEEFVHVLRRQSTGFPRGSSKYRGVTLHKCGRWEARMGQFLGKKYVYLGLFDTEVEAARAYDKAAIKCNGKDAVTNFDPSIYENELNSTESTDSGADHNLDLSLGGSSSKKNNREFGDNRGQNPSSMQFDVDWRHNGLRPEKQTAPVDMDARRRDNGYNESETLQLLSKTHLHSPVSLKHNNSHQLQRFGQYMRPGESHMIQMFPPQFGSSNYQIQFPSGSNGGRIGATNVGDLSLSSSNASSQWQSNLPPQIFAAAAASSGFSQQIVRPQNWSSENGFHHFLMRPS

SEQ ID NO: 4914 - protein, 128 aa, Schizanthus pinnatus
NTAHGPRDRRMRLSLDVARKFFNLQDLLGFDKASKTVEWLLTKSKSSIKELSKGLPHMNKESCGTTIGAISTSSTSECEVISGIDQESASNNQMNQPNVIEVAPKEIKKKSKPARRAAFNPVAKESRK

SEQ ID NO: 4915 - protein, 222 aa, Vitis vinifera
MAREKIKIRKIDNVSARQVTFSKRRRGLFKKAEELSVLCDAEVALIIFSSTGKLFDYSSSSMKDILGRYTMHSNNLEKLEGPSLELQLENSNHVRLSKEIADKSHQLRQMRGEDIQGLNIEELLKLEKMLEAGLSRVLKSKSDRIMTEIATLQTKGAQLMEENNKLRQKMEIICKGKRLMTMESDNMILEEGQSSESITNVYSCSSGPPQEDDSSDTSLKLG

SEQ ID NO: 4916 - protein, 457 aa, Petunia x hybrida
MFDLNLCFEDEEELQFDNHNNSTETSNNSSSIINNIETTTTSSTCDDHEYISYSNNEYNNNSFVDFLKTDNNDQFLDSKELFPLSNGGEMAAPVNVYGNYGGTMEQRIIIPVQQQQQQQQQQVKKSRRGPRSKSSQYRGVTFYRRTGRWESHIWDCGKQVYLGGFDTAHAAARAYDRAAIKFRGLDADINFNVSDYQDDLKQMTNFTKEEFVHILRRQSTGFSRGSSQYRGVTLHKCGRWESRMGQFLGKKYIYLGLFDSEIEAARAYYKAAIKCNGREAVTNFELSTYEGELSTEADNGGASHNLDLNLGIASSSIADDQHDNTCLIGNSEFQCASIGLPEYRGAMNSPCTTMGSKMPHGRHLLWNGVNTSVFPTFKGTAIGKGMEVDSAPNWTWQDQNLYGGSSSVPLFSTAASSGFANSTTADVHQHYFSTGPLPYHHSPSLANMNFAQYYCRS

SEQ ID NO: 4917 - protein, 126 aa, Schizanthus pinnatus
AQGVRDRRMRLSLQTARKFSDLQDTLGFDKASKTIEWLFSKSKNAIKELTENTPQEHNYSNHENNNVVVNNNNSSSSEEGNKSESLMSECEVLSSKEENSNSPFEKDHRKLRKMVYNLHTRSESRD

SEQ ID NO: 4918 - protein, 690 aa, Zea mays
MDTPDRAAAQSAATRTEVTTLSLYHSRLLDCAGQFPSPPSLPSRLPPQMRPGSPASTPYPVEAGTGRPAARRRAPAPRFRPARPQPGAEPTPTPDSPVFSFLNNLSPIEPLRSSAYSTNSLQGFQSINITSISSIFTSPHDNVSKEPRLPKSPLGEISDKEVRADAAGTNEPPEPSNAARLFACTSTVTRETRTGTCTGVAGPPPTTGGPCDLALPRQFDNNGSPDHNTTPCHGVRSDLKQDKARKLLQAAQNAKKNALEKRKCLFSTEVRLLDGGGGGGGEPGSDSDGVLGCEWSDLVSPTSAKLLAFDATMDEHHRGVHLAAQNAESCGYLLSKLAGDGGVSDGAYPTASAQVYYQELVMGEDQSENAAPQMDAQETISAEETQDNIYEADVCVPLEYKVVESQQQRGIRRRCLVFEAAGGFSNSAVKRGTIEDRSVSTCSKGKSPAESQPRGLRGIGLHLNALALTPKGKMACQDPPPTASALLPSSASEKDARGELLCAGENFAHSGGELLEFPLDGCSAGGGFPVNDHHVSGQSVSPQKKRRKTDNGDDGEACKRCSCKKSKCLKLYCECFAAGVYCSEPCSCQGCMNKPIHEETVLSTRKQIEFRNPLAFAPKVIRMSDAGLETGVWHEDPNNTPASARHKRGCNCKKSSCLKKYCECYQGGVGCSSNCRCESCKNAFGRRDDS

SEQ ID NO: 4919 - protein, 607 aa, Oryza sativa
  misc_feature (102)..(102): Xaa can be any naturally occurring amino acid
MHEASEVKIPARPRSNTICNPRLDVIVAANHSVFIKGVLSLAICMQVSTAVGSCDYASTVPAAIVSSGSGVVNHTSYCTCRSIDIMLQLPLPWPLALHLNCXKWSGVVVLCSSNIQSIRKQQAKKQHYSLHELAKRIAMVEPGRARETKVTASASSSAGSDAAVMKKKKKKKKLVVASRKVDEKDKKQVDYKCSRSSGRDECCKVESRHQQCTEPESPSYRNSSSSSHAGHHHHRAADGKKLGCNSSSICKVKQDNPMQQHMRRAEDELKVKDKPPVAEPYCKRRASVSACNISSERSVKKSVKQQQQEASSSLQSSASISASSCSSTAGGGGSFRGMQQLSLRRLSGCYECHMVVDPISGVFRDNSSMRATICSCPDCGEIFVRPDSLHLHQSIRHAVSELGAEDTSRNIISIIFQSSWLKKQSPVCAIDRILKVHNAARTLARFDDYRAAVKAKAMAHRHPRCTADGNELLRFHCATLSCDLGLHGATHLCDHLSCAACAIIRHGFRPPAPGAGIRTMATSGRAHDAVVSSGSEGDRRAMLVCRVIAGRVRREEAAAAAAEEEEEEEEEYDSVAGTTPGLYSNLDELDVFNPTAILPCFVVVYRA

SEQ ID NO: 4920 - protein, 191 aa, Brassica napus
SEPEAKRWKGESETNGGNGNGSKTVREPRIVVQTTSDIDILDDGYRWRKYGQKVVKGNPNPRSYYKCTTNGCPVRKHVERASHDMRAVITTYEGKHNHDVPAARGSGYTTNRLTQDPSSAPIRPNAVAGHSSYTTSSQAPYTLQMLHQNNNTSAGSFGYATNNNNFLGGGFSRAKEEPNDESSSFFDSFLS

SEQ ID NO: 4921 - protein, 184 aa, Oryza sativa Indica Group
MCEAAAPRYRGVRKRPWGRFAAEIRDPAKRARVWLGTYDSAEAAARAYDVAARNLRGPLARTNFPLVSSLPLPSPHYHLPGKAAAAAPPVAGPACSASSTVESSSGPRGPRPAATAAAVPRRRVPRPAPPAPDAGCHSDCASSASVVDDADDASTVRSRVAAFDLNLPPPLDRDHVDLCTDLRL

SEQ ID NO: 4922 - protein, 1251 aa, Populus trichocarpa
MIQNDGMQMLGLRKGAKKYGVIQCDPLVLKGLEKTGARETIEPALWKAIKESRFTVIIFSRDYAPSQWCLDDLVKIVQCMKEMGHTVLPVFYDVDPSETYEKAFVEHEQNFKENLENVQIWKDCLSTVTNLFGGDVRKRKESESIKIIAEYISYKLSVTLPTISKNLVGIDYRLEVLNGYIGEEVGKAIFIGICGMGGIGKTIVAKVYYDRIRWQFEGSCFLANVREVFAEKDGPRRLQEQLLSEILMERASVWDSSRGIEMIKRRLRLKKILLILDDVDDKEQLEFLAEEPGWCGPGSRIIVTRRDKKVVTGNNNYNIYEAEKLNDDDALMLFSQKAFKNDQPAVDFVELSKHVVGYANGLPLALEVIGSFLYERSIHEWRGAINRMNEIPDGKIIDVLRISFDGIGLPILIERSLISVSRDQVWMDNLLQIMGKEIVRCESPEELGRRSRLWTYEDVCLALMDSTSAVNLKIINLSNSLNLSRTPDLTGIPNLESLILEGCTSLSKIHPSLGSHKNLQYVNLVNCESIRILPSNLEMESLKVFTLDGCSKLEKFPDVLGNMNCLMVLCLDETELKEWQHGSFSNIELSFHSFQPGVKVKNCGVCLLYSLSSQSSAHFIVASKEASSSYKASLSVSSSYRQWMEDLFLSFRGADTSNDFTHLNTALALRVIIPDDKELEKVMAIRSRLLEAIEESGLSIIIFARDCASLPWCFDELVKIVGFIDEMRSDTVFPVSYHVEQSKIDDQTESYTIFFDKNEENSRENEEKVQRWMNIFSEVEIPSGSRSVERKIRKKIIGNLPVRVLDLKKPEKIRILEAKTPGTTLLVIYIIIWHREASMYTWMIGSSREERPSNLLSGRPFEESRFSIIIFSRDYASSPWCLEELVKIVQCMKEKGHTVLPVFYNVDPSETYEKAFVEHEQNFKENLEKVRNWKDCLSTVANLSGWDVRNRDCASLPWCFDELVKIVGFIDEMRSDTVFPVSCDVEQSKINDQTESYTIVFDKIGKNLRENEEKVQRWMDILSEVEISSGSRSAERFTMQGWGQECPGFRKSQAKKVVCIPAPAAANSRSSGEVVPSDLWAWKKYGQKHIKGSPYPRGYYRCSSSKGCLAKKHVERSRNDPNMLVITYNSEHNHPWPTQRNALAGSTRSQPTKSNAASKSSTGAQARKTANTKEDQKESSNDTLSPTDIIGGSSTASASVKEESDDIEKQMEMDDNEFSEGFSQSYCWWERPLVVTFKYSEEIKHIVFISK

SEQ ID NO: 4923 - protein, 353 aa, Arabidopsis thaliana
AKVFVLTFGRDVFFYFDDQEIVVKPLEEIVTNTCPKPQPQPLQPQQPPSVGGERKARPEKDQAVNCPRCNSTNTKFCYYNNYSLTQPRYFCKGCRRYWTEGGSLRNIPVGGGSRKNKRSHSSSSDISNNHSDSTQPATKKHLSDHHHHLMSMSQQGLTGQNPKFLETTQQDLNLGFSPHGMIRTNFTDLIHNIGNNTNKSNNNNNPLIVSSCSAMATSSLDLIRNNSNNGNSSNSSFMGFPVHNQDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 4924 - protein, 315 aa, Arabidopsis thaliana
MNNDLWLPEEDFKGLPDNFLDNLVDPTNDVSVEDIETGDDEGDWDAKFQKLVPPPLDELMSLSYEFTCNGQRVQVQKHVPILLVILSQMYMDLNGFQFGNWDVVIEKQSSSSEVFSTVDNSPPNVKVSKLLQSLSPVSVLKNTNGSGSPQNPNGDQKLAFLVKGIRSKRKRPTLLRVTFLKSFLLEMSQQFAPDESESSEISALKKRKKNKSRRLKCTHCETTTTPQWREGPNGRKTLCNACGIRFRSGRLVLEYRPAASPTFIPTVHSNLHKKIIYMRMKDNDQFDTRKIRAETSGPETRSRLRNFGRPMSYGQ

SEQ ID NO: 4925 - protein, 246 aa, Psathyrostachys fragilis
SHHQHPLPHPPSSGGPDAFSYYYYYPPFSAAAATTDYPTPPAVSRSRAAVRKDRHSKICTAGGMRDRRMRLSLDVARRFFALQDKLGFDKASKTVQWLLDRSTAGINHLATSMSASMSLSEEDGSLLLDLDNNDHAMSMAADAETNKQQQQEHQTTKAKRRSAPAAPRKKRNNGGAPVLLPDKASRARARQRARERTKERNRLRSEAQAPAPLPARQPVVPAAACSNSYYEEGEQEPWELGGVVFA

SEQ ID NO: 4926 - protein, 238 aa, Picea abies
MEHLNTAAAQASSSLYGVGMAEYGDAGVSSMMALITQHEPHDSESIMSTRMPSSFSSFHGHADCLLSAAMFQASQGDHKLKRQPGMDQLVSEQAVMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 4927 - protein, 256 aa, Saussurea medusa
MVRAPCFDKHGIKRGAWSQEEDNKLRAHIQRSGHSNWRQLPKLAGLSRCGKSCRLRWVNYLRPTIKHGNFTKDEKDVVVALHNKLGNKWSAIAARLPGRSDNEIKNYWHTHLKNRAQTDQTVLQTKQDGNAETSKGKGTPKAGCVVRKPNVKSQQEVEILLAVLSSASSSSFSSSTTSDQNESSPPSLSVSDANVTPQCSEEAARSLCIDQFLVEEDSIMLSSDKMYSPLGSVDYFISQDNVMDDVLLWPNLDFYY

SEQ ID NO: 4928 - protein, 168 aa, Helianthus annuus
SSGNASQRLAHVFASGIEARLAGTGSQLYAAKCAIRISAAEKLQAYQVYLSACPFKKIGMSFANKTIFDSALASSNPTIHIVDFGIAYGFQCPIFIQHLSEVPDGPRKLRITGIEYPQPGFRPAERLQETGRRLANYCERFNVQFEYNSIASSNWETVKIEDLKLQRN

SEQ ID NO: 4929 - protein, 262 aa, Leymus cinereus
WKWKWGWTLFGLTINTLFLILLPREDQMPSPTTTITLLSPPPPPRRTTQLPAVSRSRAAVRKVRHSKICTAGGMRDRRMRLSLDVARRFFALQDKLGFDKASKTVQWLLDRSTAGINHLATSMTASMSLSEEDGSVLLDLDNNDHAIAMAADAETNKQQQQEHQTTKAKRRSVPAAPRKKSNNGGAPVLLPDKASRARARQRARERTKERNRLRSEAQAPAPLPARQPVVPAAACSNSYYEEGGQEPWELGGVVFAKPRYHH

SEQ ID NO: 4930 - protein, 158 aa, Brassica napus
AADAYATKKLEFDALAAAPCDSTASNDSVSMVSNVEAVSSIGLDMKVTDSKKASFGFNFADLQIPDMGCFIDESLIPNACELDFLFTEEKDDQLLDDYCGIDDMNIIGLECDGPSELPDYDFSDVEIDLGLIGTTIDKFTFVDHLATSTTTPLNIACP

SEQ ID NO: 4931 - protein, 168 aa, Helianthus annuus
SSGNASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVPDGPRKLRITGIEYPQPGFRPAERLQETGRRLANYCERFNVQFEYNSIASQNWETVKIEDLKLQRN

SEQ ID NO: 4932 - protein, 216 aa, Zea mays
MAKTKQGNKDVDSYTIGGTNKVVYVGDCVLMRASDSDNQPYVARVEKMEGDGRGSVRVQVRWYYRPEESKGGRRQFHGAKELFLSDHFDLQSAHTIEGKCVVHSFKNYTRLDNVGPEDFFCRFEYKAATGSFTPDRVAVYCKCEMPYNPDDLMVQCDACKHWFHPSCVAMTIEQAKKLDHFVCSDCFKENGSKRLSNAYATSPNFEPKAEPKRQRR

SEQ ID NO: 4933 - protein, 187 aa, Leymus triticoides
  misc_feature (170)..(170): Xaa can be any naturally occurring amino acid
  misc_feature (176)..(177): Xaa can be any naturally occurring amino acid
  misc_feature (179)..(180): Xaa can be any naturally occurring amino acid
  misc_feature (184)..(184): Xaa can be any naturally occurring amino acid
SHHQHPLPRPPSSGGPDAFSYYYYYPPFSAAAATTDYPTPPAVSRSRAAVRKGRHSKICTAGGMRDRRMRLSLDVARRFFALQDKLGFDKASKTVQWLLDRSTAGINHLATSMSASMSLSEEDGSVLLDLDNNDHAMAMAADAETNKQQQQEPKKSNNGGAPVLLPDKAXRARARXXAXXRTKXRNR

SEQ ID NO: 4934 - protein, 279 aa, Glycine max; identical to SEQ ID NO: 268

SEQ ID NO: 4935 - protein, 168 aa, Helianthus annuus
SSGDASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVSDGPRKLRITGIEYPQPGFRPAERLQETGRRLANYCERFNVQFEYNSIASQNWETVKIEDLKLQRN

SEQ ID NO: 4936 - protein, 284 aa, Arabidopsis thaliana
MMGATVGGDGDTAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 4937 - protein, 400 aa, Zea mays
  misc_feature (26)..(26): Xaa can be any naturally occurring amino acid
MDGRESTVASGPNFSSFYTQHRGIGXPGVPGHSAVLHDPPPAGYRQHLDAVSAGYAFQTPQVGGSHIGQGYHHVEASPHVAQYSSGGGTSSGGDMDIGMGSAVCTNVKGELGSGPAQDEQVKKKRGRPRKYKPDGAVTLGLSPSSSLTPHSASLGMGTMVSAPGSGFGSGGSGASGLGAPSEKRGRGRPPGSGKMQQLASLGKWFLGSVGTGFTPHVIIIQPGEDVAARIMAFSQQGPRAVCIISATGAVSAATLHQDSESGSVVTYEGRFEILCLSGSYLVVDEGGGARTRSGGLCIALCGPDNRVIGGSVGGVLMAAGAVQVIVGSFMYGGGSKKNKVKAELDAEPEEANAGDQEVALAEHSSMAPHPAMSGGGGWASGMMRQMESRTPNIDINSIRE

SEQ ID NO: 4938 - protein, 281 aa, Physcomitrella patens
MGRGKIEIKKIENTTSRQVTFSKRRGGLLKKAHELAVLCDAEVALVIFSSTGKHFEFASSGSMRDIIERYRKNSDGAVKRGTNTDLLGREVIKLKQQVERLESSQRHMLGEDLSALKVSDLLELEQQLDQGASRVRARKNQLILEEIEDLRRKEHELMIANEALRKKIADAEGAAEAAARANFPDARLESPKPFASDFSRDMSVSSQLAASVYPHPNLLQAQRSQTSLQLGRLSEQQIPSTEEGCAGESSLKWDHPHFHIPNRLHANISPSVRTYKLHVDR

SEQ ID NO: 4939 - protein, 218 aa, Oryza sativa Japonica Group
MAKSRPPKRILESYTIKGSDKVIKPGDCVLMRASDTSKPPYVARVEAIEAAGSRGTNVRVRVRWYYRPEESMGGRRPFHGAKEVFLSDHYDVQSADTIEGKCNVHSFRSYTKLDSVNAEDFFCRFEYKSATGSFVPDRIAVFCKCEMPYNPDDLMIQCEECSDWFHPSCIGMTIKDAKKLEHFFCQSCTAENGKMAENSHEATAQSEEKQVESKRRRR

SEQ ID NO: 4940 - protein, 223 aa, Brassica napus
EPPINNNNWVKNPQMFEFDNSSPVVRTPEVVTSASFTPHVLTVNAGEDVTMKIMTFSQQGSRAICILSANGPVSNVTLRQSMTSGGTLTYEGHFEILSLTGSFIPSESGGTRSRAGGMSVSLAGPDGRVFGGGLAGLFIAAGPVQVVVGRFVAGQEESQQQQQQQQMKTQRRERFGIPTSTQASNISFGGGSAEDPKARYGLNKPVVIQAPPMSAPPVPFSQH

SEQ ID NO: 4941 - protein, 61 aa, Physcomitrella patens subsp. patens
KKRRYRGVRQRPWGKWAAEIRDPKKAARVWLGTFDTAEEAAMAYDISATKFRGLRAKLNFP

SEQ ID NO: 4942 - protein, 168 aa, Helianthus annuus
SSGDASQRLAHVFASGIEARLAGTGSQLYAAKCAITISAAEKLQAYQVYLSACPFKKIGMSFANKTIFDSALASSNPTIHIVDFGIAYGFQWPIFIQHLSEVSDGPRKLRITGIEYPQPGFRPAERLQETGRRLANYCERFNVQFEYNSIASQNWETVKIEDLKLQRN

SEQ ID NO: 4943 - protein, 364 aa, Solanum tuberosum
MDRVKGPWSPEEDELLQQLVQKHGPRNWSLISKSIPGRSGKSCRLRWCNQLSPQVEHRAFTPEEDETIIRAHARFGNKWATIARLLNGRTDNAIKNHWNSTLKRKCSSLSADEGNELADQIFENQQPPLKRSVSAGSAMPVSGFHFSPGSPSGSDSDSSLHVTSSSQSHVFKPVARTGGVFPQSIDISSPPVDPPTSLSLSLPGVDLAEFSNRSADSTQSKNPFQLLLPPMQIPPPPPPPPPPPPQATTVPFERVSAIQQSLQNPDFGKNAGGEQPDKVFVPFSQELLGVMQEMIKTEVRNYMMGVEQKQQFQQQQQHYQQQPQQFQQQNHQLPSGLGLGLCMQQASDGFRDRAANRMRLSKFD

SEQ ID NO: 4944 - protein, 306 aa, Solanum tuberosum
RIKGPWSPEEDELLQTLVEKHGPRNWTLISKSVPRRSGKSCRLRWCNQLSPQVEHRAFTPEEDDTIIRAHAKYGNKWATIARLLSGRTDNAIKNHWNSTLKRKCPSMSEDLSFETPQPPLKRSSSVGPCTNFSSVMNPGSPSGSDLSDSSLSGFPQPLVYRPVPRTGGIFPLPPPVKQIEIPPSVPDPPTSLCLSLPGSGSIEKPTQSPKSPPLPPPPLPVVDKPIPPSAAVMGHLPRSNQSYDFCAAPKSGEKQFFTPEFLSVLQDMIRKEVKSYMSGFEQNGICMQTDAIRNAVIKRIGISKIE

SEQ ID NO: 4945 - protein, 72 aa, Chlamydomonas reinhardtii
QVQGCTRRMQNEKQYYRRYGVCENHLRALELLVDGRMQRFCQQCGKFQDITEFDDVKRSCRTQLARHSLRRR

SEQ ID NO: 4946 - protein, 273 aa, Oryza sativa Japonica Group
MEGGGGGGGGGGGGGGGRSGGGAPYATRTAEEVFRDLRGRRAGMIKALTTDVEKFYKLCDPWKRENLCLYGYPNETWEVTLPAEEVPPEIPEPALGINFARDGMNEKDWLALVAVHSDSWLLSVAFYFGARFGFDREARRRLFNMINNLPTIFEVVTGAAKKQAKEKTPNSSSKSNKPSSKVQSKAESRSKSKLSAPKDEEGSGDDEGEEEEDDHDNTLCGTCGTNDGKDEFWICCDNCEKWYHGKCVKITPARAEHIKQYKCPDCTNKRTRA

SEQ ID NO: 4947 - protein, 278 aa, Arabidopsis thaliana
MSSSMSSAGSSTPKSKKLKGIVVDMEKSKEKATRNTILKLGSPQEVTSERRIENSSFGSSAVRRGREIMKFYPSKSNKIYTCHFCKKGFSTSQALGGHQNAHKQEREWDKKRKEMEAEYPGLSFLNPFLDKPHILLGGYSQDALSNENHLGITLDPFKRLIYPSFNAGMNMAVVPRVTPTRFFTGNTSTNGSTSRVPDPLPSYNNLYPSNSRNVLPFPPPQTTKLSSNFVSQGNVLSEENFISKIGTNNIVEIDDDDDDIQPEEEKTKSGRIDLSLSL

SEQ ID NO: 4948 - protein, 215 aa, Solanum tuberosum
MKDKEVKTRMKRGFWKPEEDLILKNCVETHGEGNWATISEKSGLMRSGKSCRLRWKNYLRPNIKRGMMSEDEKDLIIRLHKLLGNRWSLIAGRLPGRTDNEVKNFWNTHLNNKRSCRGKKKHVKSKEANTQSTQGKMQEYPAETVSNQEVATKTVLDSWIEEMQDFNCSLLSPLTMNNMPFLEDEPFIPILDDIVLLEAFTSTGKEAWNEIQPFL

SEQ ID NO: 4949 - protein, 237 aa, Nicotiana tabacum
MTESSSSQSESASSDSLPFDFLSDSFDFEADFFQFGDEVSNSSSESANSVHNSTNFIMLELEPTISSSDYEKPQVIIDLTSPKLSNVSDRKPSLKIDLPPVKKFEWIGFCNSTTQSNSIVSVTMQQKRKTEEKRHYRGVRQRPWGKYAAEIRDPTRRGARVWLGTFNTAVEAAKAYDRAAFKMRGSKAILNFPLEVGKNLSYSSSAVDGGVKRRKESDACGEEKGVKKVERCKEEES

SEQ ID NO: 4950 - protein, 291 aa, Arabidopsis thaliana
MQTNEDNIFQDFGSCGVNLMQPQQEQFDSFNGNLEQVCSSFRGGNNGVVYSSSIGSAQLDLAASFSGVLQQETHQVCGFRGQNDDSAVPHLQQQQGQVFSGVVEINSSSSVGAVKEEFEEECSGKRRRTGSCSKPGTKACREKLRREKLNDKFMDLSSVLEPGRTPKTDKSAILDDAIRVVNQLRGEAHELQETNQKLLEEIKSLKADKNELREEKLVLKAEKEKMEQQLKSMVVPSPGFMPSQHPAAFHSHKMAVAYPYGYYPPNMPMWSPLPPADRDTSRDLKNLPPVA

SEQ ID NO: 4951 - protein, 361 aa, Oryza sativa Japonica Group
MEEISHHFGVVGASGVHGGHQHQHHHHPWGSSLSAIVAPPPPPQLQQQQTQAGGMAHTPLTLNTAAAAVGNPVLQLANGSLLDACGKAKEASASASYAPDVEAIKAKIISHPHYSSLLAAYLDCQKVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 4952 - protein, 272 aa, Oryza sativa Indica Group
MEGGGGGGGGGGGGGGGGGGGGAPYATRTAEEVFRDLRGRRAGMIKALTTDVEKFYKLCDPEKENLCLYGYPNETWEVTLPAEEVPPEIPEPALGINFARDGMNEKDWLALVAVHSDSWLLSVAFYFGARFGFDREARRRLFNMINNLPTIFEVVTGAAKKQAKEKTPNSSSKSNKPSSKVQSKAESRSKSKLSAPKDEEGSGDDEGEEEEDDHDNTLCGTCGTNDGKDEFWICCDNCEKWYHGKCVKITPARAEHIKQYKCPDCTNKRTRA

SEQ ID NO: 4953 - protein, 294 aa, Oryza sativa Japonica Group
MMMRDVCMEVLPPMDHYASRGNWFMARKWSPEENKQFERALAGLDLRCPDWDRVARAIPGRSALEVMNHFRDLELDVQQIENGMVPFPVYGAAAAGGAFTLQWDGAHGVGDFRNAYRFGGGGGGKRHFGRTPEQERKKGVPWTEEEHKLFLLGLKKYGKGDWRNISRNFVQTRTPTQVASHAQKYFIRLNSGGKDKRRSSIHDITTVNLTDDRPPSPSQSSLISNQSNTSTLTAAVAPFSSTADVKPQNAANASFNSPSRTLGMAGYGMGLQDQGLQCGGPLHDQLAASRSILF

SEQ ID NO: 4954 - protein, 248 aa, Oryza sativa Japonica Group
MEQLFVDDPAFASSMSSLEADIFSGAGQLPSSPWLDLDLDDDVQDLSMAPTTANAVSSGYGSGGSGSHRKLSHNAYERDRRKQLNELYSSLRALLPDADHTKKLSIPTTVSRVLKYIPELQKQVENLERKKKELTTTSTTNCKPGVLGSQLMSEGMAPIVSATCINDMEIMVQVSLLSNVAGSVLPLSKCIKVLENEGLHFISSSTSSGFGNRTFYSIHLQRSEGTINEECPAFCERLEKVVRNKAKL

SEQ ID NO: 4955 - protein, 231 aa, Zea mays
MVAGLEDPAIDPTALSLALPASAPALNKEDYIAICLAALAGTRKFGLGREKDQHQHTKWCPTTTTTHAPSAQQELRFRCAVCGKAFATYQALGGHKSSHRKPTTPERYAAALAAAATTTAARGDHSDETTASSLSGSAASGGPHRCSICRRGFATGQALGGHKRCHYWDGMSVSISVSSGMASSSGLSTVRNFDLNLAPLPENGDAGMMKRWAEEEEVQSPLPIKKRRMSD

SEQ ID NO: 4956 - protein, 345 aa, Oryza sativa Japonica Group
MTGTEQMMYHQQQVQSDSQHLSSRPGLPPEKQFLLQGGADSSSGLVLSTDAKPRLKWTSELHERFVEAVNQLGGPDKATPKTIMRLMGIPGLTLYHLKSHLQKYRLSKNLQSQANASRAQGVLGCSTTEIDKPCEGNGSPASHLDLETQTNSSMHINEALQMQIEVQRRLHEQLEVQRHLQLRIEAQGKYLQSVLEKAQEALGTIAVAETAATANASSSKRLQNEHTQLHHHQQQQQVGDGSVDSCLTACDCEGSHHSRSHGHRGEQDILSIGLPPFEPAAARSGKEHHYLLFPNEPSRRRSCSDERRREMSTLQASELDLSINGRSSSHSHRRENIDLNGAGWS

SEQ ID NO: 4957 - protein, 573 aa, Zea mays
MSSAAGGGYGAGGAEHQHLLLGQAAGAGQLYHVPQHSRREKLRFPPDDAADSPPPTAWPAPPPFYSYASSSTSSYYSPHSPTLAHAQLVAHALPAGAGVQIPSQNFALSLSSAPSNPPPAPRRQLAAGVATGPYGPFTGYAAVLGRSRFLGPAQKLLEEICNVGGRPPHLDPLSDEGMFGMEHGMGGVDRATAEAVAVSGAEQQWRKTRLISLMEDVCRRYKQYYQQLQSVISSFETVSGLSNAVPFASMALRTMSKHFKFLKGMIMSQLRNTSKVAASDGIGKDDMANFALMGGGADHLRGNSVNTFSQAHNIWRPQRGLPERAVSVLRSWLFEHFLHPYPTDSDKQMLAKQTGLTRNQATSIVSNIHEDKFAVPLLIKLDEQVSNWFINARVRLWKPMVEEIHNLEMRQQLQKNTSAVDKTQLGMQQLIQHSSANSRQRGQSSGGTTRNQDELPPRMPHDMAGQGQQQQQQVSFAYAGLPAHHHGLALSHPQQQAEAVSAVGGGVSLTLGLHQNNNRTYVAEPLPAALPHRFGLEDVSDAYVMQGTTSFGGQDRHFGKGMGGHHFVHDLVG

SEQ ID NO: 4958 - protein, 95 aa, Fragaria x ananassa
SEDTLKTLRTFELHLSSSGSYIEEIRSRIPAVRFDSVCNLKTEHDCSVCLSEFQPESEINHLTCGHVFHQDCLEKWLNYWNITCPLCRTPFQGLI

SEQ ID NO: 4959 - protein, 139 aa, Physcomitrella patens subsp. patens
MGRAPCCDERMSVKKGPWTPEEDQKLVAYIQEHGHGSWRELPEKAGLARCGKSCRLRWTNYLRPDIKRGRFSHEEDQKIIQLHAILGNRWSAIAGHLPQRTDNEIKNYWNTHLKKRLAQMGIDPITHKTSSSGLALTSS

SEQ ID NO: 4960 - protein, 146 aa, Elymus repens
KDRHSKICTAGGMRDRRMRLSLDVARRFFALQDKLGFDKASKTVQWLLDRSTAGINHLATSMSASMSLSEEDGSVLLDLDNNDHAMAMAADAETNKQQQQEQTTKSKRRSAPAAPRKKSNNGGAPVLLPDKASRARARQRARERTK

SEQ ID NO: 4961 - protein, 216 aa, Vitis vinifera
MEGANGYRKGLWTVEEDRILMDYIRVHGKGKWNRIAKVTGLKRCGKSCRLRWMNYLSPSVKRGDFSQEEDDLIIRLHNLLGNRWSLIAGRVPGRTDNQVKNHWNTHLSKKLGIKKHKSKSEGSSQAQSIEAKEAHSMPSNPDSKPPSEDKNGETGPEVREDLPRSMTMLANTQDMEMGTEDYESSLWFSTGDLDLNAPSLMQFLDGHVLDFVWDGL

SEQ ID NO: 4962 - protein, 168 aa, Helianthus annuus
SSGDASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVSDGPRKLRITGIEYPQPGFRPAERLQETGRRLANYCERFNVQFEYNSIASQNWETLKIEDLKLQRN

SEQ ID NO: 4963 - protein, 307 aa, Petroselinum crispum
MIQNQKVDNRRMGNHKQKWTAEEEEALKAGVKKHGMGKWKTILVDPDFATALTHRSNIDLKDKWRNLGISSSTAAQVSKDKSPVLSITNGSAAIPIAQTAITAQNAITAQNTVTAQNTVTAQNAATAQKASTTVALVDANAISSSPKTPANAVTIPTKRYYSLIFEAISSAKDPRGADFNTIATFIEQKNEVPHNFRRALSSLVRRLTMQKKLEKVEQRFKIKNSGTRIPTPRQRDAKPGTSRKSVLLDPATLEGAVSIASERLADAEHKSCVAIEAVKESENIAELAEEAESMLEIAKGIWEQCHL

SEQ ID NO: 4964 - protein, 103 aa, Hordeum vulgare
TSVCCAVCSTVTAVPAPGTEMAQLVCGGCHTLLMYIRGATSVQCSCCHTVNLAMEANQVAHVNCGSCQMLLMYQYGARSVKCAVCSFVTSVGASSGAEQKPSN

SEQ ID NO: 4965 - protein, 307 aa, Petroselinum crispum
MIQTQKVDNRRMGNHKQKWTAEEEEALKAGVKKHGMGKWKTILVDPDFATALTHRSNIDLKDKWRNLGISSSAAAQVSKDKSPVLSITNGSAAIPIAQTAITAQNAITAQNTVTAQNTVTAQNAATAQKASTTVALVDANAISSSPKTPANAVTIPTKRYYSLIFEAISSAKDPRGADFNTIATFIEQKNEVPHNFRRALSSLVRRLTMQKKLEKVEQRFKIKNSGTRIPTPRQRDAKPGTSRKSVLLDPATLEGAVSIASERLADAEHKSCVAIEAVKESENIAELAEEAESMLEIAKGIWEQCHL

SEQ ID NO: 4966 - protein, 309 aa, Triticum aestivum
  misc_feature (136)..(136): Xaa can be any naturally occurring amino acid
MLAMDQHNHQEESCVPPGFRFHPTEEELVGYYLARKVAAQKIDLDIIQEVDLYRIEPWDLQERCRGGRGGRGARQVAAEDEQSSEWYFFSFKDRKYPSGTRTNRATAAGFWKATGRDKPVTSSRSRGVIGMRKTLXVFYRGRAPNGRKTDWIIHEYRLQTSEHAPTQEEGWVVCRAFQKPTPNQRPSYIFPAYAAAPGLGGYYDARPWLHGRGGDLPYLQSAAGAAGAGGLGFPGFPGQGIQYSDDLLESKQSLFGNIPQLIESPPTTTAVAGGGDAGYDVVQQGQAAAGIDWNFLDSLLSTSQLHLQQ

SEQ ID NO: 4967 - protein, 183 aa, Nicotiana tabacum
MLASNNPKKRAGRKKLRETRHPVYRGVRKRNSGKWVCEVREPNKQSRIWLGTFPSAEMAVRAHDVAAIALRGRSACLNFADSAWKLHIPASTDAKDIQKAAAEAAEAFRTSEAENMPEYSGEDSKEVNSTPENMFYMDEEALFCMPGLLANMAEGLMLPPPQCSQIGDHMEDDFDMPLWSYSI

SEQ ID NO: 4968 - protein, 1186 aa, Aspergillus nidulans FGSC A4
MPSILSDADKETVKRSVPKPANKIHAVAVARLFVAYPDPHKWTYTGLQGAVVLANDLVGRTFWLKLVDVSPAGRGVIWDQEIYENFQYNQDRTFFHTFELDDCPAGLSFADEKEAKTFIKKMSEREKNASKETRQTPFASTRGQGPTPVANGKSHGVGRSIFGSLLGRSSAPTHITPAELPPAPTIQVAPPPPAPAATPPRKELPFDTSDPSWKGLLNELEAMGFTEDQIADNADFIKSYIEQKKASEGESATPPADDRKGKAPPPPPPSVPPPKTSAVSPQHTGSSSGSKRGAPPPPPPSRKTPAKTEDDQAPTPPRDPSPPRPRFRAPPPIADAGKYAHTAGQAPPARPRAASGATPGPPPPPRPPKAPVDDAPPRFGVPPPFQGERKVSAPPAPPSRSPAGPPPPPPRTASPATPPQLPPKVPAFSSGPPPPPPRSPASQPPPPPPVPGASRPVPPPTASVPPPPPPPARPTPTVTGPPPPPPPPPASSGPPMPPPPPPPAPGSSAPPPPPPPPPGAGAPPPPPPPPGAGAPPPPPPPPGAGAPPPPPPPGAGAPPPPPGGAAPPLPQPSGGRNDLMAAIRASGGGGLRKVKDSEKKDRSAAMVPGAASESAAATPSTGGGPQGGLAGALQDALAKRKQKVSGSVFCCSLSHIVRGLIAEAMRNIVDPALSVLENLKSGKRLSRSPQSRNFSSTRSRPILRRFWDFRRKKQAAEPRRGPSLLDDTENLSLARALAAKASNELRLRCTEFDINGNVTLMNGEFKKSELIAKYGLLPRDLRKIDSSTLPHIFVRPSTILINLLHLRVLIKADRVLVFDAYGSTDSYMQSLFVYDLEGKLRQKQAQSTGAGSLPYEFRALEAVLISVTTGLEEEFNGVREPVVRVLRALEEDIDRDKLRHLLIYSKKLGTFEQKARLVRDAIDDLLEADDDLASMYLTERANGFQREEHDHQEVEMLLESYHKVCDEIVQASGNLVTSIRNTEEVVKAILDANRNSLMLLDLKFSIGTLGLATGTLFSALYGMNLKNFIEESDLGFGAVSVTCFAISALVCVYGLAKLRKLQRVRMWGEAGVGGTPIIPLHSSRASAVPGHRANWRADSIEPVWGSLPGEGRAERMKRLKDSSAAAAARSAASNAASTRAASLRRAIRFPSDSAVKGKENQKDAAAAVGADADTGVQTQSGGSTAA

SEQ ID NO: 4969 - protein, 219 aa, Nicotiana tabacum
MDIFRSYYSDPLAEYSSISDSSSSSCNRANHSDEEVMLASNNPKKRAGRKKFRETRHPVYRGVRKRNSDKWVCELREPNKKSRIWLGTFPSAEMAARAHDVAAIALRGRSACLNFADSAWKLPIPASTDAKDIQKAAAEAAEAFRSSEAENMPEYSGEDTKEVNSTPENMFYMDEEALFFMPGLLVNMAEGLMLPPPQCSQIGDHMEADVDMPLWSYSI

SEQ ID NO: 4970 - protein, 250 aa, Brassica napus
MNGDGAYNPRTVEEVFRDYNGRRNGMIKALTTDVHEFHRLCDPEKENLCLYGLPSEDWEVNLPAEEVPPELPEPVLGINFARNGMLEKDWLSLVAVHSDAWLMAVAFFFGARFGFDKADRKRLFNMVNDLPSVFEVVVDFAAKKQSKEKSSVSNNSSNRSKSNSKRGGSEAGPEPKEEEVEEEESDDDEEEGDTECGACGETYAPDEFWICCDMCENWFHGKCVKITPARAEHIKQYKCPSCSNNKRGRS

SEQ ID NO: 4971 - protein, 480 aa, Debaryomyces hansenii CBS767
MSEENKELFTNVGEQVETVEQPSQDGVRQTGAADAEGHPVQEIESLCMNCHKNGTTRLLLTRIPFFREIIIMSFECPHCGLKNSEIQPAAQISEKGSRYVLKLENKKDFNRQVVKSETATCKFNELDIEIPPKRGQLSNVEGLLNEMVDDLESDQEARKELQPEVYEKINEVISKIKSFVNAEPNTLPLTVSVDDPAGNSWIEYLPDEPSHKWSMYEYNRTAEQNVFLGLVSADEVAQHRRVESENKKAATASNVSSSLASNPKASGFISDTSEIENMDNEVQTFHATCSSCLKSCETHMKTVNIPHFKDVIIMSTACDNCGYKSNEVKTGGEVPEKGRRVTLKVNDPEDLARDILKGESCGLNIPELNLDLTPGTLGGRFTTIEGLLTQVYEELHSRVFSQTSDSMDNSTKTRWTTFFARLQDAIEGKIGFTVVMEDPMASSYIQNVYAPDNDPNMIIEDFERTHEMNEDLGLNDMKTD

SEQ ID NO: 4972 - protein, 332 aa, Oryza sativa Indica Group
MDGRFPLPPASGGGRGHHRRAHSETFLRLPDADLLLDPEGDFSFSDLDFPSLSDDSPAISDPTPPPPPPMAATPAPAPRPPGGAHMRSLSLDTAFFEGFSLQGGGGGGGGGGGGGSGGSGGHKRSGSMDGVNSPFEGESALSGGLPDYAKKAMPAERIAELALIDPKRAKRILANRQSAARSKERKIKYTSELERKVQTLQTEATTLSAQLTLLQRDTSGLTAENRELKLRLQSMEEQAKLRDALNEALREEVQRLKIAAGQAPNMNGNPFNGGLQQQIPPYYTQQQQQQQQQMPYLGGHHAQQRHPSHQQSSSNGGQSLSGQSLNDSMDFM

SEQ ID NO: 4973 - protein, 187 aa, Fragaria x ananassa
MRKPCCEKTETTKGAWSIQEDQKLIDYIQKHGEGCWNSLPKAAGLRRCGKSCRLRWINYLRPDLKRGSFGEDEEDLIIRLHKLLGNRWSLIAGRLPGRTDNEVKNYWNSHLKKKILKTGTTLRPNKPHENNHAPNNKLVKLFNKMDDEVVDEVSSADSAAGCLVPELNLDLTLSIKTSTGMADPQVA

SEQ ID NO: 4974 - protein, 214 aa, Zea mays
RPKTNQSTHTLPATMPSSASADAEGARSKRKRGSSAACASDGSDQQGPSSHWLTPRAQQAYSSKLLQALRLVRGGTGTPTCPASAPAVRDAAYRALAVAARGRSRWSRAILARSRRRRALLRARRPPPPTPRHRQRRHQQQQDERPAGGLAGRAKVLARLVPGCRSLSLPALLAEVSDYVAALEMQVRAMGQLTHDLASSSSAPTTASTMIAPP

SEQ ID NO: 4975 - protein, 75 aa, Zea mays
CFFFSYSRDQLYPFTIIAEANSTAQHLVDFTEAEEDLVSRMHRLVGNRWEIIAGRIPGRTAEEVEMFWSKKYQER

SEQ ID NO: 4976 - protein, 298 aa, Fragaria x ananassa
MGDTFEYNYQNNSSCSSSAPASSVSVAQSHSSTDEISLFLQQILVRSSSLTGQQFLFSSSPAGYALPENLGSPSNDSFVGGVIRGVDVSTAVVTASGPNVSSSSVGASENEADEYDCESEEGLEALVEEAAVKSGGRSSSKRSRAAEVHNLSEKRRRSRINEKMKALQNLIPNSNKTDKASMLDEAIEYLKQLQLQVQMLSMRNGMSLHPMCLPGASQFSQIRMDFGGEENRPVHLNMSGILNMNQDPSTQNLYNPNQSLCTRFVKCSQFRRCIWIGSIYSGSLGTLSAPKLIQGNLQ

SEQ ID NO: 4977 - protein, 486 aa, Arabidopsis thaliana
MDLSAKDEFSAEKRNPDNYDSVNNPSGDWRVDSYPSENLISAGPASCSPSQMMDSFGQTLWYDPTSVQAVGYAGFNGGNASSSSFRGSIDRSLEMGWNLPNLLPPKGNGLFLPNASSFLPPSMAQFPADSGFIERAARFSLFSGGNFSDMVNQPLGNSEAIGLFLQGGGTMHGQCQSNELNVGEPHNDVSVAVKESTVRSSEQAEPNVPGSGNVSEDTQSSGGNGQKGRETSSNTKKRKRNGQKNSEAAQSHRSQQSEEEPDNNGDEKRNDEQSPNSPGKKSNSGKQQGKQSSDPPKDGYIHVRARRGQATNSHSLAERVRREKISERMKFLQDLVPGCNKVTGKAVMLDEIINYVQSLQRQVEFLSMKLATVNPQMDFNLEGLLAKDALQLRAGSSSTTPFPPNMSMSYPPLPHGFMQQTLSSIGRTITSPLSPMNGGFKRQETNGWEGDLQNVIHINYGAGDVTPDPQAAATASLPAANMKVEP

SEQ ID NO: 4978 - protein, 204 aa, Arabidopsis thaliana
MAFDLHHGSASDTHSSELPSFSLPPYPQMIMEAIESLNDKNGCNKTTIAKHIESTQQTLPPSHTTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 4979 - protein, 345 aa, Arabidopsis thaliana
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSESGVFANVQGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCYSISRT

SEQ ID NO: 4980 - protein, 237 aa, Leymus cinereus
CTAGGMRDRRMRLSLDVARKFFALQDMLGFDKASKTVQWLFNMSKGAIREVMTDEVSSDCEEDGSSSLSVVDGKHKPPGPEVGGGDHGEGKKPVARAARRAPANPKPQRKLASAHPIPDKESRTKARERARERTREKNRMRWVTLASTINIEPAATGMAAARPDDLIRSTNNLINRSSSMNTASAELEEGCSSSMPSEAIMAGFGNGGYGSSGNYYQYQLEQQWELGGVVFANSRPY

SEQ ID NO: 4981 - protein, 265 aa, Brassica napus
MADTSSRTDASTDGDTDPRDLGSERGQMMLAGASDSSDRSKDKLDQKTLRRLAQNREAARKSRLRKKAYVQQLENSRLKLTQLEQELQRARQQGVFISSSGDQAHSTGGNGALAFDAEYSRWLEEKNRQMNELRSALNAHAGDTELRTIVEGVMAHYEELFRIESSAAKNDVFHLLSGMWKTPAERCFLWLGGFRSSELLKLIANQLEPMTERRVMGLNSLQQTSQQAEDALSQGMESLQQSLADTLSSGTLGSSSSDNVASYMG

SEQ ID NO: 4982 - protein, 196 aa, Vitis vinifera
MENHVSQQNLAATNNPFLPGGAGDGSFGSKIHGEDKKLRLFGFEVDLYCKGAELQGGSELDETANSPDVALSKMEKSVEKPEHKKYECQFCLKEFANSQALGGHQNAHKKERLEKKRLQLQGRKGSLNFYFQPLRSDVGFIYHESPWFYDSVSSSIPEFMLYKEPHISFDEPQASGSTLSQPIPTRHPFAKPETEV

SEQ ID NO: 4983 - protein, 339 aa, Vitis vinifera
MFEEYIFFLRCTKLPKHSLKVINGSIRFPRTKPYTMSFHRFYASWFDHLNHLVHQLTLAPKPTTPQDNPALLQLVQKVISHYSQYYRAKSVAAQNDAVSLFAAPWSSSLERSLHWVAGWRPTIVFHLIYTETSARFESHIADILHGVRTGDLGDLSTAQLHRVSELQCETVREENEITRELAKWQEGAVELVEAGGDGNVEEKIGGLMSVLVKADELRMRTIWRVAEMLTPQQAVEFLIAAAELQFGVRVLGLNHDNQRENSQNSNKSWQEVRNQVHKSSKKHHACKNFTIITRRPHHFISAMNFSYSASVPWVFFSAGGTGGGTGGAELQGAFPMFCD

SEQ ID NO: 4984 - protein, 253 aa, Triticum aestivum
MVSALSHVIRATPDQQQAYYPAGSAAVSGEQQHQHDAAAAAAIAEEQGRKRHYRGVRQRPWGKWAAEIRDPKKAARVWLGTFDTAEDAAIAYDEAALRFKGTKAKLNFPERVQGRTDLGFVVTRGIPDRLQQQQQCPATVGAPAMRPLPHQQQTVVPYPDLMRYAQLLQGAGSAGGAVNLPFGAMSPPSMSSSSPHILDFSTQQLIRVSPTSPAAAISSSGTTGPSTSSSTTTASSPGAAWPYTGEHKNNKDS

SEQ ID NO: 4985 - protein, 238 aa, Prunus persica
MGRGRVQLKRIENKINRQVTFSKRRTGLLKKAHEISVLCDAQVALVVFSNKGKLCEYATDSCMDQILDRYERYSYAERQLVEPDIESQCNWTFEYSRLKAKVELLQRNQRHYLGEDLDSLTLKEIQSLEHQLETALKQIRSRKNQLMHESISELQRKERAMQEQNNLLAKKIKEKEKAAAEEVHNWEQQNNGLNLLPQPLPCLNMGGTQQDEFLQVRRNQLDLTLEPLYSCNLGCFAA

SEQ ID NO: 4986 - protein, 212 aa, Brassica napus
  misc_feature (124)..(124): Xaa can be any naturally occurring amino acid
  misc_feature (153)..(153): Xaa can be any naturally occurring amino acid
MAKIGLKPDPVNNNAKEIRYRGVRKRPWGRYAAEIRDPGKKTRVWLGTFDTAEEAARAYDAAARVSRGAKAKTNFPNLLELSEKVPAAGGGFERSPSQSSTLDCASPPAAVTPASAGIAPPQLXELRLGNYQIPLARPVYFLDVMGVGNGGSXPPPVASAFRLPVMLGLQEVACVAQSDSDSSSVVDFEGVMEKRSQLFDLDLNLSPPSEQA

SEQ ID NO: 4987 - protein, 130 aa, Triticum aestivum
  misc_feature (76)..(76): Xaa can be any naturally occurring amino acid
MEDLYSIHPGISRGGEGGAACSEASGVAGGASSPPPPPPPADLTELMKAQIAGHPRYPSLLSAYIECRKVGAPPEXAALLEEIGQPERRGGGATAAGEIGLDPELDEFMEAYCRLLSRDKEEPVPRWTRP

SEQ ID NO: 4988 - protein, 533 aa, Glycine max
MWDLNDSPDQRINKDEESEEGCSSLNKTSFDGDDDNNNNKGKRLESVSNSSSSAVVIGDGSEEEYEEEEEDEEGVGVGGGRSMKKRSSKIFGFSVTQNEEESMDSDHPPVTRQFFPVEDADVAVATGGGGTGVSSTFPRAHWVGVKFCQSETLGTGKSSVEVSQPMKKSRRGPRSRSSQYRGVTFYRRTGRWESHIWDCGKQVYLGGFDTAHAAARAYDRAAIKFRGVEADINFNIEDYEDDLKQMSNLTKEEFVHVLRRQSTGFPRGSSKYRGVTLHKCGRWEARMGQFLGKKYVYLGLFDTEIEAARAYDKAAIKCNGKEAVTNFDPSIYDNELNSESTGNAPDHNLDLSLGNSTSNPGNDQALGNQAPNAVTHDQHMPSESNWRNGGIKPKLVNILPKPCYRSNNKDTHGRDVHGESETLRMLSQTHLHSPAFNEMQQRYGPYRSPGGESQMLQNFAHIHPPNFHFPRSSIGGRIGSDLSLSVADQQQWQTGPSRYLATAAASSSFQQEIRPSSQGWLQKNGLHSLMRPS

SEQ ID NO: 4989 - protein, 248 aa, Rosa hybrid cultivar
MAYENKPNTVLDADAQRRLGRGKIEIKRIENTTNRQVTFCKRRNGLLKKAYELSVLCDAEVALIVFSNRGRLYEYSNNSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKIADNERHQQSINAIAGGHGSYEIMQPTQPFHEARNYFQVNALEPNIHQYSRHDQISLQLV

SEQ ID NO: 4990 - protein, 1318 aa, Chlamydomonas reinhardtii
MEAVEHFSAAFSAQHQGWASSKYAWDPSSLVAVPGPDAARSSPSVEGDHGTDADRDQSLGPTPINWKPAGARNTGAESKSHAARLPKTLVCQVEGCGHDLTGEKGYYQRYRICEPHVKLLTVEVEGRACRFCQQCGRFHELSEFDGTKRSCRARLLLHNARRRKRDPVDASTKEPRSQRKAKATHPRSDDSNDNELDSRGSFGASHGTWPASGAPTSVPVTEADPAATPAVSSGAVPQLMTRAGLNDQSLPLPGFQQPVSQALQSAGYAPAFANTLAVKHEQPELLVSTSGGAAVLGVMMQRESLPLDLAHAFSDEADLPLVDTLKLDDFMLDGLMAMDYIDELPGPRQLMPGYSPMLTGDESMMGVGIMPPTAAMGSAALHAPYMPVSGDVSMSRAVPRTVLNEQSQMQQIADAQRRLLQSAGVLPGPTHQGTFLAEPQQVNDGLNSGMSVCSLGGGGFTSPCSSGMGKPLGSGFSVPPHPSAGSHHMMLSSGVTLNVPSAVPSPINVGPSMAQAQAQMQAQAPFGAVGGGMSSFDMARRLVAGGGAGAQYRSDDFLVRVSIKVANCTPEELPPDLYQRLQSLLATADASLIQGFLRPGCVHLVLDISGGEGLQQALLAARVRSALGPVAQKYATLVQVGEEVAMWAEDAPAAAQPASAARVPELEATGAVPVLLHVSPAAYLCHSTADGSSSASVVVYGSGLVKAGVQLFARMQGGYLPVRVQPLVAEGQLMVQGAEAVAALQDLAQLAQGGRSATDALLVSVEGAPASGLLLLEAQAGPLLSAWRPCLLSVDSAMATELTAAGVQARAAGNDRLQSLESFVTDLGRLVDACSFAKAGTGDAEEEAVSMERLCACEHMLAWASEAGLPAVSSFLVHTLLQYGQELGTVLEAPYADGLSVLHRAVRSRSEAMIRAVLGWAAREGVELSWRGEDAVGQLSPLHLVALVPVAWRVLATEPAVQRAWARERAADGATPALVQQILFSCLQAATNARRASAPVAEVVVAAGAQAAAAQVCAAPRTLETIETAVAPSAAGAVSPATAPTPTRPASILRAVLPLMAVLAALTYASLMHTLQASYLPVVVVTCVLMYALWRLLTTVAARPQHAVLMSMLASPLPPVFSSARLEAAYQMRASMAATQLSRDAAALLVLLAMCAAAARLPDASAFATAVNTCLTLLPLAAMKLSRQGYIRVRDIALTGAYVAMLNAICSTSQSLLADSPRCRCAMLFLAVTTAAGAVAPLNTSGMLFTLAYTVSMAMRAWTQTQGLFGGASSVTAAQACSAAQLAVVAAATAVSFARELAARQQWLAVAGEAASGK

SEQ ID NO: 4991 - protein, 261 aa, Ipomoea nil
MVNSSSAWPPPSSSRLMRKGAWTEEEDNLLRKCIQKYGEGKWHLVPLRAGLNRCRKSCRLRWLNYLRPDIKRGDFSVDEVDLIMRLHRLLGNRWSLIAGRIPGRTANDVKNYWNTHIQKKVFAMARMQDNWKGKAPEIRENTVVRPRPRRFLNTSLSPTSKTGKATAVTYDAQIQGHTLPQPPEAIITTSDLVMENVQLNNTIATLPSELETTTSDDRVRWWEDLLFDKEFNDDEGNACMHEGQVGWTNLPIDMDLLELLS

SEQ ID NO: 4992 - protein, 300 aa, Oryza sativa
MSVAAEGKEKGVGGGGGGAGAGACELCGAAARVYCGADEATLCWGCDAQVHGANFLVARHARALLCRGCARPTPWRAAGPRLGPTASLCERCVRRGGGGRGGGGGGGAAGGGGRGGGGDEEMGGEGDEEEEDEDEEVVVEEEEDEDDEDEEGEGEGENQVVPWAEEAEATPPPVASSTSSSSREAAANGANAADRVKEDQPCSTSQPSLCRYASSAHHGGGGRSDEATSSRNGGGVGGRFLASRHRKRSPSDFRRSGLAQSLIDSKLAFRFQEHCKSTFPSSSLSILPCTWQLFLRQLKQ

SEQ ID NO: 4993 - protein, 668 aa, Glycine max
QDMSKQPPTQELVAKDLHANEWRFRHIFRGQPRRHLLQSGWSVFVSSKRLVAGDAFIFLRLNGELRVGVRRAMRQQGNVPSSVISSHSMHLGVLATAWHAILTGTMFTVYYKPRTSPAEFIVPYDQYMESLKNNYTIGMRFKMRFEGEEAPEQRFTGTIVGIEDADTKRWPKSKWRSLKVRWDETSNIPRPERVSQWKIEPALAPLALNPLPMPRPKRPRSNVVPSSPDSSVLTREASKVSVDPLPTSGFQRVLQGQELSTLRGNFAESNESDTAEKSGVWPPATDDEKIDVSTSRRYGSDSWMSMGRHEPTYPDLLSGFGAHGDHSSHPSFVDQNGPVANLSRKHLLDREGKHNVLSPWSGVPSSLSLNLLDSNTKGSAQGGDTTYQVRGNLRYSSAFGEYPMLHGHKVEHSHGNFLMPPPPSTPYESPRSRELLPKPISGKPCEVSKPKDSDCKLFGISLLSSPIAPEPSVSQRNVPSEPVGHMHTTSHQQRAFDNDQKSEHSRGGSKPADGLLIDDHEKVLQTSQTHLKDIQAKSHSGSARSCTKVHKKGIALGRSVDLTKFSDYGELIAELDQLFEFGGLLTSPQKDWLIVYTDNEGDMMLVGDDPWQEFVAMVRKIYIYPKEEIQKMSPGTLSSKNEENQSASEGATDTQEIKCQLNNSASDT

SEQ ID NO: 4994 - protein, 168 aa, Helianthus annuus
SSGDASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVSDGPHKLRITGIEYPQPGFRPAERLQETGRRLANYCERFNVQFEYNSIASQNWETVKIEDLKLQRN

SEQ ID NO: 4995 - protein, 83 aa, Triticum aestivum
PTRPGRHILKYSSEAAVDTYEEIAIIIPRGRRTVELHLSFLRLHGQADDIKIQYGSIVRLFVLPKPNSPHTFVVITLDPPIRK

SEQ ID NO: 4996 - protein, 77 aa, Chlamydomonas reinhardtii
ARAQVTGCGLCLEGLKRYYIRMRVCEKHLHAPAVLVNGTISRFCQQCGKWQAVAEFEGSKKSCIATLERHNARHRAK

SEQ ID NO: 4997 - protein, 270 aa, Malus x domestica
MGRAPCCEKMGLKKGPWTSEEDQILTSFIHKYGHGNWRALPKQAGLLRCGKSCRLRWINYLRPDIKRGNFTREEEEAIIKLHEMLGNRWSAIAARLPGRTDNEIKNVWHTHLKKRLKDHTTTTSSTTSTRSSSNSTSNVKSQFVDEPENLNYPQPSSSDVSSSVTKVSAALSTDQDTIVVKGENMELSETFPDIDDDSFWSEALSTDNSSVPLQFPKASNDEPISEFPITKNDSEEFGFSFGLNMDDGMEFWYDLFIRTGHGGTPELPEF

SEQ ID NO: 4998 - protein, 282 aa, Brassica napus
  misc_feature (230)..(230): Xaa can be any naturally occurring amino acid
  misc_feature (258)..(258): Xaa can be any naturally occurring amino acid
SCSSFDGSCMGKVCMSTSDLAVYVVDAHVWGFRDACAEHHLQKGQGVAGRAFLSGNLCFSRDVTRFCKTDYPLVHYARMFKLTSCFAVCLKSTYTGDDEYVLEFFLPPGVTDEGEQDSLLGSLFQTMKQHYSSLKVVSGTELFENEMSIEVVEASEEGMVYSKREPIQISISKDYLEINAPEEKLRLNPDLVVENNDVANGFERFRTFNPSAEEAKTEKKTERKRGKTEXTISLEVLQQYFAGSLKDAAKSLGVCPTXMKRICRQHGILRWPSRKINKVNRS

SEQ ID NO: 4999 - protein, 452 aa, Zea mays
MIATTRGSSAKAAAAVGGKAARACDGCLRRRARWYCAADDAFLCQGCDTSVHSANPLARRHERLRLCPASPLQTPPDRSAAAAATATNKRERHDEVAVPAWFGRKARTPRGGHAKSVGQVALSRRLVVPHAAGGDSDSPDERNGGEEEQLLYRVPILDPALAEFCSPPPLEDAAGLALDASVCNEDGAIEDPAKPDPAAPLAQFCPVSGHFNFGPTDAELREFAADMEALLGHGLDDGNEEDSSFYMETLGLLDPMELGDDATQVKVETDGSSACCEASGTLACGLELDLEASDEMLDIDFEYASPQDTATDERAASSDTGADAQFLQTSLSLTLNYEAIIQSWGSSPWTGGGERPHVKLDTRWPHDYTNMWVVGGVVGHGGEDLPGTPRLGMDGGREARVSRYREKRRTRLFSKKIRYEVRKLNAEKRPRMKGRFVKRATAGGSLAIAGLA

SEQ ID NO: 5000 - protein, 281 aa, Triticum aestivum
MSDCSTGTDSPRADSVDEQPPADAESPGGGQSKRDQPSPSSPLPPPKRSRRSVEKRVVSVPIAECGERAKTNGEGPPPPDSWAWRKYGQKPIKGSPYPRGYYRCSSSKGCPARKQVERSRADPTVLLVTYSYDHNHPWPAPKTGCHPNKSSPRLVDPKPEPGTPVECQPEQGPEAPEQEQEEEHEQKPVIGLADPAAITTVTAAAEEEEESFDFGWFDQYPTWPRTALYVPAFDVAPPPEDWERELQGEDALFAGLGGLPECAIVFGRRRELALAATAPCS

SEQ ID NO: 5001 - protein, 176 aa, Glycine max
MATEEVNKPQSLPPYPEMIVKALEALNEADGSNKSAISKYIETTYGELPDETVLGSHLNKMKESGELAFKQNNYMKADPNAPPKRGRGRPPKPKVPLPPGTVVSPPRPRGRPPKDPNAPPKSPKAKATPATGRPRGRPKKVARSPAVPSPTAVSTGRPRGRPPKVKPQLTEVSVES

SEQ ID NO: 5002 - protein, 129 aa, Physcomitrella patens subsp. patens
MDVSPEVSGGGTRLKGAAGGAGTDDRIKGPWSPEEDVVLNRLVEKFGARNWSLIARGIPGRSGKSCRLRWCNQLNPGVKRKPFTEEEDRAIVAAHAIHGNKWASIARMLPGRTDNAIKNHWNSTLRRKH

SEQ ID NO: 5003 - protein, 766 aa, Oryza sativa Japonica Group
MGSETNKEGARGGGQFEVVATTCEVTIVVGCMKEMSAGQFYCKGEERVDGGAGIKRRGAPQRKGKSPKKVEGKTYKYKGFVIEGCELDSTIIMIKSSDLVHIPSIFTPPEVNSQKGSKTSICIDRSLSQAYHDSPDNASILPTNLAQRIQLSSDTLGSDKRHGIAGKTDHETAQKHAKLSCFDQRCLDKMKQLTSGMNVQKRDLAKTHNDEITACDWDYLGTQYDSSVVPESDLRFETAELLLETPKNGDAMPGKSFLPIVEANLENSRRKLFQGSADCYSQSAVDNIHAYCTSRGKEVATNHVSGILPCPRESQLIPDHHFSDSLEVPSDYMAMNPSAVSQHLRGLHRRSLFNDKVRDPTMGVQSVSNLGASTCATRHRSIPDDNYSKLVGSPVCALPNVDLHLVRMTEEMVPYNMTCTVNSTLSISEHNTEISDYSSQATMPTSAGNSGQENPKRKRQKCQNDNVDSCKRCSCKKSKCLKLYCECFASKVYCSESCSCRGCFNDHSHEETVLSTRNRIESRNPLAFAPKVIRTCGPGLEFGEDSNATPASSRHKRGCNCKRSYCVKKYCECFQSGVGCSMSCRCENCKNSFGVRKGIERFETKEIERADRKMKDHPKEEQSEMDKYHALCEIWGVRSTENLFTTPSMDSRRAFALFPSECPKSSLTSSTRTSSHLHSPTRTDVLLSPFGSYTQMLLGNEASDMLLQQGDSSCTASLRIASPNKKRVSPLRTGNTLSPTCRKELGLKSIIPPFPSLTGDANSELQ

SEQ ID NO: 5004 - protein, 163 aa, Zea mays
MDAFTHVPPGFRFHPTDEELVDYYLRKKVALKKIDLDVIKDVDLYKIEPWDLQEKCRIGSEEQNEWYFFSHKDKKYPTGTRTNRATTAGFWKATGRDKPIYVKNCLVGMRKTLVFYKGRAPNGQKSDWIMHEYRLETNNNGIPHEEGWVVCRVFRKRLATVQR

SEQ ID NO: 5005 - protein, 251 aa, Ipomoea nil
MANSSAWSGVRKGAWSEEEDNLLRKCIQEYGEGKWHLIPIRAGLNRCRKSCRLRWLNYLRPDIKRGDFKLDEVDLIMRLHKLLGNRWSLIAGRIPGRTANDVKNYWNTHIQKKVFAMASSMQDNWKGKAPEMRENNVVRPRPRRLFLNTTSSLLSGTPPLTGKATAVTFDAQIQGHNKIPQPEATSELVTKNLQENNTIITASELETTTSNDRVQWWEDFLFDNAGSTCMNQGQVDWPNFPTDMDLSELLS

SEQ ID NO: 5006 - protein, 425 aa, Oryza sativa Indica Group
MDMEHELRGGGVGAAAHGHGSICFSGGPVLVDGRRIQQLLLHCAAALESNDVTLAQQAMWVLNNIASSQGDPSQRLTSWLLRALVARACRLCAAAPAGAAVDFLERGRAPPWGRAMSVTELADYVDLTPWHRFGFTASNAAILRAVAGASAVHVVDLSVTHCMQWPTLIDVLSKRPGGAPAIRITVPSVRPAVPPLLAVSSSELGARLAIFAKSKGVQLEFNVVESATTTSPKKTSTTLCQELASVLSDPPSLGLRDGEAVVVNCQSWLRHVAPDTRDLFLDTVRALNPCLLTVTDEDADLGSPSLASRMAGCFDFHWILLDALDMSAPKDSPRRLEQEAAVGRKIESVIGEEDGAERSEPGARLAERMSRKGFAGVVFDEEAAAEVRRLLSEHATGWGVKREDDMLVLTWKGHAAVFTGAWTPN

SEQ ID NO: 5007 - protein, 230 aa, Brassica napus
MTRRCSHCSNNGHNSRTCPTRGSGTCGGLGGSSSSAVKLFGVRLTDGSIVKKSASMGNLSALAVSPSFPLAMGNHSDSPLSDHARYSNQDNEGYLSDDPARGFGPIHRRVERKRGVPWTEEEHRLFLVGLRKLGKGDWRGISRNYVMSRTPTQVASHAQKYFIRHACSSRRKRRSSLFDMVTDSLPTQEDTSSPSKELKNKTYLPSLELSLNNTTESEVVTTTAPPQGEL

SEQ ID NO: 5008 - protein, 188 aa, Oryza sativa Japonica Group
MRKSKQPQPQPSPEIRYRGVRKRPSGRYAAEIRDPAKKTPIWLGTFDSAEVAARAYDDAARSLRGPTARTNFPLAAPSAPPPRPPAAAAAAATSSHSSTVESWSGGAPRAAASALARSAAPMEATQEEDCHSYCGSSSSVLCEDGSDDAAASRTPLPFDLNMPPPEEELDMAAVADQMGIRYDTLLRL

SEQ ID NO: 5009 - protein, 452 aa, Oryza sativa Japonica Group
MSCSSEKAAGAVGGKAARACDSCLRRRARWYCAADDAFLCQGCDTSVHSANPLARRHERLRLRVSSPPPLTARASVEEEAAAAVGTTTTTTSKREGGVTPAWSKRKARTRRPQVKSVGQLLSRRLVVPEMAVESSDERKADEDGAHEELEGQLLYRVPVFDPSLAEFCSPPPIDDAAAASSSCFKEDAADGAVEDAKYPAAAASSPVQQLPDSFVNFEPTDAELREFAADMEALLGQGLDDSNELQDSFYMETLGLITPPVEESGRVKMELDGGVASNSRVSLPSCRAHPKPEDVESADVLDIDFNCTSPDEQKSSASNGAAADSQFFHRSLDLRLNYEAIIESWGNSPWTDGRPPHGQLDDFWPNDHHYSGLWAAGGGGHGAEVGMMTVRPRMDGPGREARVTRYREKRRTRLFSKKIRYEVRKLNAEKRPRMKGRFVKRPSAAAAPCAVT

SEQ ID NO: 5010 - protein, 211 aa, Glycine max
MVRRKIPIKKIDNVTARQVTFSKRKSGLFKKARELSLLCDSEIALIVFSPGGKLFDYASSSMQKVIERHILWSELNLEKLDQSCPTEQLRCNYADLNKEFGDRIREMRQLNGEELQGLALRELQKLEERLVSSLNRVYKAKVENFTREIDILKQKGNKLMEDNRLMKQRIKPRNEICSVQRHEHEQGRSFDTSLTLGLSFPAGSKYRVSEQ

SEQ ID NO: 5011 - protein, 957 aa, Ustilago maydis 521
MLLMLLLLLLLLLLLLVLHLRLGLNCTDDVAFSAFVSSTLPLTSANLSHSVWSIRDQFNAQSSTIAYCALPIFAAAASSSSVRPLSFVTLFYFATLVISITAVAFFNLRLSVLRGSPPLRCKLCSASRVPGHSSTQIGWPSTRSTSLLHVPFTLHPSILSTHTGFTATSVFALLTPAHAAVYNLPSPNYFVALTGRDVSITAVESSPSRCIFPAEASSTATSTPRTLHWYRFFTLLIIATRFEQAHRLLDSTCQPIDLTAGVACFGSPLSSSYPASPAASWSARYPSDPSSNIGNPSPRFGSITGACSERPADTSSSEQRLSSPPAASTRSSETSFDRHSVSSLGQRSISTVATLAFSHDIEPLPPITSLGIAKTDLVPPRIGSTKAAAFTMNPSEKADLVARRVSPPSASLRRPASPAGRISNHSAEWDIHSDRGSPRIAGRRSGPPLPAASVPYARGYASSPRDTYREAAYRDPRELSPPTASSGLKRKPSISSDIGARRAPPERVERNGSAWHTTPDYPSRAAAYAEADYYRARGRGETPERTYHSAYSRDAAYATHYADPRMEDPRYSPRHSYPTSPSTSRTAYRSGAHDTAAPGGHPYAPVSRRSDRYSPASLPRSPSYAPRQALPPPQAPPPPHDPYSRSAPHSSYLRRPSPPSYISDTRPVLPPLSSRATAPRYPAAPAAPAHASRSSRYTPPSMDPMAHSDRLSASPEPHGYPEPFYPDRRLYFARERIQDAEMDEYYHGPLGSAGGAGGKVRYGDAYYDAYGPAPGGAYAPAGAHAGGQAGNGGGRMASPGVAPMGAHTGARHAAEARYAGAYSGGEYMQDARDMHAHAGVPRMGRAGGVMPMAAAHVPPGPAAGIAPPPRRRGKLPKPVTDLLKTWLLEHASHPYPTEDEKRSLCSMTGLTLSQVSNWFINARRRILLPAGANGSPATSTAAQVKAAFRDDSNSPEA

SEQ ID NO: 5012 - protein, 643 aa, Nicotiana tabacum
MKMKSMNDDNNNCSSHRSSNNNNNNNSNSHNDASSNWLGFSLSPHMKMEVTSSEPQHQHHQFNNQSSALAQSFYLSSSPMNVTSNTSALCYGVGENNPFGHSSLSVMPLKSDGSLCIMEALSRSHADAMVQSSSSPKLEDFLGGASQYGNHEREAMALSLDSLYYHQNEGYYSPMHCHGMYQESLLDETKPTQISHCDAQMTAVSGNELKSWGHYAIDQHINETCSSMVGAGGGGGTSGSGGGTVGGNDLQSLSLSMNPGSQSSCVTPRQISPNELECVAIETKKRASGKVVQKQPVHRKSIDTFGQRTSQYRGVTRHRWTGRYEAHLWDNSCKKEGQTRKGRQVYLGGYDMEEKAARAYDLAALKYWGPSTHINFPLENYQKELEDMKNMTRQEYVAHLRRKSSGFSRGASMYRGVTRHHQHGRWQARIGRVAGNKDLYLGTFSTQEEAAEAYDVAAIKFRGVNAVTNFDISRYDVEKIMASNTLPAGELARRNKEREPIEYNLSDHKNEEACVQNDNNNNNGNNVTDWKMVSYQSSNPSLGNYRNPTFSMALQDLIGIDLMNSSNHPILDDQQNKIGNHFSNASSLVTSLGSSREASPDKSAASLVFAKPTNVNACIPSAQLRPIPVSISHLPVFAALNDA

SEQ ID NO: 5013 - protein, 168 aa, Helianthus annuus
SSVDASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVSDGPRKLRITGIEYPQPGFRPAERLQETGRRLANYCERFNVQFEYNSIASQNWETVKIEDLKLQRN

(The sequence listing continues in the following parts.)

What is claimed is:

1. A method for manufacturing non-natural, transgenic corn seed that can be used to produce a crop of transgenic corn plants with an enhanced trait resulting from expression of recombinant DNA in a corn plant nucleus, wherein the recombinant DNA comprises a nucleotide sequence encoding a protein having at least 95% amino acid sequence identity to SEQ ID NO: 148, wherein said method for manufacturing said transgenic seed comprising:
- (a) screening a population of corn plants for said enhanced trait and said recombinant DNA, wherein individual corn plants in said population can exhibit said trait at a level less than, essentially the same as or greater than the level that said trait is exhibited in control corn plants which do not contain the recombinant DNA, wherein said enhanced trait is selected from the group of enhanced traits consisting of enhanced water use efficiency, enhanced osmotic stress tolerance and enhanced drought resistance,
- (b) selecting from said population one or more corn plants that exhibit said trait at a level greater than the level that said trait is exhibited in control corn plants, and
- (c) collecting seeds from selected plant selected from step b.

2. The method of claim 1, wherein said method for manufacturing said transgenic corn seed further comprises verifying that said recombinant DNA is stably integrated in said selected corn plants, and analyzing tissue of said selected corn plant to determine the expression of the protein.

3. A method of producing hybrid corn seed comprising:
- (a) acquiring hybrid corn seed from a herbicide tolerant corn plant which also has stably-integrated, recombinant DNA in a plant nucleus, wherein the recombinant DNA comprises a nucleotide sequence encoding a protein having at least 95% amino acid sequence identity to SEQ ID NO: 148;
- (b) producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA;
- (c) selecting corn plants which are homozygous or hemizygous for said recombinant DNA;
- (d) collecting seed from the selected corn plants and planting said seed to produce further progeny corn plants;
- (e) repeating steps (c) and (d) at least once to produce an inbred corn line; and
- (f) crossing said inbred corn line with a second corn line to produce hybrid seed.

* * * * *